United States Patent 8,344,211 (PLANT NUCLEOTIDE SEQUENCES AND CORRESPONDING POLYPEPTIDES) - sequence listing, part 21

SEQ ID NO: 79628 - DNA, 804 bp, Zea mays
  misc_feature: Ceres CLONE 1564751
  misc_feature: Encodes the peptide sequence at SEQ ID NO. 79629
  misc_feature (313)..(313): n is a, c, t, g, unknown, or other
ctggagctcaccgcggtggcggccgctctagaactagtggatcccccgggctgcaggaattcgtctcacccctagaaaaaagcgggggctggagcactcaccactcagcagcgatcgcagcaccgcggcgagataatgagcagcagcctgtcctccggcatctctgcctcgccatctgcagcggccagcaccgctcggcgccgccatgacgcagcgccgcagcagctgacgagggtgaaggcggcggcgcggccacagctgctgcacgccggccgccggcgttcgagtgtcgggaggaggccgggcggcggcngcggtggtggtgagggccgggcctgggccactgtcggagatcgagccggacctggaggaggacgccatcgacgtgtaccgcaccaacggcatcagcccggaggacttcgagtacgggaagtatgacggacaccacacctatttcgaaggtcaagacaagaagggcttctgggaggatgtctccgagtggtaccaagaagctgagcctcctcagggctttcaagcactcatctcctgggcatttcctcctgcgatcatcctcggcatggctttcaatgtgccgggggagtacctgtacatcggggcggccgtcttcatcgtggtgttctgcgtcatcgagatgggcaagcccgacaagccgcacaacttcgagccggagatctactttgatgggagaggtcggcccgcgacaagctcatcgccgactacaactccatggacatctgggacttcaacgagaagtacggcgagctctgggaactcacggtcaac

SEQ ID NO: 79629 - protein, 75 aa, Zea mays
  misc_feature: Ceres CLONE 1564751
MAFNVPGEYLYIGAAVFIVVFCVIEMGKPDKPHNFEPEIYFDGRGRPATSSSPTTTPWTSGTSTRSTASSGNSRS

SEQ ID NO: 79630 - DNA, 806 bp, Zea mays
  misc_feature: Ceres CLONE 1564753
  misc_feature: Encodes the peptide sequence at SEQ ID NO. 79631
ctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacaggtcgctggaggtgatccacgggcggtgggcgatgctgggtgcgctgggctgcatcaccccgggagtgctggagaagtgggtgcgcgtggacttcaaggagcccgtgtggttccaggccggcgcgcagatcttctcggaggccgggctggactacctgggcaacccccaacttggtgcccggccaaaagcatcctgggccgggctcgggcttccaggtcatccctcaggggccccgggcggaggggttccccattaacgggccccaaaggggggtgggggaggggaaaaaaacctcttcccccggggggggcggggatttcacccccctgggggcccctccccaaaaaaccccc

SEQ ID NO: 79631 - protein, 184 aa, Zea mays
  misc_feature: Ceres CLONE 1564753
  misc_feature (69)..(185): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRSLEVIHGRWAMLGALGCITPGVLEKWVRVDFKEPVWFQAGAQIFSEAGLDYLGNPQLGARPKASWAGLGLPGHPSGAPGGGVPH

SEQ ID NO: 79632 - DNA, 852 bp, Zea mays
  misc_feature: Ceres CLONE 1564757
  misc_feature: Translation starting site: 219
  misc_feature: SWISSPROT Homolog: EC 1.1.1.29 Glycerate dehydrogenase
ccccgcggtggcggccgctctagaactagtggatcccccgggctgcaggaattcgtctcacccctagaaaaaaaaaggaggagaaaacgaaaatgaaatttctggcgcctgtctgcccgccccctgataaggccggcgagagagagagagagagagagagagagagagagagagagagagagagagagagagagagagagagcgcgagagagacacagatgtggaccctgcgcgtgcagcaccgcgtggtccgctccaagtccctgccgggcactccagggatccggctgctcgcgcacgcccactgccgccttctggatcgcagcgagctctacagcgtcctctccatggacgacatcgtgggactcctcggcgatcactgcgaccgcgtccttggacaactcaccgacgcctgaggggacgtgctcttctcggctcttcaagcgcgccagacgcacagtgttcagcaacgtgcccgtcggctacaacaacgtcgatcgtcacgctgccaacgggtatggcatcgcattcgcccacacgccgggcgtcccgaccgaaacgacagctgagctcgacgggaccctctcgctggccgcagcctggagcatccgcgaggctgacccgccctttagggctggccaggtttgccgaatggctccccaccctggcccattggggacccgggtcaagcgccaaaatgggggcaaccattcgaatctgttcccagttggctccccccttccccccccgtatgaaccgaggagctccagaggggatcccctttcctcctcggcgcttgatatccgggcccacccgcggcctcaaaatttttggcccacattttttgggacg

SEQ ID NO: 79633 - DNA, 917 bp, Zea mays
  misc_feature: Ceres CLONE 1564758
  misc_feature: Encodes the peptide sequence at SEQ ID NO. 79634
ccccgcggtggcggccgctctagaactagtggatcccccgggctgcaggaattcgtctcacccctagaaaaaacaccatcgacgacagcgcagctgattctgtcccaaatcattcttccgtggcgccggcgaccttgctactggagagactggccgtggagtgcgcgctggcgctcggacgccatggcgcagctgtcgccgagcatctacgacccgcgctgccccatcctgcatgccatcgtgcgggccgggatggccgcccccgtgcagcaagacccgcggatgggggcctccatcctccgcctcttcttccacgactgcttcctccagcggtgcgacgcgtccgtgcttttcgacgactcgccgacgctgacggtggagaagaacgctcggcctaactccaacttgggtgcccggcttccaggcgatcgactgcctcaaataccatgtggaggccgattgcccccgcaccgtcatcctgcgccaacatcctcgccctcaccgcgcgcgacagcgtctacctggctaaccggccccacgtgcgcggtgcacctgggtctccggggacacgcgcacggcgacccatttggcgccggaacatcaaccgttcgtatttggacacctaatgcggcggccctggttgtaagcttttccccccccacgtgccccgcccacatcagaccttgttggaccctttcgggacgcgcccatctatcattccgccgcacgatgcgtccaacttcccatggccccgcgtggtactagcgacccctctaattctatgcccgggttttcgtcgggctaagggagaaggcgaatattttgccgtgtgtccaaggtcccggggaccgcatgctacggcttaacttggagggacccgcttgggctagccatatgggcctctctgatcaggaagt

SEQ ID NO: 79634 - protein, 193 aa, Zea mays
  misc_feature: Ceres CLONE 1564758
  misc_feature: SWISSPROT Homolog: EC 1.11.1.7 Peroxidase
MAQLSPSIYDPRCPILHAIVRAGMAAPVQQDPRMGASILRLFFHDCFLQRCDASVLFDDSPTLTVEKNARPNSNLGARLPGDRLPQIPCGGRLPPHRHPAPTSSPSPRATASTWLTGPTCAVHLGLRGHAHGDPFGAGTSTVRIWTPNAAALVVSFSPPTCPAHIRPCWTLSGRAHLSFRRTMRPTSHGPAWY

SEQ ID NO: 79635 - DNA, 890 bp, Zea mays
  misc_feature: Ceres CLONE 1564762
  misc_feature: Encodes the peptide sequence at SEQ ID NO. 79636
ccccgcggtggcggccgctctagaactagtggatcccccgggctgcaggaattcgtctcacccctagaaaaaatcccgattccccatctcgccctgtccgccgaagagcgcgcaagcaccaccgtcccggcagcgcggagatcggtccactccatccacgcggcgtcaggcgagcggggcgcacggacgctgcgaccgatggatctcaaggatagcctctccaaatttaagcaacagcaggagagatgccagtcatcactggcgagcatagatgcttcaacctcaaagccaaagcacagggcccaaccagcgcatgctcctaacgtcccagcaagaccatcacaacctattaagttttcaaatgatacagaaaggctgcagcacatcccccccattaggaaatctcctgttggagcacagatcaagcttgtcattgaacttctttacaagacaagacaagcttttactgcagagcagataaatgaagcaacttatgttgatattcacggtaataaagctgtctttgacagcttgagaaacaaccccaaagtaagctatgatgggaggcgtttctcttacaagtccaagcatgacctgaagggaaaagatcaactgcttgttttgatttaaaagttcccaaaaggtcctgctgttgtgggaagtcaaggatgcatttttcgaatggtttggaaagaatttgcaggcttctgaaaggctgcttggtgaaggctttgggctggtaattaaaacatgggacttcccggggagggacatttgtaataccccaaaatggatccggaaaagcaaaaagatacaaggggttggatggaaaggaacctggaaaggcaaattttatttccgttggaaaaataatgaaccgtgtcctacgg

SEQ ID NO: 79636 - protein, 143 aa, Zea mays
  misc_feature: Ceres CLONE 1564762
MDLKDSLSKFKQQQERCQSSLASIDASTSKPKHRAQPAHAPNVPARPSQPIKFSNDTERLQHIPPIRKSPVGAQIKLVIELLYKTRQAFTAEQINEATYVDIHGNKAVFDSLRNNPKVSYDGRRFSYKSKHDLKGKDQLLVLI

SEQ ID NO: 79637 - DNA, 812 bp, Zea mays
  misc_feature: Ceres CLONE 1564763
  misc_feature: Encodes the peptide sequence at SEQ ID NO. 79638
  misc_feature (533)..(533): n is a, c, t, g, unknown, or other
gcggtggcggccgctctagaactagtggatcccccgggctgcaggaattcgtctcacccctagaaaaaaaaactccgtttcgaattctagggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggatctgtgcagggtctgtgataacatccccattgtcctctgcngtaataaggttgatgtggagaacaggcaagtcaaagccaagcaggtttactttcccagggaagaagaatctgcagtactattgaaatttctgccaagagccactacaactttgagaaaccctttcttgtaccttgcaagaaaactgggctggggaatccaaacccttccctttgttggaaactggttgcccttaaaccctcccggaaattacccatccaacctgggtttttcccccaccccctttaaaaccaaacttttttggaaaaaagctgtacaac

SEQ ID NO: 79638 - protein, 216 aa, Zea mays
  misc_feature: Ceres CLONE 1564763
  misc_feature (15)..(174): Pfam Name: Ras Pfam Description: Ras family
  misc_feature (15)..(128): Pfam Name: Miro Pfam Description: Miro-like protein
  misc_feature (124)..(124): Xaa is any aa, unknown, or other
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCDNIPIVLCXNKVDVENRQVKAKQVYFPREEESAVLLKFLPRATTTLRNPFLYLARKLGWGIQTLPFVGNWLPLNPPGNYPSNLGFSPTPFKTKLFWKKAVQ

SEQ ID NO: 79639 - DNA, 828 bp, Zea mays
  misc_feature: Ceres CLONE 1564764
  misc_feature: Encodes the peptide sequence at SEQ ID NO. 79640
  misc_feature (396)..(396): n is a, c, t, g, unknown, or other
ctccccgcggtggcggccgctctagaactagtggatcccccgggctgcaggaattcgtctcacccctagaaaaaacgccacatcgccgtcggccaccacatgatgcacgcgcacgccgccatataatactagtactactgaaccacacgggggtcgccgtgcgagcgcaagcaacgacgccccggcccgcctactactagtaccgccgcatccaccatggctgcgcccgccgcggccaagcgcccgtactggcaggcccccgccgcagcagctgagcccaacaagcggcaccgcacggccgcggcgccggcgcacatggacgcggagccggagcaggaggaccagcccctgctcccgggcctgccggaccacctcgcccagctctgcctccccccnctcccgccgctcctcctgcacgccgtctgccgcccctggcgccgcctcctctactcgccctcgttcccgccgttcctcgcgctctacgccgtgctcgacgacgaggccgccgccttcgccggcagcggcgtctcgttcgcggcctacgacgccgtggcggggcggtgggacgagcttcccgcgccgccgatgccgtcgccgccgcccaggctgtggcacccggccttcctgtcccgccggctcccgctccagtccgtggccgcggggggcaggctcgtgctcgtggccggctccacgcgggcgctcgccccggcgctgccccgccccgtggtcttcgacccggccgccccgcgcctggcggctcggcccgcgccttcccgttcgcgcccgcccccggtggtgacgcggccgggaccccggcccgcgggagcg

SEQ ID NO: 79640 - protein, 204 aa, Zea mays
  misc_feature: Ceres CLONE 1564764
MAAPAAAKRPYWQAPAAAAEPNKRHRTAAAPAHMDAEPEQEDQPLLPGLPDHLAQLCLPPLPPLLLHAVCRPWRRLLYSPSFPPFLALYAVLDDEAAAFAGSGVSFAAYDAVAGRWDELPAPPMPSPPPRLWHPAFLSRRLPLQSVAAGGRLVLVAGSTRALAPALPRPVVFDPAAPRLAARPAPSRSRPPPVVTRPGPRPAGA

SEQ ID NO: 79641 - DNA, 813 bp, Zea mays
  misc_feature: Ceres CLONE 1564766
  misc_feature (341)..(341): n is a, c, t, g, unknown, or other
  misc_feature (360)..(360): n is a, c, t, g, unknown, or other
  misc_feature (368)..(368): n is a, c, t, g, unknown, or other
  misc_feature (384)..(384): n is a, c, t, g, unknown, or other
ctccccgcggtggcggccgctctagaactagtggatcccccgggctgcaggaattcgtctcacccctagaaaaaggccagccccatatcatgggggacgctccctcgccattctccatccgaacaaccttcaaagatctaataaaacccatagaaacttctctcgtttctctctccttggccccgggtagcgaacccttatcagtcgctctcgttggctcggagcagcgatgcgcaccgcctgcctccgccccaaccccgccattggtataaaagcctcccctccgcctccctccttccgccactgctaggtccagccacacccgcgctcgccccggccanccgccgccgcgctctcacnggtcccancctctccgtgggcatngagaagatgggccgcgtgcctccagggggacttcggcggtgggccgcccgttcgatctgaccccggccaggggggcggcgtcctggccccccccgggtgccccgatccgggggctgctggcccggaaaaaaaccccagcccccaaagggaaacttccaggggcggcccgggtcccccccaaaagccccaggaagggggcccccccccgggaaaaaacctctccccccgggacccggggaaggggggggccaccaactcttacgccgcagggccccccgttccctttttctctggggccctctgtttcttaaaaaaaaagtttttaaagaaaccgggggatttttttcccccccggggggggaccaccccaaggggggggggggggggcccccccaaaatccccgggagaaacaaccccccccccaaaat

SEQ ID NO: 79642 - DNA, 889 bp, Zea mays
  misc_feature: Ceres CLONE 1564772
  misc_feature: Encodes the peptide sequence at SEQ ID NO. 79643
ctccccgcggtggcggccgctctagaactagtggatcccccgggctgcaggaattcgtctcacccctagaaaaaactgctcgagctcagctcaaggaaccacagaaaatggcgtcacttctccgccctctcgtcctcgtgctcctgatcgcctcctgcgcagcgcagcagtcaccgccggcgcaggccccgccaacgccgaacgcgccaccggccaactcgccgccccaggcgcctccagccggaaacccgccgccggcgccccaggcgccgccggcaggcaacccgccacctgcgcccaccgccactccacctccggccccgaccactccgcccccggccccgaccacacctcccctggctcccacaacgccgcccccggcgccgacaactccacctccggcccccaccacgccgcctccgtccccaccggcgtcgccaccgcccgctcccaccactccgccaccgtctcccccggcaagcccgccgcccgctcccgccaccccgccaccggtctccacccatggggccacctcccgccacgccccctccacccgccaccccgccgccaccggccgcgcccacgccgggcccgaacgtggccccgaatcccccgcccgtggcgacaccggctgcgttcccccagaagccggaagaaacctgaagcccgtccgccgccgacgtcccccgggggccctcggttctttgcccacggggaacgccgaaggaaacaaagacctggggggcaaagcgatattccccggttcgggtttttgccccgggggggtggaggtttttgcgaggtagcggggccttttacccagtcctaggtttttaaaaaacctgaaatcgccaaaatacgttggttactcgggtcgcacgaatcaccg

SEQ ID NO: 79643 - protein, 232 aa, Zea mays
  misc_feature: Ceres CLONE 1564772
MASLLRPLVLVLLIASCAAQQSPPAQAPPTPNAPPANSPPQAPPAGNPPPAPQAPPAGNPPPAPTATPPPAPTTPPPAPTTPPLAPTTPPPAPTTPPPAPTTPPPSPPASPPPAPTTPPPSPPASPPPAPATPPPVSTHGATSRHAPSTRHPAATGRAHAGPERGPESPARGDTGCVPPEAGRNLKPVRRRRPPGALGSLPTGNAEGNKDLGGKAIFPGSGFCPGGVEVFAR

SEQ ID NO: 79644 - DNA, 797 bp, Zea mays
  misc_feature: Ceres CLONE 1564773
  misc_feature: Encodes the peptide sequence at SEQ ID NO. 79645
  misc_feature (39)..(39): n is a, c, t, g, unknown, or other
  misc_feature (375)..(375): n is a, c, t, g, unknown, or other
  misc_feature (605)..(605): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (752)..(752): n is a, c, t, g, unknown, or other
tccccgcggtggcggccgctctagaactagtggatcccnccgggctgcaggaattcgtctcacccctagaaaaaactccatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggtttaaatatgaancttgaccagaaaactgggactgatcaaggtgggacccgtggtgctgtatttccatccaattttggtttttccccccccccccaaatctgggggggggttttttttctcccccccccccccccctttttttaaaaaaaagggaccccctccgggggggggcggggggggttaaataaaaggagggaggagtttttttttttcttccctcgatgggggtttttttttttttntgnnnttttttttaattttttcttttctcgtgttcctggttagaggtgggaggagggttacgcgccccccatgactaaggttggttgtgggggggtggtcgcactgttgtggtgttaaatgagttgaaattgagtttaaagttgtantaattatgtttactaaagaaatgtgtgttattgtggattgagtat

SEQ ID NO: 79645 - protein, 63 aa, Zea mays
  misc_feature: Ceres CLONE 1564773
  misc_feature: SWISSPROT Homolog: EC 3.6.1.1 Inorganic diphosphatase
MAPAVEAVKETGTFQKVPALNERILSSMSRRSVAAHPWHDLEIGPGAPTIFNCVIEIPRGSKV

SEQ ID NO: 79646 - DNA, 839 bp, Zea mays
  misc_feature: Ceres CLONE 1564775
  misc_feature: Encodes the peptide sequence at SEQ ID NO. 79647
  misc_feature (444)..(444): n is a, c, t, g, unknown, or other
ctccccgcggtggcggccgctctagaactagtggatcccccgggctgcaggaattcgtctcacccctagaaaaaaccccaactcgctcccttccccgtgcttcccgccgtcgtggagaggtcacgcggctggttcccgccgcttccggacgggttccgagggaggaggatcagctgccgcgatgttcctcaggatctctcgtctcggggcgcggcttctgcgcgagtctggagcggagacgagagctggaaatttgctaagcagtccaggcattttgtatcaagctcatcttaaccagcattcgaccagagtggtgacttctactgtattatcgttgttaagaactaaagattggtagtgaataatctatttagatgaacatgttcccaattaccattcattcttgctaatagtaaatgtatcactaggtattgattcaccttnatgatcttacattgattttggactatatctaatattttcaatgaatttggtttctaatccgatgaatctatctatacatttccccaatcttgaaaacggctgttgcaaaaagaaaaccggcctttattttttccccacacaagttaactttttttgaagaactaccagccaaagccctttgttcctttttgacctgccaggaatggtgggtttcctatccccagggtttaattgggaattaaatttttttggttttaaaaaatttttccgggggaaagggccttttttccccacgggcaacaaaagggggggtccccgggatttaaaaaaccttcccgggccaaggggaaaaaaactccggggagaacatttttttataaaaaggggggggcccc

SEQ ID NO: 79647 - protein, 58 aa, Zea mays
  misc_feature: Ceres CLONE 1564775
MFLRISRLGARLLRESGAETRAGNLLSSPGILYQAHLNQHSTRVVTSTVLSLLRTKDW

SEQ ID NO: 79648 - DNA, 804 bp, Zea mays
  misc_feature: Ceres CLONE 1564777
  misc_feature: Encodes the peptide sequence at SEQ ID NO. 79649
  misc_feature (374)..(374): n is a, c, t, g, unknown, or other
  misc_feature (401)..(401): n is a, c, t, g, unknown, or other
  misc_feature (518)..(518): n is a, c, t, g, unknown, or other
  misc_feature (629)..(629): n is a, c, t, g, unknown, or other
ccccgcggtggcggccgctctagaactagtggatcccccgggctgcaggaattcgtctcacccctagaaaaagggcgctcggggagcgccgcggcgccggcgtccgggtgatggcgttcgtcaccttcgcggggctcaggcccagggacgtggacctcgtggcccgcgccgtcctgcccaagcactacatggagcagctcagcgcgctggcgtacggcagcctctggctcccggccaggaggaaggtggcggtgaccagcgcgccgcgggtcatgtccgagtggttcctcaaggagtacatggccgccgacgcggtggtcgggctcgagctgcagcacgtcaacgtcggccgccgccggtacttcactgggttngctgctgtcgtccggtcacgcgacggnaacggagcttgagcagaaggcgaatcacggaggcgttgttaggcgccgaggacgacccccattggccgtcgtggggcatcatcagcgactccagcccggctcgacgacgagctcttncgtcccctactgcagggaccttttacgtcgtggagcagagagagcgcaaagaacgacaagctctcggcgggagaaatacccaaagccgctcatcttccacgacgggcgccntcggcttcctcccccaccccggcggcatgctcgcccttctcctcttctttcggctcggcgtcgtcctctccgtcatccgcattacaatcggtatcgttctcccttacaagatcaacttcgcgaacagcgccaatcttcggcgtcggctttcggggcctcggggcctccggggccc

SEQ ID NO: 79649 - protein, 100 aa, Zea mays
  misc_feature: Ceres CLONE 1564777
  misc_feature: SWISSPROT Homolog: EC 2.3.1.15 Glycerol-3-phosphate O-acyltransferase
  misc_feature (88)..(88): Xaa is any aa, unknown, or other
MAFVTFAGLRPRDVDLVARAVLPKHYMEQLSALAYGSLWLPARRKVAVTSAPRVMSEWFLKEYMAADAVVGLELQHVNVGRRRYFTGXAAVVRSRDGNGA

SEQ ID NO: 79650 - DNA, 918 bp, Zea mays
  misc_feature: Ceres CLONE 1564780
  misc_feature: Encodes the peptide sequence at SEQ ID NO. 79651
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (311)..(311): n is a, c, t, g, unknown, or other
  misc_feature (808)..(808): n is a, c, t, g, unknown, or other
  misc_feature (809)..(809): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagctggagctccccgcggtggcggccggctctagaactagtggatcccccgggctgcaggaattcgtctcacccctagaaaaaatactttccaacctagggttcgcggagccggggatcttcttcgcattcgctttcctgctccatggggctcgttgcagaaagaagggagctggggcacttttaaaccagaaggtgggaaactggaagagcatggncctacacgctggtttttctgcgttccagtgttctccgtgcaggcagtcctggtgttcgtcgttcgggcccaggcttggttagagacgagaaccatgatctcgggaggaaggaaatcgcggaaatacttcgtacggaacgccccacgcccgggtttggaaaaaaacccaaagggtttttgcaccataccccgtttgtttggggcaacccttttttttctcgggggcccccggggaaacccccttccccgaaagaaacctaacggggttccaaaaccccgggaaaataccggggggggccgggtcccccttggggggcccacaaaaaaaaaaattccccctccccaaaaaaaggagaggggggggaccccccccgcccaaaaaaactcctccccgggggggtcttttttttttttttcctcccccaaaaaaacgggggggggggttttcccccccccggggtgttttttcttgggggggggggggggccccccccgggnnccacagagaaaaaaaccccccccccccctcttaaggagaggggaacacacgggtgtttccccccccgcggggtttttttctttaaaaaaaaaaaaaaattccttccccc

SEQ ID NO: 79651 - protein, 100 aa, Zea mays
  misc_feature: Ceres CLONE 1564780
  misc_feature: SWISSPROT Homolog: EC 3.1.11.6 Exodeoxyribonuclease VII
  misc_feature (74)..(74): Xaa is any aa, unknown, or other
KKLELPAVAAGSRTSGSPGLQEFVSPLEKILSNLGFAEPGIFFAFAFLLHGARCRKKGAGALLNQKVGNWKSMXLHAGFSAFQCSPCRQSWCSSFGPRLG

SEQ ID NO: 79652 - DNA, 992 bp, Zea mays
  misc_feature: Ceres CLONE 1564781
  misc_feature: Encodes the peptide sequence at SEQ ID NO. 79653
  misc_feature (992)..(992): n is a, c, t, g, unknown, or other
agctccccgcggtggcggccgctctagaactagtggatcccccgggctgcaggaattcgtctcacccctagaaaaagaccgaataaccacccgtctgccgctgtgccgcacggcccgcaccccgcacgagacccgtccttgaggggcacgtcctagatcggtggcgcctgcctctcgccgccgatacgacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactggtaagatgctcatggttgttgacaccaccccccccccggggtcagaaaccagttggagtaggcattaggcttccagggttgaacctggatggcgccgtgggcccaaaacaaggtggttttaaatggtattccccattaccagggaatctcacccggttccgtgtgttaaaaaattgtgccccgttgttttttttttaaaccccttttccgatttttccccaaaaagtttttttgtggttagggggggtgggtgaacaatcctcccccgcgtgttgggaaaaaaacgccttctttttttgggacgcgccctcacacgcggtgatcccgtcctctttttggtgagctaccgaagaagttgggggaaaaacccccccaattctatcataaaccccgcggcgccccgaccgaattttttcttcgaggggcacaagaaaaaagaaatactatcaccgccggcgagaaaaaggaaatacatatatcttgtttcccctttcggatagaaattaccccccacttctttcttatgggaggggatgtatcaaaaccgtcgaaaataatatttgtttggggacaaccacatcttctagtattcctgaagtgtatgggcgcctactacan

SEQ ID NO: 79653 - protein, 83 aa, Zea mays
  misc_feature: Ceres CLONE 1564781
  misc_feature (7)..(31): Pfam Name: zf-LSD1 Pfam Description: LSD1 zinc finger
MQSQIVCHGCRTLLFYPRGAPSVCCAVCHVVTNVPPPAMEMARLICGGCQTLLMYARSATTGKMLMVVDTTPPPGSETSWSRH

SEQ ID NO: 79654 - DNA, 836 bp, Zea mays
  misc_feature: Ceres CLONE 1564782
  misc_feature: Encodes the peptide sequence at SEQ ID NO. 79655
  misc_feature (421)..(421): n is a, c, t, g, unknown, or other
  misc_feature (434)..(434): n is a, c, t, g, unknown, or other
  misc_feature (569)..(569): n is a, c, t, g, unknown, or other
ccccgcggtggcggccgctctagaactagtggatcccccgggctgcaggaattcgtctcacccctagaaaaaacggggagacttaccaggtccagacatagcaaggattgacagactgagagctctttcttgattctatgggtggtggtgcatggccgttcttagttggtggagcgatttgtctggtttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatnggggatagatcanttgcaattgttggtcttcaacgaggaatgcctagtaagcgcgagtcatcagctcgcgttgactacgtccctgccctttgtacacaccgcccgtcgctcctaccgattgaatggtccggtgaagtgtcatccgggnaaacaggggggggggggggtttcccccccccccgacgtcgcgaagaagtccattgaaccttatcatttagaaggaaaggagaagtcgtaacaaaggtttccggtaggtgaaccttgcgggagggatcattaaacctcagcactagtctcctcttcgcacgagcgcaacaccatcccacccaccatttcgaagcggaagcgaccggcaacctggcggcggatatgtcaggcaaggggcagggcggcaagggtgctccggaagggccgc

SEQ ID NO: 79655 - protein, 54 aa, Zea mays
  misc_feature: Ceres CLONE 1564782
  misc_feature (37)..(37): Xaa is any aa, unknown, or other
MPSKRESSARVDYVPALCTHRPSLLPIEWSGEVSSGXTGGGGGFPPPRRREEVH

SEQ ID NO: 79656 - DNA, 808 bp, Zea mays
  misc_feature: Ceres CLONE 1564783
  misc_feature: Encodes the peptide sequence at SEQ ID NO. 79657
  misc_feature (428)..(428): n is a, c, t, g, unknown, or other
  misc_feature (482)..(482): n is a, c, t, g, unknown, or other
  misc_feature (622)..(622): n is a, c, t, g, unknown, or other
  misc_feature (650)..(650): n is a, c, t, g, unknown, or other
  misc_feature (808)..(808): n is a, c, t, g, unknown, or other
tccccgcggtggcggccgctctagaactagtggatcccccgggctgcaggaattcgtctcacccctagaaaaagggcgctcggggagcgccgcggcgccggcgtccgggtgatggcgttcgtcaccttcgcggggctcaggcccagggacgtggacctcgtggcccgcgccgtcctgcccaagcactacatggagcagctcagcgcgctggcgtacggcagcctctggctcccggccaggaggaaggtggcggtgaccagcgcgccgcgggtcatgtccgagtggttcctcaaggagtacatggccgccgacgcggtggtcgggctcgagctgcagcacgtcaacgtcggccgccgccggtacttcactgggttgctgctgtcgtccggtcacgcgacgggaacggagctgaggcagaaggcgatcancggaggcgttgttaggcgccgaggacgacccccattgccgtcgtgggcatcatncagcgactccagcccgctcgacgacgaagctcttcgtcccctactgcagggaacctttacgtcgtgagcagagagagcgcatagaacacagctcctccgcgggagaaatacccaagccgctcatcttccacgacgggggncttggccttcctcccccacccccggcgncatggttcgcctttcttcctcttctttccggctcggcgttcgtccctctcccgtcatcggatttaaacaatcgggttattcctccccccttaacagatcacttcggggaacagcggcgatatcttcgggggtccggttttccggggcctccgggcctn

SEQ ID NO: 79657 - protein, 145 aa, Zea mays
  misc_feature: Ceres CLONE 1564783
  misc_feature: SWISSPROT Homolog: EC 2.3.1.15 Glycerol-3-phosphate O-acyltransferase
  misc_feature (106)..(106): Xaa is any aa, unknown, or other
  misc_feature (124)..(124): Xaa is any aa, unknown, or other
MAFVTFAGLRPRDVDLVARAVLPKHYMEQLSALAYGSLWLPARRKVAVTSAPRVMSEWFLKEYMAADAVVGLELQHVNVGRRRYFTGLLLSSGHATGTELRQKAIXGGVVRRRGRPPLPSWASXSDSSPLDDEALRPLLQGTFTS

SEQ ID NO: 79658 - DNA, 621 bp, Zea mays
  misc_feature: Ceres CLONE 1564784
  misc_feature: Encodes the peptide sequence at SEQ ID NO. 79659
  misc_feature (525)..(525): n is a, c, t, g, unknown, or other
ctccccgcggtggcggccgctctagaactagtggatcccccgggctgcaggaattcgtctcacccctagaaaaaactactttgagctgcaaggtccgaactaaaaagcacaagaaatggcggccgccttctcctccaccgtcggagctccggcctccaccccgaccaggagcagcttcctcgggaagaagctcaacaagccgcaggtggtccgcggccgtgacctaccatggcaagagctccagcagcaacagcaggtttcagggcgatgggctggccaaggaaggtggaaccaaaacgaaacccgaacccgaccaagacaggggggagggggcctgccctagaaaattttgggaaaaccgggcggggaattcccccgggggaaaggggccttcttttaaaaaaaaaacctttttttaaaggggggcccctttttggggggggaaaaaaggcccccccccccctttttcccccccgggggggtaaaaaaacccccccattggggaaaaaatatattttttttttnccccccggggggggggggcccaaaaaaaaaaaaagttttttttttaaaaaaaaaaaaaatttctttggagggaaaaaaaaaaaaattggggggggg

SEQ ID NO: 79659 - protein, 75 aa, Zea mays
  misc_feature: Ceres CLONE 1564784
MAAAFSSTVGAPASTPTRSSFLGKKLNKPQVVRGRDLPWQELQQQQQVSGRWAGQGRWNQNETRTRPRQGGGGLP

SEQ ID NO: 79660 - DNA, 971 bp, Zea mays
  misc_feature: Ceres CLONE 1564786
  misc_feature: Encodes the peptide sequence at SEQ ID NO. 79661
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (42)..(42): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (69)..(69): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (92)..(92): n is a, c, t, g, unknown, or other
  misc_feature (93)..(93): n is a, c, t, g, unknown, or other
nnnnnnnnnnttttaaaannccgcgggaacggtgcggcgtnncgccaacgaggnnngnccccgcacgcntttttnnnnnnnnnntctttttnnttgcatactggagctccccgcggtggcggccgctctagaactagtggatcccccgggctgcaggaattcgtctcacccctagaaaaacctcctcagctagcatcgatccgccattgctcaccgcacaagtgcaggctcacctcacacacgcagctaagtagctaacgccgtacgcaagaacaacaaaatgctcgacatggccgacgagaagaagcaggtcctgcagctgctggacttctgggtgagcacattcgggcagcgctgccgcatcgcgctggacgagaaaggcctgtcctacgagtacctggagcaggacctgacgaaaaagagcgagctgctcctccgcgcctaccacgtgcacaagaaaatccccgtgctgctggaccacggccacacccttctgccagtccctcgtgatggggggaatacctcgaacaaagcggttccctgcggggggatccgggcctttattccccaacaaacccttaaaccgtcgggcaaaaggccccgcttttctgggcggaaatataccccaaaaaaaaaaaatgggaaaaaaatggggggaaccacgggttttttggaaaaactctaaggggggaaccggcccaaagaccaaaggggccccccccccaaaaagggggcaaaaatatccccccccccccaatggggagaggcccccattctgggaaaaagggggccctctttttttttgggggaaaaaaccccggggggtttttctccaaaaaatattgaggattgtggccgcccttataaaaggggggagggtgcccccccccaacaaaaaaaacccttcgaggggggttctacgggggggaaaaaaaaaaagttgcccccagtttgtccccccccgaggaaga

SEQ ID NO: 79661 - protein, 131 aa, Zea mays
  misc_feature: Ceres CLONE 1564786
  misc_feature: SWISSPROT Homolog: EC 4.4.1.5 Lactoylglutathione lyase
MADEKKQVLQLLDFWVSTFGQRCRIALDEKGLSYEYLEQDLTKKSELLLRAYHVHKKIPVLLDHGHTLLPVPRDGGNTSNKAVPCGGIRAFIPQQTLKPSGKRPRFSGRKYTPKKKNGKKMGGTTGFLEKL

SEQ ID NO: 79662 - DNA, 833 bp, Zea mays
  misc_feature: Ceres CLONE 1564788
  misc_feature: Encodes the peptide sequence at SEQ ID NO. 79663
  misc_feature (512)..(512): n is a, c, t, g, unknown, or other
  misc_feature (523)..(523): n is a, c, t, g, unknown, or other
  misc_feature (532)..(532): n is a, c, t, g, unknown, or other
  misc_feature (533)..(533): n is a, c, t, g, unknown, or other
  misc_feature (549)..(549): n is a, c, t, g, unknown, or other
acccgcggtggcggccgctctagaactagtggatcccccgggctgcaggaattcgtctcacccctagaaaaaagagtcccagctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatgggttggaggggttgagctgtcaactaaagttgggtggtggccgtggccgagaccgtaacggttctgatatgaagtgctatgagtgtggtgaagctggccactttgcacgtgaatgccgcttacngattggttcanggagcttgnngtagtggaaggcgtcncaaccgaaagtctagatatcgaagccgcagccgcaaccgcagccgcaagccaagatatcgaagggaccccagctatagcagaagcccgcgagatcgttctcctagggagggaaagttacagcaggtcggcactggggatctcctggacgggagttcagcaaggtaaccggcccttgccgccgccttcttcccaaaaataaacaaccggtccccccctggaaaacccaaaaaaggaaccagggccccccccccccccttcctcccaaaaaaaaaaccagggcccc

SEQ ID NO: 79663 - protein, 110 aa, Zea mays
  misc_feature: Ceres CLONE 1564788
  misc_feature (4)..(71): Pfam Name: RRM_1 Pfam Description: RNA recognition motif. (a.k.a. RRM, RBD, or RNP domain)
  misc_feature (86)..(103): Pfam Name: zf-CCHC Pfam Description: Zinc knuckle
  misc_feature (104)..(104): Xaa is any aa, unknown, or other
  misc_feature (108)..(108): Xaa is any aa, unknown, or other
MARVYVGNLDPRVTAREIEDEFRMFGVLRSVWVARKPPGFAFIDFDDRRDAQDAIRELDGKNGLEGLSCQLKLGGGRGRDRNGSDMKCYECGEAGHFARECRLXIGSXSL

SEQ ID NO: 79664 - DNA, 869 bp, Zea mays
  misc_feature: Ceres CLONE 1564792
  misc_feature: Encodes the peptide sequence at SEQ ID NO. 79665
ctcaccgcggtggcggccgctctagaactagtggatcccccgggctgcaggaattcgtctcacccctagaaaaacccaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtccaccccatgaggaccgtgtaacactcatcaaggactaccgtggcaagattgaaactgagctccccaagatctgtgatgggatccctcaagcttctcgaatctcaccttgtgccggtctttcacccgctcccgaatccaagggcttcctatctcaagaagaaagggggactcctacagatacctttgctgaggttcaagaatgggagcttaaaaaaaaggaaccttcttgaaaaaccccctggtgggcataacaggcttcccccagaacatttgcttttgggtgaagactggttccaaccccacccctattaaggggttggggactggggccctccaactttcctccgggggttccaccaatagaagaaatttttcaacttccaccccgaaatgggcccccggaaagtccttgtcaaaaaaaaggggttttttttaacacaggcccccttcttcgggaaacacgggacaaccccccgtag

SEQ ID NO: 79665 - protein, 154 aa, Zea mays
  misc_feature: Ceres CLONE 1564792
  misc_feature (8)..(154): Pfam Name: 14-3-3 Pfam Description: 14-3-3 protein
MASAELSREENVYMAKLAEQAERYEEMVEFMEKVAKTVDSEELTVEERNLLSVAYKNVIGARRASWRIISSIEQKEEGPPHEDRVTLIKDYRGKIETELPKICDGIPQASRISPCAGLSPAPESKGFLSQEERGTPTDTFAEVQEWELKKKEPS

SEQ ID NO: 79666 - DNA, 962 bp, Zea mays
  misc_feature: Ceres CLONE 1564794
  misc_feature: Encodes the peptide sequence at SEQ ID NO. 79667
  misc_feature (518)..(518): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
agctccccgcggtggcggccgctctagaactagtggatcccccgggctgcaggaattcgtctcacccctagaaaaagcgggcagaaggcaaacgcggctgcgagcgcggcgcccctctcccactccccagccgccgccagcccgcacacccctccctcgcgcgctcagggtttcggaatggaagccgaggcggcggccaagaggacgcgggagagcggggaggacgccgccgcggcggggatctccgccgtcatcccgggatggttctccgagatcagccccatgtggcccggtgaggcgcactctttgaaggtggagaaggtgctgttccaagggaagtcagactaccaaaacgttatggtctttcagtcctctacgtacgggaaggtgctcgtccttgatggagttattcaggttacggagagggatgagtgtgcgtaccaagagatgatcactcacctgcccctttgctccatcaaagatcccaagaaggtgttggttatggaggggggaaaaanggggggttgtcnnncnnngagggttcccgggcatttcctctggtggaacaaaattgacattctgtggaaattgaccaagatggtggggtagatgttatcccaaaaccaattttttcccctccatttaagcttgtttggattttgaagaaaccctccctgttgtcatttacaccctttgggagatggggggtttgcctttttttgaaaaaatgcttccagaaaggtactttattgaacgccagtaaattgtgggaactcattcttgaatcgaaaagggcccctgcttcaagaacctttttttggagaagcccttttcctttcaaattgggggggcccaaaagctttttgcttcccaggtggggagtttgttatgcccccccaacccaggaagagccaatgggcttccatatggccccattattttgaaaaaattttgtttgtcct

SEQ ID NO: 79667 - protein, 143 aa, Zea mays
  misc_feature: Ceres CLONE 1564794
  misc_feature (28)..(140): Pfam Name: Spermine_synth Pfam Description: Spermine/spermidine synthase
  misc_feature: SWISSPROT Homolog: EC 2.5.1.16 Spermidine synthase
  misc_feature (114)..(114): Xaa is any aa, unknown, or other
  misc_feature (118)..(118): Xaa is any aa, unknown, or other
  misc_feature (119)..(119): Xaa is any aa, unknown, or other
  misc_feature (120)..(120): Xaa is any aa, unknown, or other
MEAEAAAKRTRESGEDAAAAGISAVIPGWFSEISPMWPGEAHSLKVEKVLFQGKSDYQNVMVFQSSTYGKVLVLDGVIQVTERDECAYQEMITHLPLCSIKDPKKVLVMEGGKXGGCXXXRVPGHFLWWNKIDILWKLTKMVG

SEQ ID NO: 79668 - DNA, 843 bp, Zea mays
  misc_feature: Ceres CLONE 1564796
  misc_feature: Encodes the peptide sequence at SEQ ID NO. 79669
  misc_feature (668)..(668): n is a, c, t, g, unknown, or other
  misc_feature (703)..(703): n is a, c, t, g, unknown, or other
ctggagctccccgcggtggcggccgctctagaactagtggatcccccgggctgcaggaattcgtctcacccctagaaaaaagtccctcgcctacctcgcccccgaaccttggcgtctgccctaccaaccgcagcagcgacactagaatggccgcggcgccgtcatccctcgcgtcctcccacctctccccaatcgcggcggtgtccactcccgccgtcccacattagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccattcatctatattgatcaggttaagaattcactaactggtcgcattgaggtttctgctcagaatgtgtggattggaaaaggaggagcctacaccggagagatcagtgcagaacaactggtggacatcggctgtcaatgggttattcttggacactctgagcgtagacatattattggtgaaaatgatgagtttattggaaagaaggctgcatatgcattgagccaaaatgttaagggtattgcctgcataggagagctgctngaagagagggaagcaggcaaaacttttgatgtatngtttaggcagatgaaggcttttgcagatagtatttcaaactgggcagatgttgtaattgcatacgaagcctgtttgggcgattggaaccggaaaagttgctactcctgagcaaggccaggaagttcatgctgctgtacca

SEQ ID NO: 79669 - protein, 179 aa, Zea mays
  misc_feature: Ceres CLONE 1564796
  misc_feature (7)..(177): Pfam Name: TIM Pfam Description: Triosephosphate isomerase
  misc_feature: SWISSPROT Homolog: EC 5.3.1.1 Triose-phosphate isomerase
  misc_feature (144)..(144): Xaa is any aa, unknown, or other
MAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKGIACIGELLEEREAGKTFDVXFRQMKAFADSISNWADVVIAYEACLGDWNRKSCYS

SEQ ID NO: 79670 - DNA, 816 bp, Zea mays
  misc_feature: Ceres CLONE 1564799
  misc_feature: Encodes the peptide sequence at SEQ ID NO. 79671
ctggagctccccgcggtggcggccgctctagaactagtggatcccccgggctgcaggaattcgtctcacccctagaaaaacccaaaacctcacctcgcagccaacctctgctcggaggggaagggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacacgcagtctccaggtcgacggcaaggtcatcaaggcccagatttgggacaccgccggccaggagaggtaccgtgcaatcacaagtgcctattaccgacgacccgtaggggcactgctggtctacgatgtcacccgtcgcaccacgttcgacaacgtgggccgttggctgagggagctcagagaccacaccgaccagagcatcgtggtgatgctggtcggcaacaagtccgatctccggcacctggtggccgtctcgaccgacgacgccaaggagttcgccgaggccgagtccatgtacttcatggagacgtccgccctcgacgccaccaacgtggacagctccttctcggaggtgctgacccagatataccagatcgtgagcaagaagacggtggaggtccccgaggagggggcggtcgccccgggcaagggggagaagataaacgtcaaggatgacgtttctgcgatgaagaggtcgggtgctgctcaaactaaagcgaatagccggatacca

SEQ ID NO: 79671 - protein, 227 aa, Zea mays
  misc_feature: Ceres CLONE 1564799
  misc_feature (19)..(180): Pfam Name: Ras Pfam Description: Ras family
  misc_feature (19)..(133): Pfam Name: Miro Pfam Description: Miro-like protein
  misc_feature: SWISSPROT Homolog: EC 2.7.11.1 Non-specific serine/threonine protein kinase
MAANGGGYRAEDDYDYLFKVVLIGDSGVGKSNLLSRFTKNEFSLESKSTIGVEFATRSLQVDGKVIKAQIWDTAGQERYRAITSAYYRRPVGALLVYDVTRRTTFDNVGRWLRELRDHTDQSIVVMLVGNKSDLRHLVAVSTDDAKEFAEAESMYFMETSALDATNVDSSFSEVLTQIYQIVSKKTVEVPEEGAVAPGKGEKINVKDDVSAMKRSGAAQTKANSRIP

SEQ ID NO: 79672 - DNA, 859 bp, Zea mays
  misc_feature: Ceres CLONE 1564800
  misc_feature: Encodes the peptide sequence at SEQ ID NO. 79673
  misc_feature (611)..(611): n is a, c, t, g, unknown, or other
ccgcggtggcggccgctctagaactagtggatcccccgggctgcaggaattcgtctcacccctagaaaaagaggaaaagcacgcgagagcttgtcggagggctctctgtctctgtgataaaccgatacgcagaggaagctgcggagaggtgtccctgctctgctggtgagctgcggccagcgggtgaagtgaagtggaccggacgtggacgaaggagagagagagagagagagaagaaagggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggctttccggccgccgaccaccatgaacttgctgtccgcgctcgacgcggccaaggccaccgtcggggagccagaaggccatggccaacgcaccggcgggaatccaggggaggcagcttggggaggaggcgcagcagctgaccatcttctacggcgggaaagtggtcgtcttcgacaggttcccctccgccaaggtcaaggacctgnctgcagatcgtgagcccgccgggggccgacgccgtggtggacggtgccggtgccggtgccgctgtccctacgcagaacctgcctaggccttcacacgacagtctctctgccggatctgccgatcgcgaggcggaactccgctgcacaggttcctcgagaagagaaaggacagggataccgcaaaggcgccgtaccaaagttcacagttccgtcgggcgctgaggcgtcccaggcggaaaaaacccctg

SEQ ID NO: 79673 - protein, 70 aa, Zea mays
  misc_feature: Ceres CLONE 1564800
  misc_feature (43)..(43): Xaa is any aa, unknown, or other
MANAPAGIQGRQLGEEAQQLTIFYGGKVVVFDRFPSAKVKDLXADREPAGGRRRGGRCRCRCRCPYAEPA

SEQ ID NO: 79674 - DNA, 850 bp, Zea mays
  misc_feature: Ceres CLONE 1564801
  misc_feature: Encodes the peptide sequence at SEQ ID NO. 79675
  misc_feature (627)..(627): n is a, c, t, g, unknown, or other
ccccgcggtggcggccgctctagaactagtggatcccccgggctgcaggaattcgtctcacccctagaaaaaacgtctttatacatgtgcaattcgccctgctgctatatatggaccaggtgaagagcgtcattttccaagaatcctgtcccttgcaaagttgggattagctttcttcaaaattggggacccaggtgtcaagacagattgggtttatatagataatctagttcttgctctgatattggcaagcatgggacttttagatgacattcctgacaggaagggaactcctgtagcagctggtcaggcgtatttcatatgcgatggatcaccatgcaatacttttgaatttatcatcaagcccctttttcaaagcttgggttattccgttcctcaagtggtgctggatacctccgttgcccttgccgtttcaagaatatttgtattcatatctacactgttctacccgaggcttgatagctaatggatgcctcagcctcgtattacacccgctgaagtttacgaagatggtgtcacacgctacctgtcgttcttgaacgctacagaggagctcggctacttgcccatggtgacgccccccaatggctaatctgcaacgactcntactgtcaaaaccgaacaaaaggcacctgattgcccgaacaaattcccttgctgggcgtaacacccggaacctgggcctgttttttttggtacgcccacacgggattcgccccttaaaagggggcccaaacctccccccattttttttcccccaaaaccctaaaacccccgggaattgggggggcccccacccataaaaggggggaaaccctgtgccccagtg

SEQ ID NO: 79675 - protein, 77 aa, Zea mays
  misc_feature: Ceres CLONE 1564801
MGLLDDIPDRKGTPVAAGQAYFICDGSPCNTFEFIIKPLFQSLGYSVPQVVLDTSVALAVSRIFVFISTLFYPRLDS

SEQ ID NO: 79676 - DNA, 810 bp, Zea mays
  misc_feature: Ceres CLONE 1564804
  misc_feature: Translation starting site: 447
ggcggccgctctagaactagtggatcccccgggctgcaggaattcgtctcacccctagaaaaaatccacacacgcgcctcgcctcccactcccccgaactcacacgccgcggcggagcaccaccgcggccgcccaccatgacctccgcctccaccttcctctctctgcgcctgcccactccctcccacgccacttcgtccctttccttccccccgtctctgctccggcaggcgcgtggcggtgtggcgtcctcgacgctggtggcgcgggcggcagggccaacgggagcggcgggagctccatcgccgctattcaacccccggggagacccgttcctgtctaccctcgcagccgcctcaccggaggaccttgcggccgccgctggtggcgagcgccgtggagaggaccacctgccgttcctcgagatcttccagaacaccaaactcatggcctcgcccgcgcaggtggaacggtctagcagctcgtatagtcagcacagacctagaaggcctcctccagatttgccttcattgcttcttcacggccgaatcgtttatattggcatgccgttggtaccagcagtgactgagctcatttgtgcccagttgatgtactttgaaatggatgaacagtaaagaacctgtttatatatacatcaactcaactgggacggctcgcgatgatggtgaaccggtcgggattgagaacgaagggttttcaatctatgatgcaatgatgcgtatgaaaactgaaatccccaccctttgtattagaacttgcagcaggccatgcatgttcttgggcttgcac

SEQ ID NO: 79677 - DNA, 817 bp, Zea mays
  misc_feature: Ceres CLONE 1564806
  misc_feature (585)..(585): n is a, c, t, g, unknown, or other
  misc_feature (653)..(653): n is a, c, t, g, unknown, or other
ctccccgcggtggcggccgctctagaactagtggatcccccgggctgcaggaattcgtctcacccctagaaaaaaataataaaaagatgattattgcgtgccgggggaggagatcgcacgggggttgatgtttttggccccgggttctcctccctcatcttgttccgtgttcctgtatgcgttgcttccgctcctgttggtccgctacgcacgccggatttttgcatcgagcacggagatctacaacaaaaacatggagctacgacgcgattcccaaggtacaatcgtaattatgttcaaacaatttttaagtcgtcctgcgctccttctattacgagcaacgttttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcaaaaatttaggtcgcagctacacaaatttacacgctgttctatattctatattctatnatatatttaggtcgcagctacccgtgaatctcctattttgaaaaggtcactgcttttttattccattncctatatctatattatattttggaataatcagcctcgtttaattgctttcagacttaatgttaagataattgtttacattttctacaattcagtctggactaattgctttgggactaaggttggaaatattcatatggatctgcgtcctaagcatttttcattt

SEQ ID NO: 79678 - DNA, 812 bp, Zea mays
  misc_feature: Ceres CLONE 1564807
  misc_feature: Encodes the peptide sequence at SEQ ID NO. 79679
  misc_feature (592)..(592): n is a, c, t, g, unknown, or other
  misc_feature (653)..(653): n is a, c, t, g, unknown, or other
  misc_feature (793)..(793): n is a, c, t, g, unknown, or other
  misc_feature (803)..(803): n is a, c, t, g, unknown, or other
ctccccgcggtggcggccgctctagaactagtggatcccccgggctgcaggaattcgtctcacccctagaaaaaaacactcgtcgatctacacacatacatagtttcttctactacacgacgacaaacatggggaagcctgcgaagatcggagagtggggtggatacgccggcgatcgtcgggatctgagggctactccggaccggctgaccgaggtgaaggtcacggcggacaacagcagctgcatccgctccatctccttcatctacatcggagccgatggcaagccgtacgaggaggggccatggggtttcggccatgctggcacggagtacaagattgatctgtgcaggttcgacgagagcttgacggagatctccgggaccacgggcccagcctacaacattgacaatctggtcaagtctctcaaatttgtcaccaacaaacgtacttacggaccgtacggcagggacgagggcaccccgttccgtgtcaaggtgatgaacaacggccacgtcgctggcttctttggccgctctggagattgcctggacgcgatcgggctctacgtcaaccccaactaataactaanacgatggatcggatcatctgcatgcatgcatatgcagtatgctgcttgcctagctgcctgntacgaatatgaatgcataaaataacgcccctgctgctccatatgcatcagcagtgtgtaccactatatatgttatatactggtatttcgctaccgaaataaaacaaaaaaactgacccagagcgatcggagctgacgacnatggccgggnaaggcggcg

SEQ ID NO: 79679 - protein, 151 aa, Zea mays; identical to SEQ ID NO: 57670
  misc_feature: Ceres CLONE 1564807
  misc_feature (15)..(150): Pfam Name: Jacalin Pfam Description: Jacalin-like lectin domain

SEQ ID NO: 79680 - DNA, 881 bp, Zea mays
  misc_feature: Ceres CLONE 1564809
  misc_feature: Encodes the peptide sequence at SEQ ID NO. 79681
  misc_feature (437)..(437): n is a, c, t, g, unknown, or other
ctccccgcggtggcggccgctctagaactagtggatcccccgggctgcaggaattcgtctcacccctagaaaaaggaaacccatcgcaaattcgcaaactaaccccaaaccccaatccaccccatcccctcctcatccactccgggcggccatggcctgctccttctccgccgccatcaccgtctcttccgcccctaccccggccgccagacccctcgctgctgccccgcagtccgtctgcatcgctcgctccgcggtcgccaccactgccaggccgctccgcctcgccgcctcaaggtccgcgcgggctaccagactcgttgcccgcgccagcgtagtcgatgacttgccgctggtcgggaacaaggcgccagacttagaagccgaggctgtgttcgaccaggagttcatcaacgtgaagctctctgaatacattngggaagaagtacgtccattctgttctttctacccccttggaatttcacccttcgtctgcccgaaacgaaaattactggcttttgggggacccaaaaccaaggaaattttgaaaaattgaaaaccttggggggttccttgggggggtttccaattgaaaagggggtttccccccccctttaaagggggccaaaaaaaaacaaaaaaaccgggggggtcccccaaaattttaaaaaaacccccctgtttttctggaggggcacacaaaaatatttttaaaggggccccggggggtgttcaaaaccccccaaacaaagggggtttttctttttttaagaaaaacgtgttttttttttttttctaaaaagggggggggggggagatatttcctcccccctctttctcccctttataaaaacaccctcttctcctcttcttgggggggg

SEQ ID NO: 79681 - protein, 134 aa, Zea mays
  misc_feature: Ceres CLONE 1564809
  misc_feature: SWISSPROT Homolog: EC 1.11.1.15 Peroxiredoxin
  misc_feature (96)..(96): Xaa is any aa, unknown, or other
MACSFSAAITVSSAPTPAARPLAAAPQSVCIARSAVATTARPLRLAASRSARATRLVARASVVDDLPLVGNKAPDLEAEAVFDQEFINVKLSEYIXEEVRPFCSFYPLGISPFVCPKRKLLAFGGPKTKEILKN

SEQ ID NO: 79682 - DNA, 816 bp, Zea mays
  misc_feature: Ceres CLONE 1564810
  misc_feature: Encodes the peptide sequence at SEQ ID NO. 79683
  misc_feature (442)..(442): n is a, c, t, g, unknown, or other
  misc_feature (607)..(607): n is a, c, t, g, unknown, or other
acccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccngcaacgcccgcagcatcccctccaagtgcggcgtcagcatcccctacaccatcagcacctccaccgactgctccaggggtgaactaaaacctagaccacgcgcgacgacggccgcctgatcgatcgaccaacatttccgccgttcgcgcccggcggatcatcggncggcggcatgataatatcatccaatcaccccgggaagatcgatgggctacttgcccacgggcttgtactacaaaataaaatcctcccccctgtgggtacccctacccttgcattggcctgggaacatggccctcccaaccccccccctgttaaaagttggaacacgttgaaaccgcacaaaaagaaaaaaaaacgggtccctctgaaaa

SEQ ID NO: 79683 - protein, 132 aa, Zea mays
  misc_feature: Ceres CLONE 1564810
  misc_feature (32)..(117): Pfam Name: Tryp_alpha_amyl Pfam Description: Protease inhibitor/seed storage/LTP family
  misc_feature (94)..(94): Xaa is any aa, unknown, or other
MARTQSAVAVAVVAAVLLLAAAATTSEAAITCGQVSSAIAPCLSYARGTGSGPSASCCSGVRNLKSAASTAADRRAACNCLKNAARGVSGLNAXNARSIPSKCGVSIPYTISTSTDCSRGELKPRPRATTAA

SEQ ID NO: 79684 - DNA, 729 bp, Zea mays
  misc_feature: Ceres CLONE 1564811
tggagctccccgcggtggcggccgctctagaactagtggatcccccgggctgcaggaattcgtctcaccccagaaaaatacagttttccaactcacattctactatatattaggatgtgttgggcacacatggcaagtaaggcaaaatgatgcatcgacatgtgatacgtgagcacgtatttcaaaacccgataggttggttggagtgggcttcttaaaattattactccgaagcgtgcaattgagattgtagtattataatacccacgtatttgtaaatttgttatcgtcgttgctttaaacacccatctatatatagctcactcactgctgctgttactggcatttctcccctcatcccgttcctgaaaacggatctgaggccgtcgtcttccactgggtcgcgctcctgttcgctccgtcgtcagacatgcaggcagcgccagcacgtcttgcttcacgctcctcgcggatggtggcccctccggcccgcgccgatgcagttgaaactccttccgagcacaagattaaatagagttgggaatggtcttttagacgcccatagacccatgcaagtctcagcccatgaatttgaggaagttgacccaaaccccacccatgtgccctaaaatatggtaaaaggaccttcccccaaaaattttgttttagggaacccccctttttgggggtgcgcggggttaaccttaaaaaattttccccaaaagggcc

SEQ ID NO: 79685 - DNA, 966 bp, Zea mays
  misc_feature: Ceres CLONE 1564813
  misc_feature: Encodes the peptide sequence at SEQ ID NO. 79686
ggcggccgctctagaactagtggatcccccgggctgcaggaattcgtctcacccctagaaaaaacgacaaaaaccaaccaccgtgcgccagccgccacgccagcgcctgccatggctcctctcctccccctccccctccccctccccctccccctccgacccatccccgccgagaactccatttcccggctcggaccgaggccaaggttccctcgtcccttctccaggcggcgcctacgccttcccgccctcctccaagtggaatgcctcgcggccaccggccccgaagagcccgcgccgaggtgggaagcggcactgtacgcggcggaggggctgtacccggcctacgtcgcaggcggggcctccggggcaataaagagggaccaaaggggtacgggggtacatggagctggggaacagggttcataaacgaaaagggacgggattcataggggtgagaccaggggggttcaaggcttcaggttgaggggagtagagacggccaggtatgcggggaaggggagaacatagccaattgtagttgcgggggggggggacgaccaagaaaaaggagagagaaggggcctggcgggtttggggggcgggtaggagagaaggagcgagaggggggggggggggagggggagggcagaggagggaatggaagagggggaggctaatatcaagaggaaaggggaaagtaggggtctaagggaaggagagtgtggggggcagggggggggggtgacactcttcagtggtggagtaaaagggggagaaagggagaaaaaaagacgaagagagggagagtggaagggaaagtgaagaagaagaaataggggagagagaagggagacagaaggaagccaaggagaggaaagaggagagaacggaggggaaggaggagaggtaagagaaacggaggggaggaggagaaagaggggaaaagaggaggagaaaaaaaaa

SEQ ID NO: 79686 - protein, 105 aa, Zea mays
  misc_feature: Ceres CLONE 1564813
MAPLLPLPLPLPLPLRPIPAENSISRLGPRPRFPRPFSRRRLRLPALLQVECLAATGPEEPAPRWEAALYAAEGLYPAYVAGGASGAIKRDQRGTGVHGAGEQGS

SEQ ID NO: 79687 - DNA, 824 bp, Zea mays
  misc_feature: Ceres CLONE 1564815
  misc_feature: Encodes the peptide sequence at SEQ ID NO. 79688
  misc_feature (549)..(549): n is a, c, t, g, unknown, or other
  misc_feature (615)..(615): n is a, c, t, g, unknown, or other
  misc_feature (627)..(627): n is a, c, t, g, unknown, or other
  misc_feature (662)..(662): n is a, c, t, g, unknown, or other
  misc_feature (665)..(665): n is a, c, t, g, unknown, or other
  misc_feature (693)..(693): n is a, c, t, g, unknown, or other
  misc_feature (698)..(698): n is a, c, t, g, unknown, or other
  misc_feature (716)..(716): n is a, c, t, g, unknown, or other
  misc_feature (720)..(720): n is a, c, t, g, unknown, or other
  misc_feature (781)..(781): n is a, c, t, g, unknown, or other
ctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcggctacngtggcggcggcggctaccgtggtggtggcggcggctaccgcggtgggcaccgtggcggcggctacngcaactccgacnggaactggaggaactgagcggtggggcccgcgcgnccnagttatccctgtcgctacccgtgtgttnacccntagtcagagggtttatcntcgntcgtctcatgtttgggtgtgccccatctgggtttttgaatgcaaggtcgctttgtgtcagntggtaagggctgggtcatccctgggttcaagaaaaccatggat

SEQ ID NO: 79688 - protein, 156 aa, Zea mays
  misc_feature: Ceres CLONE 1564815
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
  misc_feature (126)..(126): Xaa is any aa, unknown, or other
  misc_feature (148)..(148): Xaa is any aa, unknown, or other
  misc_feature (152)..(152): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYXGGGGYRGGGGGYRGGHRGGGYXNSDXNWRN

SEQ ID NO: 79689 - DNA, 855 bp, Zea mays
  misc_feature: Ceres CLONE 1564816
  misc_feature: Encodes the peptide sequence at SEQ ID NO. 79690
ggccgctctagaactagtggatcccccgggctgcaggaattcgtctcacccctagaaaaagggcgctcggggagcgccgcggcgccggcgtccgggtgatggcgttcgtcaccttcgcggggctcaggcccagggacgtggacctcgtggcccgcgccgtcctgcccaagcactacatggagcagctcagcgcgctggcgtacggcagcctctggctcccggccaggaggaaggtggcggtgaccagcgcgccgcgggtcatgtccgagtggttcctcaaggagtacatggccgccgacgcggtggtcgggctcgagctgcagcacgtcaacgtcggccgccgccggtacttcactgggttgctgctgtcgtccggtcaccccacgggaacggagctgaggcagaaggcgatcacggaggcgttgttaggcgccgaggacgaccccattgccgtcttgggcatcatcagcgactccagcccgctcgacgacgagctcttcctccccctactgcaaggaacttttacgtccagagcagagaggagcgcaaagaaacgaccaggctctccccggggaaaaaataacccaaaagccggctccatctttccaaaaacggggcggccttcgacctttcatccccaaccacccggccggccatggttcggccttccttccctccttcctttccccttcgggggtacgtccctccccgggcattccggctttaacaaacgggatatcgtcccccccttacaagaaaaaaacttcgggaaaagccccgaatctttgggggttcgagtttccagggcctttcggggctcccggaccccccccgggaaaaagaggaaagggggga

SEQ ID NO: 79690 - protein, 252 aa, Zea mays
  misc_feature: Ceres CLONE 1564816
  misc_feature: SWISSPROT Homolog: EC 2.3.1.15 Glycerol-3-phosphate O-acyltransferase
MAFVTFAGLRPRDVDLVARAVLPKHYMEQLSALAYGSLWLPARRKVAVTSAPRVMSEWFLKEYMAADAVVGLELQHVNVGRRRYFTGLLLSSGHPTGTELRQKAITEALLGAEDDPIAVLGIISDSSPLDDELFLPLLQGTFTSRAERSAKKRPGSPRGKNNPKAGSIFPKTGRPSTFHPQPPGRPWFGLPSLLPFPFGGTSLPGHSGFNKRDIVPPLQEKNFGKSPESLGVRVSRAFRGSRTPPGKKRKGG

SEQ ID NO: 79691 - DNA, 772 bp, Zea mays
  misc_feature: Ceres CLONE 1564817
  misc_feature: Encodes the peptide sequence at SEQ ID NO. 79692
  misc_feature (715)..(715): n is a, c, t, g, unknown, or other
  misc_feature (733)..(733): n is a, c, t, g, unknown, or other
agctccccgcggtggcggccgctctagaactagtggatcccccgggctgcaggaattcgtctcacccctagaaaaagcgtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgcccgggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggagaggccatcaagcactcgctggggcagtcccacccggtgcgcctggtgccctacaacccggactttatggacgagtcggtgctgtggacggagagccgcgacgtcggcaacggcttccgatgcgtccgcatggtcaacaacatctacctcaacttcaacgccctacactggcgacaagtggcacggcggctgtnatgaccgctacgacgtcntgcatctggcaagtggtgccgagggcgacgaccatcgac

SEQ ID NO: 79692 - protein, 180 aa, Zea mays
  misc_feature: Ceres CLONE 1564817
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFMDESVLWTESRDVGNGFRCVRMVNNIYLNFNALHWRQVARRL

SEQ ID NO: 79693 - DNA, 754 bp, Zea mays
  misc_feature: Ceres CLONE 1564821
  misc_feature: Encodes the peptide sequence at SEQ ID NO. 79694
  misc_feature (547)..(547): n is a, c, t, g, unknown, or other
ctccccgcggtggcggccgctctagaactagtggatcccccgggctgcaggaattcgtctcacccctagaaaaagttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgactactactngcgcggggatcgtgctcacctccaacggcgtcgaccacgcgcacggcggcgcgcccaccaaggggggattcctcgacgtcctggtcgcgagcgagcaactacgtggtccgcgtcccccaacgggctggcgctgggaccgaaccgggccgcttgctctggcccgggcttccccgtggttaagccccctggaaggggccacggccttaa

SEQ ID NO: 79694 - protein, 181 aa, Zea mays
  misc_feature: Ceres CLONE 1564821
  misc_feature (33)..(123): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (113)..(113): Xaa is any aa, unknown, or other
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDYYXRGDRAHLQRRRPRARRRAHQGGIPRRPGRERATTWSASPNGLALGPNRAACSGPGFPVVKPPGRGHGL

SEQ ID NO: 79695 - DNA, 825 bp, Zea mays
  misc_feature: Ceres CLONE 1564824
  misc_feature: Encodes the peptide sequence at SEQ ID NO. 79696
acccgcggtggcggccgctctagaactagtggatcccccgggctgcaggaattcgtctcacccctagaaaaaatctcctctctcccatctctgctagggttaggtcgtctcggcaagtcgccatgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaagacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcattggggattttggctgcacatgttacagattacttggttacagagacattcagggttcattatcccctcggtgaagggggcaaaaagtggtgactgataaattggcaatgccttacaaggggttaagggatttgtgaaaatttggcaatccttaagaaacaagcc

SEQ ID NO: 79696 - protein, 154 aa, Zea mays
  misc_feature: Ceres CLONE 1564824
  misc_feature (39)..(110): Pfam Name: RRM_1 Pfam Description: RNA recognition motif. (a.k.a. RRM, RBD, or RNP domain)
MWGQPPSQAHYGQAPPPQPYYAAPPVPAAPAAADEVRTLWIGDLQYWMDDNYVFGCFSNTGEVQNVKLIRDKNSRQLQGYGFVEFTSRAAAERVLQTYNGQMMPNVDLTFRLNWASAGEKRDDTPDYTIFIGDFGCTCYRLLGYRDIQGSLSPR

SEQ ID NO: 79697 - DNA, 835 bp, Zea mays
  misc_feature: Ceres CLONE 1564827
  misc_feature: Encodes the peptide sequence at SEQ ID NO. 79698
  misc_feature (722)..(722): n is a, c, t, g, unknown, or other
  misc_feature (738)..(738): n is a, c, t, g, unknown, or other
  misc_feature (786)..(786): n is a, c, t, g, unknown, or other
tggcggccgctctagaactagtggatcccccgggctgcaggaattcgtctcacccctagaaaaatacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaaggctatgaaagcagatggcctggaggttagcatcttagtgttgaattcgttgattaatgcttttggtgaagatagaagggttgttgaagccttctctgtgctgcagttcatgagggagaatggtttgaggcctgacgttataacatacacgacattgatgaaagctttaatacgtgttgagcagtttgataaggttcctgttatctatgaagaaatgatcacatcaggatgtgcccctgatagaaaagctagagcaatgctgcggtcaggtttgaaatacataaaacacatgagggttgcataggaaactaaacacaattactgatagcatctgatggaatcatataccttctcctgatcttatagaacatttcaacagaaggtgaagcaccacatgctgacagacacgatctgcttttgcacaagatgatagaatcatcaatatagtcacttcgtcttcctaatcacctanggggaggcgaatatantatacatcttgatcatttgcaatggaaggagattaatacatgacaccnaggagtcaggatcttggtataggaaacaatacatagtctgtccagacct

SEQ ID NO: 79698 - protein, 153 aa, Zea mays
  misc_feature: Ceres CLONE 1564827
  misc_feature (100)..(134): Pfam Name: PPR Pfam Description: PPR repeat
  misc_feature (65)..(99): Pfam Name: PPR Pfam Description: PPR repeat
  misc_feature: SWISSPROT Homolog: EC 5.3.1.1 Triose-phosphate isomerase
MGRKFFVGGNWKCNGTADQVEKIVKTLNEGNVPSSDVVEVVVSPPYVFLPVVKAMKADGLEVSILVLNSLINAFGEDRRVVEAFSVLQFMRENGLRPDVITYTTLMKALIRVEQFDKVPVIYEEMITSGCAPDRKARAMLRSGLKYIKHMRVA

SEQ ID NO: 79699 - DNA, 979 bp, Zea mays
  misc_feature: Ceres CLONE 1564831
  misc_feature: Encodes the peptide sequence at SEQ ID NO. 79700
  misc_feature (769)..(769): n is a, c, t, g, unknown, or other
  misc_feature (979)..(979): n is a, c, t, g, unknown, or other
acccgcggtggcggccgctctagaactagtggatcccccgggctgcaggaattcgtctcacccctagaaaaaggcgagccggcagtccgcccctgacaacccgtagcgtctctgatctctctcgtgattcccggtcccgatgagcactggcatggagctggagcacaagccggcgccgcctccggcggggtactgtgaagtcgtggcgggcgggcgcccctgcgacgcgtgcgccgcgcggccggggcggctgcactgacgtgcggaaggtgcgttcttgtgccccggttgcgacgcgtgggtgcactgtgtcgggttgtggcgcgggcgcgcgtgggtgtgctaggatctcgagcacgccctcgccgccgttgtttggtgggtggggccccccccccgctcttgtgccgttttgcaacgcagacattcactccgcctaattattttgcgccgccatccctcgaacgtcctcccattggcggccccttgcgtcgggcgacttttttatttaaccctgccgaggggcttgcaagatattaaagcctgcatccttgctgtgtatggtctcacggacggtaaaagaaaaactcgctcgggtcagatggtatcttaaaaaagagactggcgaggggtacgcgcactgactctcgagcggatggccgctcctccggggttaaagcctacgtccaccatcccctagaactggcccttctccctcgcaattcatgaagtagtgctcgcctcgtcgaggaccttaattcctgtacanaggtatacccgtgagtaattttaccccgtctggggttataggtaccctgggaattgtacggcacgggcgtgtagtatatcgaccccttatggtgtgaatgagctatattgcgcgttccaccccgagaggccagattaaaggacgtgtatctcgtgtttcccgcgacagattattttttatgtttccgcgcgtatttaattatagtacccn

SEQ ID NO: 79700 - protein, 39 aa, Zea mays
  misc_feature: Ceres CLONE 1564831
MSTGMELEHKPAPPPAGYCEVVAGGRPCDACAARPGRLH

SEQ ID NO: 79701 - DNA, 890 bp, Zea mays
  misc_feature: Ceres CLONE 1564835
  misc_feature: Encodes the peptide sequence at SEQ ID NO. 79702
ctggagctccccgcggtggcggccgctctagaactagtggatcccccgggctgcaggaattcgtctcacccctagaaaaaatctctttctccgggtagtgcaccagcggaacggcgaggtgcagtcgtgcagacgggaacggggatgggaagcacaggggcgctgctttggcacccgtcgccgcaggtgcactccggtggcgtcctcttccgccagagccggcgcatcgtacgccagcgcaacttgcctctattatcgctagctgacgcggcgcttgagcccgagcgccgccgcgggcagcgcctccgctgcgctgccggcgacggggacggcgggccccgggaggctcagaaggagtctccgagcggcatcggcgcagcactcgaggatccgtctccaggacctcctgtggaaaacggttccttcagaagcccctcacaggaagaacagagtgctctgtataattttctctatccaagcaaagacttacttccagatgataaggagatgagtatatttgatcatctggaggagcttcgcgagaggattttcatctcagttttggctgttggggctgcgatactaggctgttttgctttttcaaaagatctggttctttttctagaggcaccagtgactgttccagggggttcggttttttgcagctctcgccctggggaaatttttctttacaacattaaagggtttcagggatattgggggcctttttactttggaagtccttatcattttttattatgaaaattctttgcaattttgtttacccccaggttttagcctaaggggattaagcgggaaattttctccggggccctattaagcggagggggggttctttactggtttccaattccctaaccttaggtgaa

SEQ ID NO: 79702 - protein, 205 aa, Zea mays
  misc_feature: Ceres CLONE 1564835
MGSTGALLWHPSPQVHSGGVLFRQSRRIVRQRNLPLLSLADAALEPERRRGQRLRCAAGDGDGGPREAQKESPSGIGAALEDPSPGPPVENGSFRSPSQEEQSALYNFLYPSKDLLPDDKEMSIFDHLEELRERIFISVLAVGAAILGCFAFSKDLVLFLEAPVTVPGGSVFCSSRPGEIFLYNIKGFQGYWGPFYFGSPYHFLL

SEQ ID NO: 79703 - DNA, 850 bp, Zea mays
  misc_feature: Ceres CLONE 1564838
  misc_feature: Encodes the peptide sequence at SEQ ID NO. 79704
  misc_feature (760)..(760): n is a, c, t, g, unknown, or other
ctccccgcggtggcggccgctctagaactagtggatcccccgggctgcaggaattcgtctcacccctagaaaaaacctttttttccctctcgtctctgttgcccggttgcccctcgctgtgacgactgacgagcaaccaatccacccaaatcccagaccgagctccaatcctcagcgccgccagtcgcgccgcctccgatggccgcgcggcgcgggccccacgtcatcaagctccacgatcccaacccgcccctcctcggccgggcgccggggaccgcaccggccgccatccccgcgccgtcgcgcgatgagggcatcctcgcgcagcaccctcgcgccgccccctcgagcgcatccgcctcgcacccggccttcgcccttatcgaggagcgcctcgtagcccgggaccaggacatccaggagctcctcgtcgacaaccagcggttcgccgccacgcacgtcgcgcttcagcagcagcttatcgcggcgcagcacgagctccgggcggtctccgtcgctgccaccagggcgcgcgccgagcgggaggtcgaggtgcgagcgctggccgaccaggcggcccacatagaggccgaggcgcgggccgtcgccgctgcgcgcgcggaggtcgaccaggttcacgccgacgtccaggtgctcgtcgcggcgcgcactgaccttgtcaaccggctccagggcctacgggagaagctcgcgcacaagaaagctgaggcgagtaagaccgattccgtccgtgcccagnatgaaaccaatgcgcggggaggatcacgagggcagagctgcggttgatttttgaaaagaagcacactctgaataaccttgaacaaagtaa

SEQ ID NO: 79704 - protein, 202 aa, Zea mays
  misc_feature: Ceres CLONE 1564838
  misc_feature (188)..(188): Xaa is any aa, unknown, or other
MAARRGPHVIKLHDPNPPLLGRAPGTAPAAIPAPSRDEGILAQHPRAAPSSASASHPAFALIEERLVARDQDIQELLVDNQRFAATHVALQQQLIAAQHELRAVSVAATRARAEREVEVRALADQAAHIEAEARAVAAARAEVDQVHADVQVLVAARTDLVNRLQGLREKLAHKKAEASKTDSVRAQXETNARGGSRGQSCG

SEQ ID NO: 79705 - DNA, 779 bp, Zea mays
  misc_feature: Ceres CLONE 1564843
  misc_feature: Encodes the peptide sequence at SEQ ID NO. 79706
  misc_feature (518)..(518): n is a, c, t, g, unknown, or other
  misc_feature (779)..(779): n is a, c, t, g, unknown, or other
ccgcggtggcggccgctctagaactagtggatcccccgggctgcaggaattcgtctcacccctagaaaaaagagtcccagctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatggttggagggttgagctgtcaactaaagttggtggtggccgtggccgagaccgtaacggttctgatatgaagtgctatgagtgtggtgaagctggccactttgcacgtgaatgccgcttacggattggttcangaggcttgggtagtggaaagcgtcgcagccgaagtcctagatatcgcagccgcagccgcagccgcagccgcagcctaagatatcgaaggagcccaagctatagcagaagcccgcgagatcgttctcctaggaggcgaagttacagcaggtcggccacggggatctcctggcacggagtctcagcaagttcaccgcccgctggcgccccccttcctccccagaaattaacaagcaggtcaccacccttggaagccggagaan

SEQ ID NO: 79706 - protein, 193 aa, Zea mays
  misc_feature: Ceres CLONE 1564843
  misc_feature (4)..(70): Pfam Name: RRM_1 Pfam Description: RNA recognition motif. (a.k.a. RRM, RBD, or RNP domain)
  misc_feature (85)..(102): Pfam Name: zf-CCHC Pfam Description: Zinc knuckle
  misc_feature (107)..(107): Xaa is any aa, unknown, or other
MARVYVGNLDPRVTAREIEDEFRMFGVLRSVWVARKPPGFAFIDFDDRRDAQDAIRELDGKNGWRVELSTKVGGGRGRDRNGSDMKCYECGEAGHFARECRLRIGSXGLGSGKRRSRSPRYRSRSRSRSRSLRYRRSPSYSRSPRDRSPRRRSYSRSATGISWHGVSASSPPAGAPLPPQKLTSRSPPLEAGE

SEQ ID NO: 79707 - DNA, 762 bp, Zea mays
  misc_feature: Ceres CLONE 1564844
  misc_feature: Encodes the peptide sequence at SEQ ID NO. 79708
  misc_feature (635)..(635): n is a, c, t, g, unknown, or other
ctccccgcggtggcggccgctctagaactagtggatcccccgggctgcaggaattcgtctcacccctagaaaaagtaggaggagaaccgagagcagagagacatggcgccccaccagcagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggggagctgtcgacggtgtgcccgtgggcggaccaggtgcgctggcactaccactgggccagcccgctccactacgccaacaccccccaagtctgcaacttcaagtattctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgacgtccaccagccgctgcacgtaggcttcgaagatgacgagggcggtaacaacatcaccgtccactggtacccggaggaaagcaaccntccatcacggtgtgggatgtcagcatttattgatacgggcattcaaggacttcttcaaacagagcatggatccattggtgaaggctcccagaagaaccttaccgaatggatgggctgacgacatctc

SEQ ID NO: 79708 - protein, 216 aa, Zea mays
  misc_feature: Ceres CLONE 1564844
  misc_feature (30)..(216): Pfam Name: S1-P1_nuclease Pfam Description: S1/P1 Nuclease
  misc_feature: SWISSPROT Homolog: EC 3.1.30.1 Aspergillus nuclease S(1)
  misc_feature (178)..(178): Xaa is any aa, unknown, or other
MAPHQQQRALLLFPLVFLLLLLAPPLAGAWGKEGHIMVCKIAEKYLSEKAAAAVQALLPESAGGELSTVCPWADQVRWHYHWASPLHYANTPQVCNFKYSRDCHNSRGQQGMCVVGAINNYTDQLYSYGQKTSYNLTESLMFLAHFVGDVHQPLHVGFEDDEGGNNITVHWYPEESNXPSRCGMSAFIDTGIQGLLQTEHGSIGEGSQKNLTEWMG

SEQ ID NO: 79709 - DNA, 844 bp, Zea mays
  misc_feature: Ceres CLONE 1564845
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (311)..(311): n is a, c, t, g, unknown, or other
  misc_feature (322)..(322): n is a, c, t, g, unknown, or other
  misc_feature (323)..(323): n is a, c, t, g, unknown, or other
  misc_feature (336)..(336): n is a, c, t, g, unknown, or other
  misc_feature (337)..(337): n is a, c, t, g, unknown, or other
  misc_feature (367)..(367): n is a, c, t, g, unknown, or other
nnnnnnnnnnnnnnggggnngggggnnnnnnnnaaanccaannnnnnannnnnnnnnnnnnnnnnnnccnnnnnnaaaaactggagctcccgcggtggcggccgctctagaactagtggatcccccgggctgcaggaattcgtctcacccctagaaaaaaccgcagccgcagcacaatcgcctcgccttcccttccccaccagcccccgtctctctctctctctttctctctctcgtagccgcgtccacctcgcagcagcaagcaagcgcgaccaaatggcgcctctaggaagaacggcggaagctgctgnctcgcggcggnncgtccaacaaccnntggtggggtgtcgttttcggcgagatgctngatcgacttcgtcccccgacgtggcccgggctgtcgctggccgagtcgggcgggcttcgttcaggccccccggcggcgcgcccgccaaacgtcgccctgcgccaatcgccaaagcttcggcgggtttctttccgcccttcgttggggaaaagtttggggaaaccaaccaaatttttggggggccacatgggctggggtgaaaaaaatcccctctaaaaccacgaaaaaaaacccgggggaaacctcccgaaaggggggtgggcctcctgtttttcaaaaaaaaacaacacccccccgggaaaaaggggccctttgggggcctctcttggggggaaacccctctaaaaaaacacaaaacagggggggaaaacccccccaaaaggcctccagggtgttcccccaacggggaagaaaccccccaaagagggcggggaaaaaaaaatttttctttttttaaaaaggaaaaaggggggggga

SEQ ID NO: 79710 - DNA, 856 bp, Zea mays
  misc_feature: Ceres CLONE 1564847
  misc_feature: Encodes the peptide sequence at SEQ ID NO. 79711
ggcggccgctctagaactagtggatcccccgggctgcaggaattcgtctcacccctagaaaaagcattgtggctccttacttccgcgccgccacccctacaggtaaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtgtcatatgtgaagactcctcgtggcctccgcacactcaactctgtttgggcccaacatcttagcgaagaagtgaggagagggtctacaagaactggtgcaagagccagaagaaggcttttccaagtatgctctcaaatataaaatgaagctggcaagaaggaatttcaccttgccgctgggaagaatgagaaaaatgcttcgggtaacccgggcccttgccctaaccccatttaggaaaataaagggtttaaaccaaaaaaggctcccccgagggaattccgggacaaggggggcccttgtcgaaaaagggggaaattgggtcaaatttttttaaaaaaaagcccccggttaggcccgccttcccgaaggggaggggggttgccccccctgggggcccccgggggaaaggttttggggggggggccccccccgggggggtgcccacgttttctccaaaaaaa

SEQ ID NO: 79711 - protein, 136 aa, Zea mays
  misc_feature: Ceres CLONE 1564847
  misc_feature (50)..(133): Pfam Name: Ribosomal_L3 Pfam Description: Ribosomal protein L3
MSHRKFEHPRHGSLGFLPRKRSSRHRGKVKSFPRDDPKKPCHLTAFLGYKAGMTHIVREVEKPGSKLHKKETCEAVTIIETPPLVIVGLVSYVKTPRGLRTLNSVWAQHLSEEVRRGSTRTGARARRRLFQVCSQI

SEQ ID NO: 79712 - DNA, 1068 bp, Zea mays
  misc_feature: Ceres CLONE 1564848
  misc_feature: Encodes the peptide sequence at SEQ ID NO. 79713
  misc_feature (64)..(64): n is a, c, t, g, unknown, or other
  misc_feature (74)..(74): n is a, c, t, g, unknown, or other
gaattataaaatatttattttcgttaatatcaaaaaaaattaaataaaacaataacaagagatngcggtaatanaaaaaatctggagctcccctcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccagagactttcgccaagaaccgcgagctggaggtgatccactgccgctgggccatgctgggcgccgctcgggtgcgtgtttcccggaacttgctcgcccgcaacgagcgtcaaagttcggcgaaggccattgtgggttcaaaagcccggggtcccaaaatctttcaagcgaaggggcggggctttggactaccctccgggcaaaccccgaaggccctggattccaacgacgaacagaagacattccctggaccccaatcttagggagcgggtgcccaaggttgggatggcctccatggggagcgccccggtccgaatgggggttaaccctccattctgccccggatgggccccgccttccgggggaaatgggagggtccaaacccccctctgtttatcccccagagggggggagccttttcaaaccccgctatggggggcttctgccgaaaacaaccccggaagagcggttttcccgagaaacttcaaaagggctaaggggagggaactaataaacgggcccgcccttctaccaaggttttcctaccaagagtttgggcggttcttttacggaaaa

SEQ ID NO: 79713 - protein, 168 aa, Zea mays
  misc_feature: Ceres CLONE 1564848
  misc_feature (58)..(160): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGAARVRVSRNLLARNERQSSAKAIVGSKARGPKIFQAKGRGFGLPSGQTPKALDSNDEQKTFPGPQS

SEQ ID NO: 79714 - DNA, 779 bp, Zea mays
  misc_feature: Ceres CLONE 1564850
  misc_feature: Encodes the peptide sequence at SEQ ID NO. 79715
  misc_feature (460)..(460): n is a, c, t, g, unknown, or other
  misc_feature (462)..(462): n is a, c, t, g, unknown, or other
acccgcggtggcggccgctctagaactagtggatcccccgggctgcaggaattcgtctcacccctagaaaaattcccacacccctcaccgcgtccgcctcccctaccatctagggtttctacgggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggaacngncggctacggaggaggaggcgaccgtggctacggcggcggcgaccgtggttacggtggaggtggcgaccgcggctacggcggcgaccgtggctacggcggaggcggcggctatggcggtgggtacggtggaggccgcggtggaggcggccgcggctgcttcaagtgcggcgaggagggccacatggcaagggactgctcccaggcggccggctccgaacgggggagcggctgcggccccgccagcgagcgctacgacatccgacagtcaggccaaatttgccgcgactgccccgacaaaagcgttaggggcggtggca

SEQ ID NO: 79715 - protein, 212 aa, Zea mays
  misc_feature: Ceres CLONE 1564850
  misc_feature (5)..(72): Pfam Name: CSD Pfam Description: 'Cold-shock' DNA-binding domain
  misc_feature (157)..(174): Pfam Name: zf-CCHC Pfam Description: Zinc knuckle
  misc_feature (107)..(107): Xaa is any aa, unknown, or other
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGTXGYGGGGDRGYGGGDRGYGGGGDRGYGGDRGYGGGGGYGGGYGGGRGGGGRGCFKCGEEGHMARDCSQAAGSERGSGCGPASERYDIRQSGQICRDCPDKSVRGGG

SEQ ID NO: 79716 - DNA, 839 bp, Zea mays
  misc_feature: Ceres CLONE 1564851
  misc_feature: Encodes the peptide sequence at SEQ ID NO. 79717
ccgcggtggcggccgctctagaactagtggatcccccgggctgcaggaattcgtctcacccctagaaaaaaccagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatggctggtccctgaaaccctccctgaggaagtgcttggaaagatgggcgcaccccctaagcctgacgtgccagtcatcacgccgcaagaactcgcagaggccgacggaatcctcttcgggttcccaacgaggttcggaatgatggcagcgcagatgaaggcgttcttcgatgccactggtgggctctggagggagcagagccttgccggcaagcctgccggcgtcttcttctgcactggatcccagggtggtggccaggagacgacagcgttgacagcgatcacccagttgacgcaccaccggcatggtgtttcgtggcctgtgggctacaccctcgggcgccaagctgttcggcattgaacaaggttcagggcggcagcccctacgggggccggcacgttcgcccgccaaacggctccaggtggcccaaccgaaggtggagcttgaaacacgccttccccccaggggaaagtacttccccaggcattcccaagaaacctcaaaggtttcgccctgatcttaccattttacccttt

SEQ ID NO: 79717 - protein, 156 aa, Zea mays
  misc_feature: Ceres CLONE 1564851
  misc_feature (7)..(138): Pfam Name: Flavodoxin_1 Pfam Description: Flavodoxin
MAVKVYVVYYSMYGHVGKLAEEIQKGASSVEGVEAKTWLVPETLPEEVLGKMGAPPKPDVPVITPQELAEADGILFGFPTRFGMMAAQMKAFFDATGGLWREQSLAGKPAGVFFCTGSQGGGQETTALTAITQLTHHRHGVSWPVGYTLGRQAVRH

SEQ ID NO: 79718 - DNA, 852 bp, Zea mays
  misc_feature: Ceres CLONE 1564852
  misc_feature: Encodes the peptide sequence at SEQ ID NO. 79719
acccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaaggacaggctgctgcacatctcaagggtggtgccaagaaagttgttatctctgcccccagcaagatgcacccatgtttgttgttggtgtcaatgaggacagtacacctcggatgttaccttgttttccatgctagctgccccacaactgccttgctcccccttgctaagtcattcatgacaacttcggcatttgtgaagggtttgaaaacaactggttcagccatcactgccccaccaaaaactggttgacggaccccccaccaaagaactggaaaaaggggccagggctccccactttaaaatcatttccttacaaaaaccggggctggcaaaggttgttgggaaaaattctccccgggtctgaaggggaagccctcctggt

SEQ ID NO: 79719 - protein, 189 aa, Zea mays
  misc_feature: Ceres CLONE 1564852
  misc_feature (4)..(153): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKGQAAAHLKGGAKKVVISAPSKMHPCLLLVSMRTVHLGCYLVFHASCPTTALLPLAKSFMTTSAFVKGLKTTGSAITAPPKTG

SEQ ID NO: 79720 - DNA, 1166 bp, Zea mays
  misc_feature: Ceres CLONE 1564853
  misc_feature (795)..(795): n is a, c, t, g, unknown, or other
  misc_feature (1107)..(1107): n is a, c, t, g, unknown, or other
  misc_feature (1166)..(1166): n is a, c, t, g, unknown, or other
agaagttgggttttatatgaccccacaacaccaaaatattcgcaccgccccaagaacgcattttttttaaaaaaaaaaaaactggagctccccgcggtggcggccgctctagaactagtggatcccccgggctgcaggaattcgtctcacccctagaaaaaagaaccgaacctccgtcactctcaggcgagcgagaaagcgcggctcagctccacatggccagcgacagtaggctgtaagcccacgccgctccagatacatacgcagccgtgcgcgaacccgccatggcggataaaaacgtgcgcttcacgcgctgcctacagggaatagaggcggaaccaacgccaatgcattgcgacgagtagccagataccgcatccaaggaagcactcaacccttgggcggccgccgccgggtgcgactgtgggccaaccccaccccccccatacaaggcggctgggaacggctaccggcggggccaattttttaaccccccccccccaaggaccaaacaacggggggttcaaggggaccccccgggcgggatttgttcaacggtggggggggaaaagagatccaaaaaagtggtttggacctcgccccccggggggggcccccaaaggcgggaaggcccccagagacggccccacgtctcggaggccggccaagagaatacccccgttggggggtgtatacacaaccattaggggtaaataaaaacactaaaggttcccggtggcatcacgcagatggggaaattatgctctctgtttccacaaaaggaaacggcacgcnttgcgggacacatgaggaggtggattatttacgacccaccgagggcggaggatagaacacagaagcacactccgttggggctcatcttttcccctccctctccggttatctatttgcggggtcgctaccgggaacggtaggcttggggttgagcacccgggtgactagttatgtaagaaagagggtagcacatatttgacagttgaagagggtagcgaacattggtgaattcattatagtcggatgacgccgcacaaggagggggtagtaatgccagctctcagtgccagcagacaagatcacaatacctgnctcattaggagcgtgacgaaccaccctctgtatcaaagataccctccctcttggtgttn

SEQ ID NO: 79721 - DNA, 807 bp, Zea mays
  misc_feature: Ceres CLONE 1564856
  misc_feature: Encodes the peptide sequence at SEQ ID NO. 79722
ctccccgcggtggcggccgctctagaactagtggatcccccgggctgcaggaattcgtctcacccctagaaaaaaaaaacactcgtctgagccaccaaacacttgctatgcccgctcctccccgcgcactgctcagcacgccgtgcccgtgagaccatggacgcgagcgcggccaccgccaggcgcaagcgcaagcgccccgacgccgacatcaccgccgccgccgccgccgccgccccggtcgccgtcgacgaggcctcggacgccgaggtcgaggagttctacgccatcctgcggcgcatccgcgacgcctcccgccggctgtgcggcgccggcgcccggcccgccccgcgcgcgccggcgtggcggcccagcttctcctgggaggacttcgcgacgccggcccctggcgcgccggcgcctgagaccccgacccccgcgcagcaggagccagcgcagccgcggcccgacgagcctgtagccgtcgtccgcgctaccgccccgtcgccgcgtgccgggctggacctgaacgcggagccggagccggaagcgcccggcacccctcgctcggcgcgcgtccaggcgtagcgtagcgcgcggcgcatcgtcggctgccctctgcaccgcgccaaagtggggccgcgcgtcagctcggctgctgggaggcgggcggcacagcacacacagtgcgtactttcccctccggtgaataccgatacgaatccccatcatgtgatcggaattttttaggggctctctttggtgccctgctccctgtgaacaggtgaaactggttccgtttgcttt

SEQ ID NO: 79722 - protein, 143 aa, Zea mays
  misc_feature: Ceres CLONE 1564856
MDASAATARRKRKRPDADITAAAAAAAPVAVDEASDAEVEEFYAILRRIRDASRRLCGAGARPAPRAPAWRPSFSWEDFATPAPGAPAPETPTPAQQEPAQPRPDEPVAVVRATAPSPRAGLDLNAEPEPEAPGTPRSARVQA

SEQ ID NO: 79723 - DNA, 761 bp, Zea mays
  misc_feature: Ceres CLONE 1564858
  misc_feature: Encodes the peptide sequence at SEQ ID NO. 79724
  misc_feature (469)..(469): n is a, c, t, g, unknown, or other
  misc_feature (573)..(573): n is a, c, t, g, unknown, or other
  misc_feature (574)..(574): n is a, c, t, g, unknown, or other
  misc_feature (737)..(737): n is a, c, t, g, unknown, or other
tccccgcggtggcggccgctctagaactagtggatcccccgggctgcaggaattcgtctcacccctagaaaaagaaaactccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagaacatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtggngtacggtggtggccgtggaggcggcggctacggcggtggcgggcgccgtgatggcggtggcggctactgcggtggcggcggctactgtggcggcggcggctacnngtggtggtggcggcgggctactgcggtggcaaccgtggcggcggctacggcaactccgacgggaactggaggaactgagcggtggggcccgcgcggccaagttatcctgttcgcctaccgtgatgtttaccctagtccagagggtttatctcgtttcgtgtcnttgtttgttgttgccatctgtgtt

SEQ ID NO: 79724 - protein, 112 aa, Zea mays
  misc_feature: Ceres CLONE 1564858
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKNILDRETQRSRGFGFVTFSTEEAMRNAIEGMNGKELDGRNITVNEAQSRGGRGGGGGGVRWWPWRRRLRRWRAP

SEQ ID NO: 79725 - DNA, 888 bp, Zea mays
  misc_feature: Ceres CLONE 1564859
ccccgcggtggcggccgctctagaactagtggatcccccgggctgcaggaattcgtctcacccctagaaaaagactccttgtattcgacgcatgacgacaaagtgtcttcctttccgcggtctatccgccgcctcccatatcctgcggtcatggcaaggagaccggggctgcaccgtctttataggtaatttgcatgacaaggttcgtgagagggttctgtatgaaattcttatacggatctctgggcaagacaaatctctcattaaatggcaatatatctgctaactactaggttaaactctgtaggagagttgaagcctcatcaatctatgaggtctagtgatactcttttgccacaacatgcaacactgaatggcaggaatgccgggtatggtatcccaccaagtgtatcataccacacgcatagtcaaacactgtcgagtagagtactgaatagatgactaagcaactgtacataggaatatagtacgcgtgtatttagaactgtcctggactgatgttagcagacaagctactggaaacaaggccctacccttcctactggcatgttgaaccccgggaaatgggacttaattttgacaaaaaaaattttcagatggtaaaagttttgttggcccctttaaaaaatcagaactcccaatttcttcccttaaaaatgggtttggggggagggaaaaatgtgggttttatccggaacggcctccaatttttatttaaaatttcccaaaactttttgggcttatcaaaaccctttggggggaggcccccccccccccaaagggggggttccttaaggaaatcaccttcccaaaaaaaaaaaggggggggaaattccccaaaaaaaaatttttctcctggaggggggg

SEQ ID NO: 79726 - DNA, 961 bp, Zea mays
  misc_feature: Ceres CLONE 1564860
  misc_feature: Encodes the peptide sequence at SEQ ID NO. 79727
gcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagcttggaggtgatccactccccgctgggccattgctcggcgcgctcgggctgccgtcttccccgaagctgctctcccgcaacgggcgtcaaagttcggccgaggcccttctgggttcaaggcccgggctccccagatcttcaagcgaagggcggggcttgggacttaccttccggcaaccgccaaggcctggatcccaacgcggcaaaagcaatcccttcgcccattcttaggcccctggcccaagggtcgtagcttcaatagggggagcccagcccaaggggcttaaccggaattttgcccgggacgggcccatactcaaggtcaaaaggtcctttcaataaccagccttgttaccccctgtgccgggcagagctttcagaacacccctctcaggccctgtgtccgaaacaaaacccccggaagggccctttccccccaaaactctccaggggtgaaaaagagacttcacaaaaaccggcgccgcccctcccgccaagtttatttccctatgttttaggggcgttctttctcgtatccagaggcaaaagaaaaaccacaaaa

SEQ ID NO: 79727 - protein, 169 aa, Zea mays
  misc_feature: Ceres CLONE 1564860
MAASTMAISSTAMAGTPIKVGSFGEGRITMRKTVGKPKVAASGSPWYGPDRVKYLGPFSGEPPSYLTGEFPGDYGWDTAGLSADPETFAKNRELGGDPLPAGPLLGALGLPSSPKLLSRNGRQSSAEALLGSRPGLPRSSSEGRGLGLTFRQPPRPGSQRGKSNPFAHS

SEQ ID NO: 79728 - DNA, 869 bp, Zea mays
  misc_feature: Ceres CLONE 1564862
  misc_feature (669)..(669): n is a, c, t, g, unknown, or other
  misc_feature (745)..(745): n is a, c, t, g, unknown, or other
  misc_feature (764)..(764): n is a, c, t, g, unknown, or other
  misc_feature (768)..(768): n is a, c, t, g, unknown, or other
  misc_feature (772)..(772): n is a, c, t, g, unknown, or other
  misc_feature (773)..(773): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (793)..(793): n is a, c, t, g, unknown, or other
  misc_feature (800)..(800): n is a, c, t, g, unknown, or other
  misc_feature (801)..(801): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (842)..(842): n is a, c, t, g, unknown, or other
  misc_feature (843)..(843): n is a, c, t, g, unknown, or other
  misc_feature (857)..(857): n is a, c, t, g, unknown, or other
  misc_feature (861)..(861): n is a, c, t, g, unknown, or other
aaagctggagctccccgcggtggcggccgctctagaactagtggatcccccgggctgcaggaattcgtctcacccctagaaaaaaaaggaaactctcaggcttgatctggtagagcaatcgtcattgaagtacaaggatgcagactttatcattttcaatacggggcattggtggacacatgagaaaactgctcttgggaaggactactatcaagaaggtaaccatgtgtataatgagctgaatgtcatggatgcctttcataaagctcttctcacctggtccaagtggatcgatgccaatgttaaccccagaaaaactctggtgttattcagaggctactcagcatctcatttcagtggcggacaatggaattcaggcggtggctgtgacaaggagagtaaaccaataaccaacgatcagtacctttcaacctacccaccaaagatgagcatcctggaggacgtgatccacaagatgaaaactccggtcgtttacttgaacataacgagaatggctgactacagaaaggatgcacacccttccatctaccgcaagcagaacctgactgacgagggagaggaagatcgccccgaaaagaaattttcaaaaaaaatgggtggagccccccccccgggggtgggtggcggggcgctcccttcccccccccngggggggggggggggggggagatcccccccccccccccaaccaaaaaataattatcctccctccccccttgggggnggggaaaaaaaaaaaaaanaaanaaanngtnnnnnnnnnggnnnnggnggggggnnggggggtggtgtttcnnntgtgttnnnnntttatttttttnnccatgtcgtttttntcgncgccccct

SEQ ID NO: 79729 - DNA, 859 bp, Zea mays
  misc_feature: Ceres CLONE 1564864
  misc_feature: Encodes the peptide sequence at SEQ ID NO. 79730
ctccccgcggtggcggccgctctagaactagtggatcccccgggctgcaggaattcgtctcacccctagaaaaagttcttccagcgaagcaggcggcctagaaaaaccggatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccatcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacatcctcgccttcatcgaccgcgaggtggacgacacggtgcacgaggtggacaagcacctcccgggcgcgctgaacgcggcatcggcgcatgtctacgctgtggttcggggcgtgccggaagtggcgcgcgagctggcggccgatgcacagcgtctggcgtgaggggcgcaacccgtgcggcgctcgcgatgactgatcccgtggctcgggacatgtacaggctcgtgtagcccgtagccaaggacttctacgtactgtacgagcccacggcggagcaactggccgactacgccatggcactcgctgaacagtctgacagtgttcccgcacgatctcggagatcgtcgtgcccaacactacgaactggggcgaa

SEQ ID NO: 79730 - protein, 143 aa, Zea mays
  misc_feature: Ceres CLONE 1564864
  misc_feature (19)..(143): Pfam Name: REF Pfam Description: Rubber elongation factor protein (REF)
MAEEQSNPQHHQAEEREVMVEQQQPRRAPKLRYLDFVQVAAAQAAVCLAGLYGLAKDHAGPLRPSVDAVESAVKGVVSPVYDRFGGLPLDILAFIDREVDDTVHEVDKHLPGALNAASAHVYAVVRGVPEVARELAADAQRLA

SEQ ID NO: 79731 - DNA, 967 bp, Zea mays
  misc_feature: Ceres CLONE 1564865
  misc_feature: Encodes the peptide sequence at SEQ ID NO. 79732
tgtggcgggcgggtggggttttttcttttgtttttttccgccgctataggggactctttttgtggtgtaaaaaaaaagtgggagctcaccgcggtggcggccgctctagaatagtggatcccccgggctgcaggaattcgtctcacccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctggggaaaaagagcgagctgctcctccgcgccaacccggtgcacaagaagatccccgtgctgctgcacgacggccgcccctgtctgcgagtccctcgtcatcgttgcagtaccctcaacgaaggcgtttccccgggcgagcggggcgcccggcgccttgctccccccgccgaaaccccctaacgcgccggcggcgccagggccccgccctttcttgggggcgggaaactaacggttccaaaccaaagaaaagccttggtaaacaaacatgggcccgggcaaacccccgcgggccttgtgggggaaaaaaccctctccaaggggggggggaaaccggggccccaaggggccccccaagggccccccccccccccccaaaaaaatagggtccgaaaaaaaaacccccccccccccccccccctcgtggaaaggggggcccccccctccatgggcaaaaaaagggggccccccttttctttttggggggggggcggaaaaaaccccccccccggggtttttttctttttaaaaaaaactccccccctcttctggtgcccccccttataccgaggaggggggg

SEQ ID NO: 79732 - protein, 100 aa, Zea mays
  misc_feature: Ceres CLONE 1564865
  misc_feature (7)..(66): Pfam Name: GST_N Pfam Description: Glutathione S-transferase, N-terminal domain
  misc_feature: SWISSPROT Homolog: EC 4.4.1.5 Lactoylglutathione lyase
MAEEKKQGLQLLDFWVSPFGQRCRIALDEKGLAYEYLEQDLGKKSELLLRANPVHKKIPVLLHDGRPCLRVPRHRCSTLNEGVSPGERGARRLAPPAETP

SEQ ID NO: 79733 - DNA, 934 bp, Zea mays
  misc_feature: Ceres CLONE 1564866
  misc_feature: Encodes the peptide sequence at SEQ ID NO. 79734
  misc_feature (934)..(934): n is a, c, t, g, unknown, or other
ccccgcggtggcggccgctctagaactagtggatcccccgggctgcaggaattcgtctcacccctagaaaaaaagctttaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcgtcaagtaccgttgaagaggccactgtgctgctgtggagaacttcctacgtcaaagaaatgggtgcttcattagaaggcctgacccccccgcgtgaactttttgttccgaagatgatactcatgtgttaagctctatttgtttaaggtggtaatggtaagcttctccactaaccggattgtccctgactattttctgatgcccctggccgttcctagggaccggagctgcccccagaaggttggtggataatactccgtgggggaactgggcgttttataaatataaacccaaccggggttgggaaaacctccctgggttttttccagaacccaaagggcgtcagtctcgaggacaattaacccttttgctaaaggaacgggctttggtttcccggatataaaaccggcgtgggtatatggcataggtataacaactgggggagggttccacattagacccccaaggaccaacctttgtgggaaggggatattgtataggataatatgtttcggagaagtggtcctccctcaggagagggctcaggtatggaaaacaacctttaaggccgcgcaccttcacaaatttgggggggggcttattatcctatttataccacacgggggggtn

SEQ ID NO: 79734 - protein, 56 aa, Zea mays
  misc_feature: Ceres CLONE 1564866
  misc_feature (3)..(56): Pfam Name: Ribosomal_S14 Pfam Description: Ribosomal protein S14p/S29e
MGHSNVWNSHPKNYGPGSRVCRVCANPHGLIRKYGLMCCRQCFRSNAKDIGFVKYR

SEQ ID NO: 79735 - DNA, 903 bp, Zea mays
  misc_feature: Ceres CLONE 1564870
  misc_feature: Encodes the peptide sequence at SEQ ID NO. 79736
ctccccgcggtggcggccgctctagaactagtggatcccccgggctgcaggaattcgtctcacccctagaaaaattgcaagagtttgagacagcagaggacactcctcctcagaactctcccttccctcttgtaggggccaaaagggtcagagatctaggaagaagagaactagtccccaagcctaacaagaaagcaagctcttctgcaactgttggcattcgccttaatttgtatccatatcccaatggcaggcctatctctgcaacacccctgggcattcactttcggcctcctaggcaacgtcatctccttcatgaccttcctggccccgataccgacgttctaccgcatctacaacaacaagtcgacggagggcttccagtcggttccctacgtggtggccctgttcagcgccatgctgtggatcttctacgcgctgatcaagtcccacgagacgttcctcatcaccatcaaacccgcccggttgcgtgaatctaaaaccgccaccgtggggcaggtactttctcctacgcgaaccaaaaagggcagggatgttcacccgccaaaaaatatggtccctcctcaaacgtcgggggcctttcgggggccaatccttcctccttaaccctttttcctttttttaaggggggaacaagcgccgtcctcactgttttgggggggagattggggtggggttttttcccgtaaagggttttttttttgcggcccccctaacataacctagagaggggggggggtatccccaaaccaaaaaaggggggaaaaaaaagggccctttttccccctctccccttttggggaaaaccccaaaaagagccccgttaatgtggggttctctcttttagggggctccttttttagaaggaaaaaaaatatttcc

SEQ ID NO: 79736 - protein, 126 aa, Zea mays
  misc_feature: Ceres CLONE 1564870
  misc_feature (12)..(86): Pfam Name: MtN3_slv Pfam Description: MtN3/saliva family
MAGLSLQHPWAFTFGLLGNVISFMTFLAPIPTFYRIYNNKSTEGFQSVPYVVALFSAMLWIFYALIKSHETFLITIKPARLRESKTATVGQVLSPTRTKKGRDVHPPKNMVPPQTSGAFRGPILPP

SEQ ID NO: 79737 - DNA, 859 bp, Zea mays
  misc_feature: Ceres CLONE 1564872
  misc_feature: Encodes the peptide sequence at SEQ ID NO. 79738
  misc_feature (859)..(859): n is a, c, t, g, unknown, or other
ccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccaccaacttccgcaagcagctcaccgtgcagctgaagaagctcgctgccgccggcaagctgacgagggtgaagaactccttcaagctgccggccaccgacgccaagcccaaggccgccaagcccaaggcacccaaggccgcgcccaagccccagccctcgccgaaagcgaaggccaagaccgctgcgaaagcccaggcggcgtcgccccagccccaagccaaggccaagggccaagccaagccctgttgcttctggccgccgcgtttgcccaaagcccccggggggcccccttcccaaggtccccccaagaacctcccgcccagggccctcccctccccccaaggggcgccccaagaaaggggggggtttggtttctgtgtcccaaaaaagggggaaaaaagggccctcccccccccccn

SEQ ID NO: 79738 - protein, 232 aa, Zea mays
  misc_feature: Ceres CLONE 1564872
  misc_feature (54)..(124): Pfam Name: Linker_histone Pfam Description: linker histone H1 and H5 family
MSTEEAVVAEVPVTEVPAEVPAAQVAEAPKAKKAPKEKKAPKEKKPSAAKKPAAHPPYAEMIVEAIAALKERKGSSSVAISKYVEGKHGGKLPTNFRKQLTVQLKKLAAAGKLTRVKNSFKLPATDAKPKAAKPKAPKAAPKPQPSPKAKAKTAAKAQAASPQPQAKAKGQAKPCCFWPPRLPKAPGGPPSQGPPKNLPPRALPSPQGAPQERGGFGFCVPKKGEKRALPPP

SEQ ID NO: 79739 - DNA, 827 bp, Zea mays
  misc_feature: Ceres CLONE 1564873
  misc_feature: Translation starting site: 292
ccccgcggtggcggccgctctagaactagtggatcccccgggctgcaggaattcgtctcacccctagaaaaaaaaactccgtttcgaattctagggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccatgtggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggatctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagatacctttcctgtaccttgcaggaaagctggctggtgatccgaaccttcactttggttgagctgttgctcttaagccctcgggagttaccatcgacatggctatgcagcagcagcatgaggccgagcttgctgcagcagctgcacaacctctttctgattgacattgagaatctga

SEQ ID NO: 79740 - DNA, 865 bp, Zea mays
  misc_feature: Ceres CLONE 1564874
  misc_feature: Encodes the peptide sequence at SEQ ID NO. 79741
tccccgcggtggcggccgctctagaactagtggatcccccgggctgcaggaattcgtctcacccctagaaaaaacccacacagcacgtcggagtagcagtcgagctcggcatcagctcccttactgctcactttgcagcacctcgccagctccctggtaacgctctgcacctgccgtcgaactctctcaggttcggtcatccctgctcccttccaaatcagcgcccctccactcggctccgctactgtgtcgtgcgcgcgcttcctcccgcttccatcgctgggtgcgtgctcatcttccgtcgcatgccacctgctcgatagaatgagcagtttggtcgtccccatctcgctgtggttcatcctcaccatgttttcagatgtgtttgtgttgagatgccattcgaagttgatgatctgttcgtcgccaccggccgcaagcaccagtttcgatgaacgtgagaacgtcttaatcagttgatatgagttgaaaattgatgtgtcgatctgtggtttgacctagtgttctcggcatgtctatgttctggtcgaggccctagatacgtgattgaagatcctttgtggtgatgaaggtgaaatcagcatagcactcgccaagcattctacagaaggtctggactagagaaccatgttgtttcacgtttgttgagtcgggttggattagagtgagctgattcattgctctggctattaggtctaattaataggaatggattttaaaataaaagtgcagtgccaaaaaaatatgggcatttttgaataacttgttttggtcatttaagcactggtaaaattttgagcctattggaagtcttttgcttaaaaagcttgtaaagtccaaaaag

SEQ ID NO: 79741 - protein, 51 aa, Zea mays
  misc_feature: Ceres CLONE 1564874
MSSLVVPISLWFILTMFSDVFVLRCHSKLMICSSPPAASTSFDERENVLIS

SEQ ID NO: 79742 - DNA, 969 bp, Zea mays
  misc_feature: Ceres CLONE 1564875
  misc_feature (229)..(229): n is a, c, t, g, unknown, or other
  misc_feature (252)..(252): n is a, c, t, g, unknown, or other
  misc_feature (253)..(253): n is a, c, t, g, unknown, or other
  misc_feature (262)..(262): n is a, c, t, g, unknown, or other
  misc_feature (270)..(270): n is a, c, t, g, unknown, or other
  misc_feature (286)..(286): n is a, c, t, g, unknown, or other
  misc_feature (319)..(319): n is a, c, t, g, unknown, or other
  misc_feature (358)..(358): n is a, c, t, g, unknown, or other
  misc_feature (412)..(412): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (522)..(522): n is a, c, t, g, unknown, or other
  misc_feature (632)..(632): n is a, c, t, g, unknown, or other
  misc_feature (668)..(668): n is a, c, t, g, unknown, or other
  misc_feature (705)..(705): n is a, c, t, g, unknown, or other
  misc_feature (752)..(752): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (796)..(796): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (867)..(867): n is a, c, t, g, unknown, or other
  misc_feature (927)..(927): n is a, c, t, g, unknown, or other
  misc_feature (949)..(949): n is a, c, t, g, unknown, or other
ccccgcggtggcggccgctctagaactagtggatcccccgggctgcaggaattcgtctcacccctagaaaaaacgttgcccttctcttccccactcgcctccgctcaccttgcctcgatcgttccaggagtgataaaacactaaaatggcgatggcggcggcgaggagagcgctgatggtggggctacgcttgctggtggttcgccctggtgggtagcgagggatgagncacaacccatagcttggggtggnngtctggtanttccaggnggggggctgcccggcngtaccattctggttccgagccaacagagggggnatattatagggaaacgtgtgtccaatgcagcgctgcctnacttcccagggacaggacatattgtgtggtgccccccccgatccaacccgcggngaataactatggatgtgacccccacactcctctcgccnnntttcgatgcgctttagccggctagtgtcacaggcacgagccttaccaagcaaggtccagagagtgccccnacgcccgggggacacccgcttagtagacacgcagaaacaccttgggagtgcagacaccagcgcatagacaggccccgcccaccacccaccgcgggggctctgatgagaantccctcggagtgcgtgccgacgagagcgggctctgnggatctcttctctcttagccgtccccctatcttttanacatcctccttcgtggcgcgccttaagtcggatttccacgcaaggtnagtcgaaccccnnnttatcacctccggctgcgggcccacccagnccnnngcggcgggctatattgatccccatggtccctccgacatatcccgtctctggatctggcaaatacgngagagacaaaagcgtacataggattactactttcagttgtccccccaaacgcctatatgncaattttgggaaggaagggagnacacctcataaatgcaatag

SEQ ID NO: 79743 - DNA, 845 bp, Zea mays
  misc_feature: Ceres CLONE 1564876
  misc_feature: Encodes the peptide sequence at SEQ ID NO. 79744
ctccccgcggtggcggccgctctagaactagtggatcccccgggctgcaggaattcgtctcacccctagaaaaaatcaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacaggggcgccggcgaggccgtctccggccgcggatacaaggagtaccgcctcggggactactccaactggctgcagaagcgcgtcgagaacaccaggaactgggaccggatcaggagctgcctccaggacttccaggtctgcaagagcctgcaggacagaacgagaccgtcgcccaggtcatgaagtccagcctctcccccatcgagtctggctgctgcaagccccccaacagctgcggctacacctacgtcggcggcacggactgaacgccggtgacaacaactcgacggaaccggactgcagaacctgaacaaacaaccctcggggctctgctacaatgg

SEQ ID NO: 79744 - protein, 160 aa, Zea mays
  misc_feature: Ceres CLONE 1564876
  misc_feature (5)..(158): Pfam Name: Tetraspannin Pfam Description: Tetraspanin family
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRGAGEAVSGRGYKEYRLGDYSNWLQKRVENTRNWDRIRSCLQDFQVCKSLQDRTRPSPRS

SEQ ID NO: 79745 - DNA, 890 bp, Zea mays
  misc_feature: Ceres CLONE 1564878
  misc_feature: Encodes the peptide sequence at SEQ ID NO. 79746
  misc_feature (597)..(597): n is a, c, t, g, unknown, or other
  misc_feature (646)..(646): n is a, c, t, g, unknown, or other
ctccccgcggtggcggccgctctagaactagtggatcccccgggctgcaggaattcgtctcacccctagaaaaaatctctctgatctctccctcgctctcgcagccgccactgtagaagcttcgaggctgctgctgcgcccatggccgcggaagccaagacgccgtccctcgctgaggaatattcacttccaccacaggaagttccagtggaaaaggtagctgaggagaagccctctagtggtactgagactgaatctgctccttcaaccaatgatgggactccttcatctgtagaagataagaatgaaacatctgaagtacaagatgctgctgaaaagtcagacgcagaagaaactaacactgctgcagaggaagcaagtgagactaccgaggacgaagaggctgagaaacctgagatcaagattgaaacagctccagcagattttcgtttcccaacaacaaatcaaacgaggcactgtttcacacgctatgttgaataccacaggtgtgtggctgcaaaaggtgaggatgcacctgagtgtgataagtttgccaagtactatcgatccctgtgccccaggtgaatgggttgaacngctggaacgagcagcgtggaaaatggcacgtttccttggacctctgtantccctaacatgcaaaaagaattaggaacctcacgatgttgttgcccgccctttctccttcttgggaaactgggccccaagtttcccggggaaaaaaaacaaaatcatccctctttggagcccccctccaaaaaaaaaaaatatccttttgaactttaaaaaaggcccttgttgctcctttccacaaaggtcttttttcctgggcctcccggaaaaaaacacccggtccacatttacattttttt

SEQ ID NO: 79746 - protein, 147 aa, Zea mays
  misc_feature: Ceres CLONE 1564878
  misc_feature (93)..(146): Pfam Name: COX6B Pfam Description: Cytochrome oxidase c subunit VIb
  misc_feature: SWISSPROT Homolog: EC 1.9.3.1 Cytochrome-c oxidase
MAAEAKTPSLAEEYSLPPQEVPVEKVAEEKPSSGTETESAPSTNDGTPSSVEDKNETSEVQDAAEKSDAEETNTAAEEASETTEDEEAEKPEIKIETAPADFRFPTTNQTRHCFTRYVEYHRCVAAKGEDAPECDKFAKYYRSLCPR

SEQ ID NO: 79747 - DNA, 830 bp, Zea mays
  misc_feature: Ceres CLONE 1564879
  misc_feature: Encodes the peptide sequence at SEQ ID NO. 79748
ccgcggtggcggccgctctagaactagtggatcccccgggctgcaggaattcgtctcacccctagaaaaagggcgctcggggagcgccgcggcgccggcgtccgggtgatggcgttcgtcaccttcgcggggctcaggcccagggacgtggacctcgtggcccgcgccgtcctgcccaagcactacatggagcagctcagcgcgctggcgtacggcagcctctggctcccggccaggaggaaggtggcggtgaccagcgcgccgcgggtcatgtccgagtggttcctcaaggagtacatggccgccgacgcggtggtcgggctcgagctgcagcacgtcaacgtcggccgccgccggtacttcactgggttgctgctgtcgtccggtcacgcgacgggtacggagctgaagcagaaggcgatcacggaggcgttgttaggcgccgaggacgaccccattggccgtcgtggggatcatcagcggactccagccccgctcgacgacgaagcttcttcgttcccctactgacaaggaaactttacctcttggacccaaaaaaaccccaaaaaaagaacaaagctcctcccggggaaaaaaaacccaaaggcccctccatttttcccacaaaggggggccctttgccttttttcccccccccccccccccccccccaaacccccccctttttttcccttttttcttttcgggttggggggggggggccccccctccccgtttttcccgggatttaaaaaacacgggggaggagggttcccccccctttaaaaaaaaaaataaaatttttttggaaaaaaacgcccgctaatttt

SEQ ID NO: 79748 - protein, 139 aa, Zea mays
  misc_feature: Ceres CLONE 1564879
  misc_feature: SWISSPROT Homolog: EC 2.3.1.15 Glycerol-3-phosphate O-acyltransferase
MAFVTFAGLRPRDVDLVARAVLPKHYMEQLSALAYGSLWLPARRKVAVTSAPRVMSEWFLKEYMAADAVVGLELQHVNVGRRRYFTGLLLSSGHATGTELKQKAITEALLGAEDDPIGRRGDHQRTPAPLDDEASSFPY

SEQ ID NO: 79749 - DNA, 858 bp, Zea mays
  misc_feature: Ceres CLONE 1564886
  misc_feature: Translation starting site: 160
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaatcgcttacatggtaggagtgccgcgtgccacacaagtcggattgctaacaagcagccagaccaagagttcttggcccacgtgtctatggtgtcaaggatgaagcatgaaaatgttgtagagttgcttggttactgtgctgatgggacactccgcgtccttgattatcacttccccaccaagggctcccttcacgatatgcatcatcgaaagaaagggattaaaggcgctcaacacagtccaatcttatcctgctcccgactcgtcaacatatccgctgaggaagcgaaacgcctcgactatcttcagtgagaaagcgcagccccatatcataccccgacacctccagtctagaaacctccttcttttccatcactatatacctcagatcgctgacttttatctgtcgaaccaagctcctgacatggcagctcggcttcactcaactacggttctcgcaacattcggataccatgcgcctaagtatgcgatgacgggacaactcagctctaagagtgatacatatagttcatagcgttgcttcttctacagctactcacagggaagaaagctgaccatcatacattgcccacgcgacagcagagtctcgtgacctgagctacaccaagactcaacgaacacaaggttagacagcgtgttcactcgagactttgaggggactatcgtcctaagctgctagcgaagttggcggctgtcgcccgacttgggtgtcaataccaagtccaactcacggccgacatgagccattggtgactaaggcactca

SEQ ID NO: 79750 - DNA, 782 bp, Zea mays
  misc_feature: Ceres CLONE 1564887
  misc_feature: Encodes the peptide sequence at SEQ ID NO. 79751
  misc_feature (506)..(506): n is a, c, t, g, unknown, or other
  misc_feature (575)..(575): n is a, c, t, g, unknown, or other
ctccccgcggtggcggccgctctagaactagtggatcccccgggctgcaggaattcgtctcacccctagaaaaactcaccaagaaagaaaaacagacacacgtcactgttcgccttgtccggtcgtttctgctccattcctcctcctgcaagccgcaaaggaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgtagtgtgcctgtccttgctgccaacaatatttttgagagtgagatggccaagtttcagggaatgttgaaccggtcattgagggtctgtcaagataagtttgaagctgccaatctccagaaaagtgaatcagatgncactcgggaactggaatcctgtgtcaacagatctattgatgacagcctcagggtccttccgcatgtggntggatcaggatcagtccccccctcaaaatccattagaggccactattaccttttagcaaatgaacccagaatatagttgaaaaaggttttcaaattccaaattcgctggcataacttcccattttttccgaacctccttaccgatttttggttgaaaccgggatccccccccttcccgaagttttttgggaatcccgcgcccttccc

SEQ ID NO: 79751 - protein, 156 aa, Zea mays
  misc_feature: Ceres CLONE 1564887
  misc_feature (10)..(137): Pfam Name: DUF842 Pfam Description: Eukaryotic protein of unknown function (DUF842)
  misc_feature (109)..(109): Xaa is any aa, unknown, or other
  misc_feature (132)..(132): Xaa is any aa, unknown, or other
MGEQVVTEQIQRKLEEVNATVQQHLAGVQDHINFTMQQAYFKCAYGCFDRRHTQEAISNCVENCSVPVLAANNIFESEMAKFQGMLNRSLRVCQDKFEAANLQKSESDXTRELESCVNRSIDDSLRVLPHVXGSGSVPPSKSIRGHYYLLANEPRI

SEQ ID NO: 79752 - DNA, 901 bp, Zea mays
  misc_feature: Ceres CLONE 1564889
tccccgcggtggcggccgctctagaatagtggatcccccgggctgcaggaattcgtctcacccctagaaaaatactttctttcagtgtgctctccagccttggagacggaatcctatctttcactggcgatgtgcgtggctgccctctgaccccgtctctctgctccttgtgaaccgggtactcgtaccgaaagatgcccccggggccacggcccacggccctgctgggcaacactcctcgatgtcttccgcggacactgcccgtgtcgggccacgagtgggcatgggccctccggccgatcccgaggcgcgccctgagaacctcgacgcggggcggtggaccgccgcccgagcggaccaagaactgcctccatacctcatactaggtgatcgcctaccgccgccgggaccgctccaccaaaagcttaaggcggacaggcccatacatcatctgggccaattattgcccccattaaatcaaggtgcccaagatctgcactctaaagtctcggttcaatctgaaggctcgacgctccttggcccatgcccgcgatacgaagtctcagcctcggtgcgaatgcgctatcagacggccacttcgactagctgtacaaggaaaccttctcgtggctaacaaccacatctctagaagaagactttaacatgctacctctcctagggcttcgggaaaccgtctcctgggacgctgctacgcgaacctggaaggatcatagggcttctagtttcaagggggatcgtttctacacttggcctcgaacgatcgggggccatcccctccctcaataggctacaaaaaagggtcaatggatctgcccctttggctaggcatcccccgaccgaaagaaacaacggcctttccaaatgtcccagcgggaggcac

SEQ ID NO: 79753 - DNA, 770 bp, Zea mays
  misc_feature: Ceres CLONE 1564892
  misc_feature (337)..(337): n is a, c, t, g, unknown, or other
  misc_feature (740)..(740): n is a, c, t, g, unknown, or other
ctccccgcggtggcggccgctctagaactagtggatcccccgggctgcaggaattcgtctcacccctagaaaaaattctctcggcgacgactgggagaccgccgccgccgccatcctactccaggtgccctgagaactcgatcggagtcttcgctggcgacgaacacccaccagctatcaggtgtacaaccatgtacttcaccgtgtccgcccctgcaatgtctctatgatcctccagctacggtagacgccccgttcgctagctgaggacctcctggttcctgtgagcaggcggcgtggttagctgctgccttcaagcatgcagagaccccaacgncgcccggttcgggttttggggccctatcatttttcccctttttttgggggagggggcctctaataagggggggggaaaatattttttttccccccccccccgggggggggggggggggggaaagaagaaaacccccccccccccggttttttttttgtggaagaaaaaaaaagttggggggggcccccccccccccccgggttcttggggaaaagaaaaaaatatttttttttttttttttgggggggggggggggaaaaccccccctttggggggtgttttaaaaaaaaaaaaaaaaaaaaaaattttccccaaaacaaagggggtgttcctccccccaaacacaaaaaaaaaattatttttttttgttgttgtgtggggttgtgtgggggggggagaaaanaaaaacccccccccccccgggtgtttgggt

SEQ ID NO: 79754 - DNA, 766 bp, Zea mays
  misc_feature: Ceres CLONE 1564894
  misc_feature: Encodes the peptide sequence at SEQ ID NO. 79755
ctccccgcggtggcggccgctctagaactagtggatcccccgggctgcaggaattcgtctcacccctagaaaaagcattgtggctccttacttccgcgccgccacccctacaggtaaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtgtcatatgtgaagactcctcgtgggctccgcacactcaactctgtttgggcccaacatccttagcgaaagaagtgaaggagaaaggttctccaagaactggtgcaagaacaaaaaaaaggctttcccaaagtatgctctccaaatttgaaaaatgatccttggcaaaaagggaaatcccccctcccccttgaaaaaaaataaaaaaaaaatgccttcgggttatccccggggcccattgtcccccacccccccggatttttggaaaaaaataaaaagggggtttttaaaaccccaaaaaaaaaaggggccccccccccgggggggggggggaaagattttccgggggggcccaaagggggg

SEQ ID NO: 79755 - protein, 110 aa, Zea mays
  misc_feature: Ceres CLONE 1564894
MSHRKFEHPRHGSLGFLPRKRSSRHRGKVKSFPRDDPKKPCHLTAFLGYKAGMTHIVREVEKPGSKLHKKETCEAVTIIETPPLVIVGLVSYVKTPRGLRTLNSVWAQHP

SEQ ID NO: 79756 - DNA, 709 bp, Zea mays
  misc_feature: Ceres CLONE 1564896
  misc_feature: Encodes the peptide sequence at SEQ ID NO. 79757
  misc_feature (383)..(383): n is a, c, t, g, unknown, or other
ctccccgcggtggcggccgctctagaactagtggatcccccgggctgcaggaattcgtctcacccctagaaaaagactcaagccttccttgctccttgccgccgtcgagtcgtcgcaggaacgatgacccggcggaacggctgtacgatctacgtgggcaacctccccggcgacatccgcgagagggaagtggatgatctcttctacaagtatggacgtatagtggaaattgacttgaaaattccaccaaggcctcctggttttgcttttgttgagtttgaggacgcacgtgatgctgaagatgcaatatatggccgtgatggatacaactttgatggccataggttgcgggtggaattagcccatggtggacgaggcacatncttcttttgatcgatctagcagctatagcagtgctggacaacgcggtgcctcaaaacttctgattacgtgttatgttactggataccttctcacatcatggcagatctcaggacatatgcgcgagctggtgatgtctgtttcactgatgtgtatcgtgagggctggagcacctatggaaatagctgatttttcctaacctttgaaagaatttgaaaaacccccgaataagggaagccctaagaggaattcttgaaatttcccggaaaaggcgctttttttcaaggggacaattatttttccccggggttaaaaaggggaaaaaatt

SEQ ID NO: 79757 - protein, 89 aa, Zea mays
  misc_feature: Ceres CLONE 1564896
  misc_feature (9)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (87)..(87): Xaa is any aa, unknown, or other
MTRRNGCTIYVGNLPGDIREREVDDLFYKYGRIVEIDLKIPPRPPGFAFVEFEDARDAEDAIYGRDGYNFDGHRLRVELAHGGRGTXFF

SEQ ID NO: 79758 - DNA, 864 bp, Zea mays
  misc_feature: Ceres CLONE 1564898
  misc_feature: Translation starting site: 182
  misc_feature (361)..(361): n is a, c, t, g, unknown, or other
  misc_feature (499)..(499): n is a, c, t, g, unknown, or other
  misc_feature (626)..(626): n is a, c, t, g, unknown, or other
  misc_feature (655)..(655): n is a, c, t, g, unknown, or other
  misc_feature (687)..(687): n is a, c, t, g, unknown, or other
  misc_feature (688)..(688): n is a, c, t, g, unknown, or other
acccgcggtggcggccgctctagaactagtggatcccccgggctgcaggaattcgtctcacccctagaaaaaagtggcctcatctctctcttcctcttctcccgccgcccagcttctctcttctctcggcggcgccaccacggcgatcaagcgcgatacgggcgtaaccgaagaatcgacaatgggcggcgagaaggaaacctttgatacgtccgacctcaacgcctccctccccgcggccgctgcagccctcagcgccgaggaccgcgccggcctcgtcaatgcccttaaggataagctgcagagcctggcgggccagcacgccgatgtgttagagacgctgtcgcccaatgttaggaangcgggttgagttttttgagagagatccagagtcaacacgatgaaattgaggccaagtttttttgaagaacgagctgcccttgaggcaaagtaccagaagctttatgaacctttatacacaaagaggtatggaattgtnaatggagaagggaggtaagatgggtggtttttgtgatgaacccggccagtgagaatactgtttgaggggaaaaagaaccagacgctaaagggagttccagaacttttggcttactgccatgaaaacnaaacgaggttttttgtctgaggagatacnagagcgcgatgaagccgctttgaaatatctannagatatcagttgtctagaatcgagggatcctagggttttcagctggattttttctttgatacaaaccattcttcaagattctgtcctgacaaacgtaccacatggttgatgagatgacccattttggagaagctatgaactgaaatcagtggatcctggaaaactaacacgagatt

SEQ ID NO: 79759 - DNA, 703 bp, Zea mays
  misc_feature: Ceres CLONE 1564899
  misc_feature: Encodes the peptide sequence at SEQ ID NO. 79760
  misc_feature (219)..(219): n is a, c, t, g, unknown, or other
  misc_feature (278)..(278): n is a, c, t, g, unknown, or other
  misc_feature (285)..(285): n is a, c, t, g, unknown, or other
  misc_feature (289)..(289): n is a, c, t, g, unknown, or other
  misc_feature (290)..(290): n is a, c, t, g, unknown, or other
  misc_feature (294)..(294): n is a, c, t, g, unknown, or other
  misc_feature (297)..(297): n is a, c, t, g, unknown, or other
  misc_feature (482)..(482): n is a, c, t, g, unknown, or other
  misc_feature (676)..(676): n is a, c, t, g, unknown, or other
  misc_feature (677)..(677): n is a, c, t, g, unknown, or other
  misc_feature (680)..(680): n is a, c, t, g, unknown, or other
ctccccgcgggtggcggccgctctagaactagtggatcccccgggctgcaggaattcgtctcacccctagaaaaaagcactagcagtaagaaacttgtcgaagtcgtcgtagttttacgtgctccgcccgtcccgtgcgccatgtcacgcagcaacgccttgctgtggttgttgcttctcgcgctctcgtgctggtcgtggtgcggcgccgtcacggcngcggccgaccccgagcgccagcaccagcaccacccacggccggcggcgggcttcatccngggtcgntggnntgcnccngggggggaacgggaaaaatttaccccgggcctggtgaaaacggaacctttggcccccttaccggggggaaaggtggggggccaagcccggggccccctttttttttttgggggggggccttaaaaaagggtcaccccccctggagaaaaccccgccccccccccggggggggggggggagaattnaccccccgcccccaaaaaaaaaaaaaaaaaaaagaggggggggggggggggggaaaaaaaagaaaaaaaccaccctttttttttttttttggggggaacaaaaaaaaggggggggggaaaaaaaataggggggggggttttctccaaaaaaaaaaaaaccccgcgggcgtttttcttttttgtttttgtggggnnaangttattttgtgggaaaggagaag

SEQ ID NO: 79760 - protein, 92 aa, Zea mays
  misc_feature: Ceres CLONE 1564899
  misc_feature (46)..(46): Xaa is any aa, unknown, or other
  misc_feature (50)..(50): Xaa is any aa, unknown, or other
MSRSNALLWLLLLALSCWSWCGAVTAAADPERQHQHHPRPAAGFIXGRWXAPGGEREKFTPGLVKTEPLAPLPGGKVGGQARGPLFFFGGGP

SEQ ID NO: 79761 - DNA, 760 bp, Zea mays
  misc_feature: Ceres CLONE 1564901
  misc_feature: Encodes the peptide sequence at SEQ ID NO. 79762
caccgcggtggcggccgctctagaatagtggatcccccgggctgcaggaattcgtctacccctagaaaaaaggaaaaaaccaaccaccgtgcgccagccgccacgccagcgcctgccatggctcctctcctccccctccccatcccggtgtaaagagaagttccaaatcaacattgtggataatggcaatgttgactctggaaagacgacaaccataggacacctgatctacaagcttggaggaattgacaagggtgtgatcgagaggtttgagaaggaggctgctgaaatgaacaagcggtccttcaagtacgcatgggtgctctacaagctcaaggctgagggtgagagaggtatcaccattgatatcgctctgtggaagtttgagaccaccaagtactactgcaaggtcattgatgaccctggacaccgtgacttcatcaagaagatgatcactgctacctctgaggctgactgtgctgtccttatgattgactccactactggaggatttgaagctggtatctccaatgatggacagaaccgagaacatgctctcgttgcggtcaaccttgggagtgaagcacatgaatttggtgctgcaacaagatggatgcaaccacctcaaaaatattccaaagcaaggtaatgaggaaaattgtgaaaggaaagtgccaatcctaacctcaaagaaaaagtgggggtaaaaacccttgaaaaaaaaagggcattccgtttcccaaatatttaaggtttttta

SEQ ID NO: 79762 - protein, 119 aa, Zea mays
  misc_feature: Ceres CLONE 1564901
  misc_feature (1)..(118): Pfam Name: GTP_EFTU Pfam Description: Elongation factor Tu GTP binding domain
  misc_feature: SWISSPROT Homolog: EC 2.7.7.4 Sulfate adenylyltransferase
MNKRSFKYAWVLYKLKAEGERGITIDIALWKFETTKYYCKVIDDPGHRDFIKKMITATSEADCAVLMIDSTTGGFEAGISNDGQNREHALVAVNLGSEAHEFGAATRWMQPPQKYSKAR

SEQ ID NO: 79763 - DNA, 869 bp, Zea mays
  misc_feature: Ceres CLONE 1564902
  misc_feature: Encodes the peptide sequence at SEQ ID NO. 79764
ctccccgcggtggcggccgctctagaactagtggatcccccgggctgcaggaattcgtctcacccctagaaaaaggtccacaattccgcattgccatctagtccagttccagtccgagcagcagcaagcggcggcggcgatgggctctggatccaactccaaggagggagaggagcgggtgctgagccacggtgacgtggtgctcatccgctccgacctcgcaatccttcgcggtccctgcttcatcaacgaccgcatcattgccttctacttcgcacacctctccgccagcctccaggacgacgacctcctcctgcttccgccctccatcccctacctcctctccaacctccctgactcggccgccgtcgccgccgtcgccgagccgctccccctcgcctcccgccgcctcgtgctgcttcctgtcaacgacaatcccgatgcctccatcgccgagggcggttcccactggaccctcctcatccttgataacatcactagcccctccgtgccccgctttgtccaccacgacagcatcgctggagcgcccaacctcccaatcgctgcccgccttcccgacgcactccgccccccggtgtcaggcagcaaattccagaaggatactgttccgctttatcgagggggccaccccaaggcagaaccaacggctattactgggggggcctatggtcatggccatcccccggggctcttttgcccctggggggaaaaagtggctcggaacccaccaaggaaggccaattggtttcccccgccggtcaaagaaccgggggtgtgaaccccccaacagcttctcaaggccctgtagagaacccaactctggttgcacacataatctgggccctctt

SEQ ID NO: 79764 - protein, 219 aa, Zea mays
  misc_feature: Ceres CLONE 1564902
MGSGSNSKEGEERVLSHGDVVLIRSDLAILRGPCFINDRIIAFYFAHLSASLQDDDLLLLPPSIPYLLSNLPDSAAVAAVAEPLPLASRRLVLLPVNDNPDASIAEGGSHWTLLILDNITSPSVPRFVHHDSIAGAPNLPIAARLPDALRPPVSGSKFQKDTVPLYRGGHPKAEPTAITGGAYGHGHPPGLFCPWGEKVARNPPRKANWFPPPVKEPGV

SEQ ID NO: 79765 - DNA, 654 bp, Zea mays
  misc_feature: Ceres CLONE 1564903
  misc_feature: Encodes the peptide sequence at SEQ ID NO. 79766
  misc_feature (206)..(206): n is a, c, t, g, unknown, or other
  misc_feature (207)..(207): n is a, c, t, g, unknown, or other
  misc_feature (620)..(620): n is a, c, t, g, unknown, or other
  misc_feature (627)..(627): n is a, c, t, g, unknown, or other
  misc_feature (628)..(628): n is a, c, t, g, unknown, or other
ctccccgcggtggcggccgctctagaactagtggatcccccgggctgcaggattcgtctccccctagaaaaaagcatctcaagccaccatcgaccttcaagtctcgctacgtagcagtgcaataaaaaaagcagccgcaatggcgagcagcaccatggccctctcctccacggccttcgccggcaagggccgtgaacgtgccgtcnngtcgtccggccttcggcgagggcccgcgtgaccggatgcgcaaagacggcgggcgaaggcccaagcccaggcgggccggggccgttccccggggaaagccccgttgggtaacgggccccccaaccgggttggcttgtaccctggggccccaaatgtgtccgggggaaaccccccccaaaccttccctgaacaggggggaaattccccgggggggaaattaccggggttggggggaaacacccccgggggggtttttttccggggggaacccccgggaaaaaaaaattttctccccccaaaaagaaaaacccccggggaaaaccccctggggggagtgggaatacccccccccccccccccccctgtggggggccccacttttttgggggggggcgcccccccccccccttctncgcgggnnggggggggcgggcgcgtcttttttcc

SEQ ID NO: 79766 - protein, 32 aa, Zea mays
  misc_feature: Ceres CLONE 1564903
  misc_feature (23)..(23): Xaa is any aa, unknown, or other
MASSTMALSSTAFAGKGRERAVXSSGLRRGPA

SEQ ID NO: 79767 - DNA, 804 bp, Zea mays
  misc_feature: Ceres CLONE 1564904
  misc_feature: Encodes the peptide sequence at SEQ ID NO. 79768
  misc_feature (572)..(572): n is a, c, t, g, unknown, or other
  misc_feature (707)..(707): n is a, c, t, g, unknown, or other
ctccccgcggtggcggccgctctagaactagtggatcccccgggctgcaggaattcgtctcacccctagaaaaagctgtcctctgtgctatccgctagggtttatctgctcgaggaatggcgtcggtgcaggtctccggcgcgggggtcggtgccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgagaagaagacaactggtggaatcttgctccctacgactgctcagtccagacctcaaggtggcgaggtagttgttgttggagaaggaagataattggggataaagaaagttgatgtcagcattcaggttggagctcaggttgtgtattctaagtacgctggaaccgaggtcgcgttgaacgatcacagccatctggttctcaaagaggatgacgttataggtatnctagaaactgatgacgtgaaagacatgaagcctcttgaacgacgtgttcctatcaaagttgctgaaactggaagacaaaactccaggaggctactgcctacggaaactgcccaggaagaaccatctttcgaaacngtcctaacggtttggccaaggccccctggaaaaaaacggcaaaagctttccccttgtccctttccggggggaaaactttccttgtaccccaaaaacc

SEQ ID NO: 79768 - protein, 107 aa, Zea mays
  misc_feature: Ceres CLONE 1564904
  misc_feature (62)..(107): Pfam Name: Cpn10 Pfam Description: Chaperonin 10 Kd subunit
MASVQVSGAGVGAAAFSVKGKASTGALRLRSTLTFGEVCPARRAFRGLVVRAATVVAPKYTTLKPLADRVLVKINSSEKKTTGGILLPTTAQSRPQGGEVVVVGEGR

SEQ ID NO: 79769 - DNA, 876 bp, Zea mays
  misc_feature: Ceres CLONE 1564905
  misc_feature: Encodes the peptide sequence at SEQ ID NO. 79770
ctccccgcggtggcggccgctctagaactagtggatcccccgggctgcaggaattcgtctcacccctagaaaaagccacactcagtccacccgttcccactcccagccagggttgccccgccgcttgcggttgcagctaccagagccgagaccgagagagcctgagctagacacgcagccagcaagcgccgagtcagcgagtccgacgacgccatggacgccgtctcctgcgcgggcgtggcgccgcagagcgcgctcctgtcccacacccactccttcgccgacgcggccatcgcgcgcgcgctgcacttctccctctccgatcacgccgccgcggacccgcccgccacgacgacggcggcgatgctgatgcaaggcgccgtggcagcgacggactgtaccccgacgagcgcagcggcgtcgccgtcctcgttcgcgcggtgccggctgggcccggcgggcgggcacgcggggaagcggcgccggccgcggccgtccaagcgcgcgcccaccacgtacatcagcaccgacgccgccaccttccgcgccatggtgcagcgcgtcaccggcgccgacgaggccgacctgcagccgccgcagcaagacgggctcgggctcggccttcttctggcgcaactcggggccgagcgggttctacagggcggcggggaacgcggcggccccacgtcgcttgctggacccgaaaacgccctgcccccgccccttgggggaagccaaaaaaaaaaccccttggacccccaaatctgggaccccgtgaaaaccggatgccccgggaaaaaaaaccccaggtggggccctaacccctgaacgggggccaaggaaaaactggtccccgaattgttccccccctcccgt

SEQ ID NO: 79770 - protein, 204 aa, Zea mays
  misc_feature: Ceres CLONE 1564905
  misc_feature (96)..(126): Pfam Name: VQ Pfam Description: VQ motif
MDAVSCAGVAPQSALLSHTHSFADAAIARALHFSLSDHAAADPPATTTAAMLMQGAVAATDCTPTSAAASPSSFARCRLGPAGGHAGKRRRPRPSKRAPTTYISTDAATFRAMVQRVTGADEADLQPPQQDGLGLGLLLAQLGAERVLQGGGERGGPTSLAGPENALPPPLGGSQKKNPLDPQIWDPVKTGCPGKKNPRWGPNP

SEQ ID NO: 79771 - DNA, 809 bp, Zea mays
  misc_feature: Ceres CLONE 1564906
  misc_feature: Encodes the peptide sequence at SEQ ID NO. 79772
gcggtggcggccgctctagaactagtggatcccccgggctgcaggaattcgtctcaccccagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccgtcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctccgcctgggcgacgaccccgaggccttcgccaagctcagggtgaaggaactcagaacggccgcccccgccatgttttcatggttcgggttcttcggtcaaggccatcga

SEQ ID NO: 79772 - protein, 230 aa, Zea mays
  misc_feature: Ceres CLONE 1564906
  misc_feature (61)..(229): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPVDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLRLGDDPEAFAKLRVKELRTAAPAMFSWFGFFGQGHR

SEQ ID NO: 79773 - DNA, 829 bp, Zea mays
  misc_feature: Ceres CLONE 1564907
  misc_feature: Encodes the peptide sequence at SEQ ID NO. 79774
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccnnnnnnaaaactggagctccccgcggtggcggccgctctagaactagtggatcccccgggctgcaggaattcgtctcacccctagaaaagcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccggggcaagcggaagcagaacgtgctcggccaagaaaggccccccaggaacaggggaccttaaggtttgggtcgtcccaaaaaaaagggggttaaaacttttccccccgaaaaaaaagggggtttctcaaagatcttcttacccccccaaaaaaaaaggggtgttttttaaaaacggggggggggccccttttgggggggcccccttatttccccccaaaaggggggtgtaaaaaaattcccccccccccccgccccaataaaaaaaagggggtctccctcccctggggagggaggggggccccttttttgcccccccctcccccgcgggggagagggggggccccccctttt

SEQ ID NO: 79774 - protein, 70 aa, Zea mays
  misc_feature: Ceres CLONE 1564907
MATQISKKKKFVSDGVFYAELNEMLTRELAEDGYSGVEVRVTPMRTEIIIRGKRKQNVLGQERPPRNRGP

SEQ ID NO: 79775 - DNA, 911 bp, Zea mays
  misc_feature: Ceres CLONE 1564908
  misc_feature: Encodes the peptide sequence at SEQ ID NO. 79776
gcggtggcggccgctctagactagtggatcccccgggctgcaggaattcgtctcacccctagaaaaaacggacaaaaaccaaccaccgtgcgccagccgccacgccagcgcctgccatggctcctctcctccccctccccctccccctccccctccggctccgacccatccccggggagaactccatttcccggctcgcaccgaggccaaggttccctcgtcccttctcgaggcggcgcctacgcgttcccgccctcctccaagtccaatgcctcgcggccacgggccccgccgcgcccgcgccgcggtggcacgcggcactgtccgccgcggcggggctgtaccgggcctacgtcggaggcggcgcctccgtggccttcacgcggaccaaggcgttcgggtggttagtggcgctggcgcggggagtctacaccggtacggtcgggtgcatcagggtcgggatggggctgaggctgcaggttggtgacgtcgccggcctggtaagggacagggcccgtaggattgggggcgggggggggggacaagtaagagaaaaggggcgggggtgtggcggaaagggttagccaggcggcggggggcttgccaaaggaaagtgtaaggtggggcaaaatgaagagaggggatagtgggcgagaggaaggaacgggcggccggagggggggggaattgtgagtgggggaagggggagaaggttgcagggtagcgcggaggggggggagaggggcgagcgagaaagtgaggagggggggatgagccgcggtgatcggaatgtgtgaaaaagaaaaggtgtgggggctggggaggttttaaatggtcgggtggggggggagagggcgagaaataaactgttgggaaaataggagagagggtgaggggaggaggggggtaag

SEQ ID NO: 79776 - protein, 40 aa, Zea mays
  misc_feature: Ceres CLONE 1564908
MGLRLQVGDVAGLVRDRARRIGGGGGGQVREKGRGCGGKG

SEQ ID NO: 79777 - DNA, 631 bp, Zea mays
  misc_feature: Ceres CLONE 1564909
  misc_feature: Encodes the peptide sequence at SEQ ID NO. 79778
  misc_feature (312)..(312): n is a, c, t, g, unknown, or other
  misc_feature (463)..(463): n is a, c, t, g, unknown, or other
ggagctccccgcggtggcggccgctctagaactagtggatcccccgggctgcaggaattcgtctcacccctagaaaagcagctcattcgccgaggaaacgagatcctctagaggtttgtgctgtttagcgtgagtttttttggggccgatttgctttgctcgcatgggggatcatgtcgcggtggatgttggggagctcgtagcgtcccgagtcggtgaggcagcggggctagtgtccggcgccaaggaggaaacagaggcgctgattggggatggtggagtgccgcatttgccagggagggaggacctcangaaagaacctttcgagagcccctgcgcttgcaacggcagccctcagtatgctcacagagaatgtgtgcaacgatggtgcaatgagaaaggggatacaatctgtgaaatctgccatgagttgtacaagccctggtacactgcccccaccccnggtgcatcctgatgaaactaccatagaagtaagtgggggtgaaaatgggaccatctcctgggcaaccgtttggaatttaccctggacccccaaaaaaattgggccaatgggttggctggttcaaaaaccccgttttacctttggaggagccaactctttgtgttggaa

SEQ ID NO: 79778 - protein, 103 aa, Zea mays
  misc_feature: Ceres CLONE 1564909
  misc_feature (47)..(87): Pfam Name: zf-C3HC4 Pfam Description: Zinc finger, C3HC4 type (RING finger)
  misc_feature (50)..(50): Xaa is any aa, unknown, or other
MGDHVAVDVGELVASRVGEAAGLVSGAKEETEALIGDGGVPHLPGREDLXKEPFESPCACNGSPQYAHRECVQRWCNEKGDTICEICHELYKPWYTAPTPGAS

SEQ ID NO: 79779 - DNA, 787 bp, Zea mays
  misc_feature: Ceres CLONE 1564910
  misc_feature: Encodes the peptide sequence at SEQ ID NO. 79780
  misc_feature (621)..(621): n is a, c, t, g, unknown, or other
  misc_feature (625)..(625): n is a, c, t, g, unknown, or other
  misc_feature (629)..(629): n is a, c, t, g, unknown, or other
  misc_feature (630)..(630): n is a, c, t, g, unknown, or other
  misc_feature (643)..(643): n is a, c, t, g, unknown, or other
  misc_feature (644)..(644): n is a, c, t, g, unknown, or other
  misc_feature (652)..(652): n is a, c, t, g, unknown, or other
  misc_feature (672)..(672): n is a, c, t, g, unknown, or other
ctccccgcggtggcggccgctctagaactagtggatcccccgggctgcaggaattcgtctcacccctagaaaaagggcgctcggggagcgccgcggcgccggcgtccgggtgatggcgttcgtcaccttcgcggggctcaggcccagggacgtggacctcgtggcccgcgccgtcctgcccaagcactacatggagcagctcagcgcgctggcgtacggcagcctctggctcccggccaggaggaaggtggcggtgaccagcgcgccgcgggtcatgtccgagtggttcctcaaggagtacatggccgccgacgcggtggtcgggctcgagctgcagcacgtcaacgtcggccgccgccggtacttcactgggttgctgctgtcgtccggtcacgcgacgggaacggagctgaggcagaaggcgatcacggaggcgttgttaggcgccgaggacgaccccattgccgtcgtgggcatcatcagcgactccagcccgctcgacgacgagctcttcgtcccctactgcaaggaactttacgtcgtgagcagagagagcgcaaagaaacgacagctctcgcggggagaatacccaaagccgctcatcttccacgacggggcgcntcgncttnnctcccacccccgnncgcatggntcgctttctcctcttccttncggctcgcgtcgtcctctccgtcatccgcattaacatcggtatcgttcctcccttacagaatcaacttcgcgacagcggcaatcttgggggtccggttcggggcctcgggcctcg

SEQ ID NO: 79780 - protein, 197 aa, Zea mays
  misc_feature: Ceres CLONE 1564910
  misc_feature: SWISSPROT Homolog: EC 2.3.1.15 Glycerol-3-phosphate O-acyltransferase
  misc_feature (170)..(170): Xaa is any aa, unknown, or other
  misc_feature (173)..(173): Xaa is any aa, unknown, or other
  misc_feature (178)..(178): Xaa is any aa, unknown, or other
  misc_feature (187)..(187): Xaa is any aa, unknown, or other
MAFVTFAGLRPRDVDLVARAVLPKHYMEQLSALAYGSLWLPARRKVAVTSAPRVMSEWFLKEYMAADAVVGLELQHVNVGRRRYFTGLLLSSGHATGTELRQKAITEALLGAEDDPIAVVGIISDSSPLDDELFVPYCKELYVVSRESAKKRQLSRGEYPKPLIFHDGAXRLXSHPRXHGSLSPLPXGSRRPLRHPH

SEQ ID NO: 79781 - DNA, 810 bp, Zea mays
  misc_feature: Ceres CLONE 1564912
  misc_feature: SWISSPROT Homolog: EC 2.3.1.16 Acetyl-CoA C-acyltransferase
ccccgcggtggcggccgctctagaactagtggatcccccgggctgcaggaattcgtctcacccctagaaaaatacttctactagtaccatccgggctacttcggcaaggttggcatgcgttacttccataagctccgcaacaagttctactgccccgcggtcaacatcaagcgcctctggtcgatgagtgcccgccgacaaagcggcggaggccggactccacaaggccccgcatatagacgtcacacagttcagctacttcaacgtgctcgggaagggggtgctgccgcccaagcccattgtcttcaaggccaagctcatctccaatgtctccgagaaaaagatcaaagcagcatgcggggccatcctgctcaccgcctaggtttcaatccttgttcgcctcctggctttgaaatctatatatatgtacacatcaactgaactgatagtgctttcactgtctcagcaatttgtgttaagaaaacctatactcttaaaatatgtggttcctgcctgttgcgcagtgcttatgcggtttatgatgccagttcatatcatcctagaactagaaaaaaaaaacaactgcatccacagcctctagaaaattcaaggatgagatcgtcccgatcccaacaaagatcattgatcactaaaactggacaggagaaggaaattgtgatatcagttgatgatgggattaggacagggtacacggcatctggattggcgacactgagaccagttttatgatatgatggaactactaatgacagcaattccagtcaaatgagtgatggcgctaggactgtt

SEQ ID NO: 79782 - DNA, 717 bp, Zea mays
  misc_feature: Ceres CLONE 1564913
  misc_feature (138)..(138): n is a, c, t, g, unknown, or other
  misc_feature (494)..(494): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (644)..(644): n is a, c, t, g, unknown, or other
tggagctccccgcggtggcggccgctctagaactagtggatcccccgggctgcaggattcgtctccccctagaaaaagccatagcctcctcgtctcctcgagaactgtagcatcacgcgccgcctttgttgagcaggnctgggagagaggagaagagagggtgaaagggggcaagaaaacgcttcttgttgcctttgtgcttcagcggatccgcggtgggctgcgcacgcccggcgggggaaagaaggaatccccgggcgggccccgccctcccagttcttttttttcccccccccggggcctttcccgggggggtttttttttgcccccagggccccgaaaggccccccggggccccccgggggccccccggggggcccccaaaaaaaataattttccccccccccccggggaaaaaaaacaacaaaaaaaaaatttttttttttcccccgggggggggggggcccccccccccctttcccccccccaacggnatttattttcccccccccccccttctatattaaaaaaaaaccacacannnggggggggggggggggggggggggccccgccccccccccccccccccccccccctccttttttttttttttataaaaaaaaaaaaaaaaaaaaannnggngggggggggggggggggggttggttttttttttttttctccccccccccccccccggggagagaaaaaaaaaa

SEQ ID NO: 79783 - DNA, 827 bp, Zea mays
  misc_feature: Ceres CLONE 1564914
  misc_feature: Translation starting site: 162
acccgcggtggcggccgctctagaactagtggatcccccgggctgcaggaattcgtctcacccctagaaacataaccagcacacagctctcgccttctctctcccatcggcacacccgagctcgctccctccttccacgtcgaggtccgagtcctgctttgatggcgaccgacgtggctgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctatgcgattgccaagttcgtggaggacaagcacaaggacaagctcccgcccaacttccgcaagcttctgaacgttcagctcaagaagctcgtcgccggcggcaagctgaccaaggtgaagaactcgtacaagctgtcgtccgccgccaccaaagccgatccctagccccaaggcgcccccgaagaaccccaagacggcgctaagaaagccaagggccgctgccaagaccaaagccttagacccccggcaagggcgaaacccggccccaaagccccaggcccggccccaaagcccaaaaggcgcttaatggaagcccaataacccccggccaagcccaaaggccaagcccagcctgccaagggggaaacccccaggaacccccggcgccttaagccgaaaccccctttcttaaaaaaagccggggcccccccgccccagggccggcggaaa

SEQ ID NO: 79784 - DNA, 897 bp, Zea mays
  misc_feature: Ceres CLONE 1564916
  misc_feature: Encodes the peptide sequence at SEQ ID NO. 79785
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (447)..(447): n is a, c, t, g, unknown, or other
  misc_feature (456)..(456): n is a, c, t, g, unknown, or other
  misc_feature (521)..(521): n is a, c, t, g, unknown, or other
nnnnnnnnnnnnccccaaaaaaaaaaannaaaaaaaannnnnnnnnnnnnnnnnnnnnnnnnnnnnnnnnnnnnnnnaaaaactggagctccccgcggtggcggccgctctagaactagtggatcccccgggctgcaggaattcgtctcacccctagaaaaagagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacggggattgcnacttgtccnttgggtgcggttgggaatatacctttgcttttcaaaaatcacaaatgaagagtgggggattgccnaattcttttaacagccctgccacctccttgggaattttggggaattagggaaaaccaaatttacccttttggggtatgggggaaattttcccaagggggggaaaaaaaatttgtggggaaattttcccggtacaacaggttttttttttttttttttttccccccccgtggggggggggccctttttccccccccccaaaaaaaaaaaggtgtgttaaaaaaaaaaaaaaaaaaggggggggggggggttttcccctccctcccccccctgggggggggacaaacaattaataccccctttttttttgggggggggggccctcctccctttgtttgggcccccccaacaaaaacactcttttttattaaacaaaac

SEQ ID NO: 79785 - protein, 133 aa, Zea mays
  misc_feature: Ceres CLONE 1564916
  misc_feature (94)..(94): Xaa is any aa, unknown, or other
  misc_feature (97)..(97): Xaa is any aa, unknown, or other
MGLGLGVRAAPFTYAAHALAVAAAAMVLVWSIQFRGGLAIESTNKNLIFNVHPVLMLIGYVIIGGEAIMVYRVLPTSNHDTTKLIHLILHGDCXLSXGCGWEYTFAFQKSQMKSGGLPNSFNSPATSLGILGN

SEQ ID NO: 79786 - DNA, 1092 bp, Zea mays
  misc_feature: Ceres CLONE 1564918
  misc_feature: Encodes the peptide sequence at SEQ ID NO. 79787
gggggtgtaggggagtgggaaatcatcatacaaaactaaaagcaagtacatgatcattttaaacagcccccttctaaactggagctccccgcggtggcggccgctctagaatagtggatcccccgggctgcaggaattcgtctcacccctagaaaaaacctccacagctagcatcgatccgccattgctcaccgcacaagtgcacgctcacctcacacacgcagctaaatagctaactccgtaggcgagaacaagaaaacgctcgacatggccgacgagaagaagcagggcctgcagctgctggacttctgggtgagcccattcgggcagcgctgccgcatcgcgctggacgacaagggcctggcctacgagtacctggagcaagacctggggaaaaagagcgagctgctcctccgcgccaacccggtgcacaagaagatccccgtgctgctgcacgacggccgccccgtctgcgagtccctcgtcatcgtgcagtaacctcaacgaaggcgttcccgggcggcggcgccggcggcttgttcccccgccgaacccctaactcgcgcgcggcatgccccgctttctggggcggaactaacgtccgaacaagaaagcttgtaccaacctggccgggacccccgggttgtgggaaaacctccaaaggggggaaacgggccaaggggcccaagggcccccccccccccaaaaaaatgggtcccaaaaaaattccctccccgcaacacaacttgggaaagggggctcgccgcgctcttggggggaaaagggtgggcccccttttcctttctgggggggtggggaaacccccccctgcgggaaattttcccttcataaaggttctcccccccccccatgggccccctttatagagggtgggggggaggtctcccctccgccccttataaataacagggtgtttcaaggggggggggtttataactctgtggggaaaaaaagggaagaggcccccccagaggcttgtggcgcccccatggggccccaaaaaccctttgtcacactaaaagacacaccaaagggtgtcgcccacaaaaaaaatcttataaaacccttccg

SEQ ID NO: 79787 - protein, 76 aa, Zea mays
  misc_feature: Ceres CLONE 1564918
  misc_feature (7)..(76): Pfam Name: GST_N Pfam Description: Glutathione S-transferase, N-terminal domain
  misc_feature: SWISSPROT Homolog: EC 4.4.1.5 Lactoylglutathione lyase
MADEKKQGLQLLDFWVSPFGQRCRIALDDKGLAYEYLEQDLGKKSELLLRANPVHKKIPVLLHDGRPVCESLVIVQ

SEQ ID NO: 79788 - DNA, 881 bp, Zea mays
  misc_feature: Ceres CLONE 1564920
  misc_feature: Encodes the peptide sequence at SEQ ID NO. 79789
  misc_feature (438)..(438): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (448)..(448): n is a, c, t, g, unknown, or other
  misc_feature (461)..(461): n is a, c, t, g, unknown, or other
  misc_feature (464)..(464): n is a, c, t, g, unknown, or other
  misc_feature (465)..(465): n is a, c, t, g, unknown, or other
  misc_feature (554)..(554): n is a, c, t, g, unknown, or other
  misc_feature (566)..(566): n is a, c, t, g, unknown, or other
  misc_feature (665)..(665): n is a, c, t, g, unknown, or other
ctccccgcggtggcggccgctctagaactagtggatcccccgggctgcaggaattcgtctcacccctagaaaaagactcagtggcacgggcgcggacgctgccgctcgcgatatttgcgagagagagagaagagagggcccgagagccgaggacgagtgcagtctggctggcgtgatgctgcttcggagcgcgtcctcgccgctgctcaactgcgggcgcgcgccggctgcggcggcgtcggtcgagcacctcgcggtggtttcgccgttgttgtcaccggcagtggcggcgcctaggcaggggccggtgctgtgccgcgccatgtccgagggggacctcgccgcgccgctcgtgcccaagaaggatgatggacacgggagggcgccgaggctatcggcgtccttgtcctcgtccgcctccatcttcgtcgaggaagncnnnaaaggncccaaggaagganganngaggaccctggtcgcggtcgcggtcgcggggggccgggcgtgggacgtgccccgctgcccgctgcgtcggggctgctgacgaacacggnggctgggacgtngtccgccgcccgccggcgccgggcgtttcgtgggagcaggggcgttcggcgggcagcggcggggggccggggaaagggcgtgcggcagcagcggcggcnaggggtggggggtccggggaaacggcctaccgttggcaagcacccgcgccggccacggaacgcccactaccgggcagatgatccgaggcggacccgggcaactcgctgcttctggtcaacttacgcaggttcctcaagggagtgggcgggggacgcaacaggggcccatggatactgcgagcgcgccatccttgccagtcccggggacccccgagg

SEQ ID NO: 79789 - protein, 122 aa, Zea mays
  misc_feature: Ceres CLONE 1564920
  misc_feature (88)..(88): Xaa is any aa, unknown, or other
  misc_feature (89)..(89): Xaa is any aa, unknown, or other
  misc_feature (96)..(96): Xaa is any aa, unknown, or other
  misc_feature (97)..(97): Xaa is any aa, unknown, or other
MLLRSASSPLLNCGRAPAAAASVEHLAVVSPLLSPAVAAPRQGPVLCRAMSEGDLAAPLVPKKDDGHGRAPRLSASLSSSASIFVEEXXKGPKEGXXRTLVAVAVAGGRAWDVPRCPLRRGC

SEQ ID NO: 79790 - DNA, 879 bp, Zea mays
  misc_feature: Ceres CLONE 1564921
  misc_feature: Encodes the peptide sequence at SEQ ID NO. 79791
gagctccccgcggtggcggccgctctagaactagtggatcccccgggctgcaggaattcgtctcacccctagaaaaaaaacacacccaggctcctcacctcaccaccgcggccgcctgcccaaagcagcccaccactcgggcgcagcaattcgtcgagcatccgccgcgctcgacggccaccggcccaccagggcaccatggcgtccgccacgcgtgctctgggggcgctcctccacagggcctcgtctctgtcttcctccgctcccgctctccggggagcctcgctcctccgcggggacgggcctattggaagcgccggactgttccggaggcatgcggcgaggcggcggatttcgtcgttccagccgctctgcatgggaagacgctcctgcaaaacccccccaaggaaggatgcccagaacttgaagaagatgaagcgcaacagcaaaattggaaaagaaattgttgcggccatcaagaagggtggcccaaacccttcatccaacacaactttatcagctatactagagaaagcaagggaacttgatgtccctagagaaattttggagcgcaacatcaaaagggcatcagaaaagggacaagatacttacacagaaaaggtttatgaggtctatggttttggtggagtgggtatggtcgttgaagttctaactgacaaaattacaagatcagttgctgacaataagaaacgtggtggaagactgccgagcaaaaatggcttgatccgtgatctgttacctttaaaatcagaccagcctcgagtgtggaacataaaagtttactgaattcaaataaggaaccacttgctccccgtttgcgttaaaatgctggggcttaataacaatctttgaaacaaa

SEQ ID NO: 79791 - protein, 202 aa, Zea mays
  misc_feature: Ceres CLONE 1564921
  misc_feature (62)..(200): Pfam Name: DUF28 Pfam Description: Domain of unknown function DUF28
MASATRALGALLHRASSLSSSAPALRGASLLRGDGPIGSAGLFRRHAARRRISSFQPLCMGRRSCKTPPRKDAQNLKKMKRNSKIGKEIVAAIKKGGPNPSSNTTLSAILEKARELDVPREILERNIKRASEKGQDTYTEKVYEVYGFGGVGMVVEVLTDKITRSVADNKKRGGRLPSKNGLIRDLLPLKSDQPRVWNIKVY

SEQ ID NO: 79792 - DNA, 808 bp, Zea mays
  misc_feature: Ceres CLONE 1564926
  misc_feature: Translation starting site: 198
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (734)..(734): n is a, c, t, g, unknown, or other
  misc_feature (735)..(735): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (756)..(756): n is a, c, t, g, unknown, or other
  misc_feature (757)..(757): n is a, c, t, g, unknown, or other
  misc_feature (775)..(775): n is a, c, t, g, unknown, or other
  misc_feature (777)..(777): n is a, c, t, g, unknown, or other
ctccccgcggtggcggccgctctagaactagtggatcccccgggctgcaggaattcgtctcacccctagaaaaaaggatagagaagagatacacgcagaccagtagcaagccaagcagcgcccacgcccccacgagggccacgaccaccaccacccccgccgccgccgcggcaaactgctactgcccaaccgcgggaatggaggtggacgccactgccttctgcccgccgccccagcccgcgcctgccgcctccccggcttcaaagccgcctgcgccggtgctgggcgccggtggagcggtcgcgccggtggcagggcacggccgcggcggagggaggcagtaccgcggcgtccggatgcgcaagtggggcaagtggggtggcggagatccgcgagtcgaacaagcggtcgcggatctggctcgggtcctactccaccgccgtcggccgccgcgtgcgcctacgacacggcagtcttcttgcctcgcgggcgctccgcggcgggtcaacttccccgaacaactcgaccggggccgggcgtggcccgaacaacccccgaggggcacaaagggaacggcccggggggtttaaaaagccggccccccattcccaaaaaaaaaggcgggccccaaaaagtgttttttccccccccccccccaaaaaaaacatccccccccctgggggggggggggggggggggggggnnnnnnnnnnnnnntnnnnnnnannnaaagnngnnnnnnnnnnnnnannnggnngggggggggggggggggngnaagggaaaacaacttatcagtcatcttcttt

SEQ ID NO: 79793 - DNA, 792 bp, Zea mays
  misc_feature: Ceres CLONE 1564927
  misc_feature: Encodes the peptide sequence at SEQ ID NO. 79794
ctcaccgcggtggcggccgctctagaactagtggatcccccgggctgcaggaattcgtctcacccctagaaaaactgacacactccaccaccagggccaccacctcctactccgccccggcccctctgatccggacggagcgccggccatggcgctcgccttcgacgagttcgggcgccccttcattatcctgcgggagcgggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcgaaggtagcttttgaccacttagaacatatatccgaaaagtttgagttcagtgcagacaacattgaacccctggtccagacctgcatgacaactctatcctcaaagattgttaaccgttgcaagcgggcgttggcagagattgctgtcaaagcagtacttgcggttgcagatttggagacgaaagatgttaacttggatctaattaaagtagaaggccagggttggtcgggaaa

SEQ ID NO: 79794 - protein, 214 aa, Zea mays
  misc_feature: Ceres CLONE 1564927
MALAFDEFGRPFIILREREKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDHLEHISEKFEFSADNIEPLVQTCMTTLSSKIVNRCKRALAEIAVKAVLAVADLETKDVNLDLIKVEGQGWSG

SEQ ID NO: 79795 - DNA, 878 bp, Zea mays
  misc_feature: Ceres CLONE 1564932
  misc_feature: Translation starting site: 137
ccgctctagaactagtggatcccccgggctgcaggaattcgtctcacccctagaaaaaatccccgccccgggcaccgcgagctagctagctactgacacccggcgccggcgccgagtacaatacaaggaaagcagcatggtgttcgagcagcatgaggaggaggcggtggcgccgggcgcggtgcacgggcaccggctctccacggtggtgccgagctcggtgacgggggaggtggactacgcgctggcggacgcggacctggccttcaagctgcactacctgcgcggggtgtactactaccggtccggggacggcctcgccaccaaggtgctcaaggaccccatgttcccgtggctggacgaccacttccccgtggccggccgcgtccgccgcgccgaggcggaggggggacggcgcgccgcgccggccctacatcaagtgcaacgactgcggcgtgcgcatcgtggaagccaggtgcgaccgcgacatggccgagtggaatcgcgacgccccgccccggcaggatcaggcagctctgctaccacaagggtgctcggccccgagctcttctttctcccgctggtctacgtccagaatacaaacttcaaattccggggggctggccctgggtttcaactgggcccaccctttttggggaaatccccgttgggccgcccccttggtttaaaaaagtggggggcccaaaaccctccaccgggaaaaaaaaccggggaaaccccctgttttttcccccccgcaaaaaaaacatccccctgttgggggtaaaattttctccccgcggggggccccccctcttctttataaaaagagagggggggcccccctagaaaggaaaacacactttgttggggtgccc

SEQ ID NO: 79796 - DNA, 838 bp, Zea mays
  misc_feature: Ceres CLONE 1564933
  misc_feature: Translation starting site: 350
ctccccgcggtggcggccgctctagaactagtggatcccccgggctgcaggaattcgtctcacccctagaaaaattcccacaccctgcaccgcgtccgcctccactggggtataggggtttctacgggttttcgaggaagatgaaatggcgtctgatgaggtgctcgaggactgtgaagtggttcaacggaaccaagggcttcacgtttcatctcccccgacgacggtcgcgaggacctattcctccaccactcctccatcaagtccaaccgctaccgcagtcttaacgaccgcgatgccgtccaatacaccgtccgcagcggcaaccacggccgcgccaaggccctcgatgtcaccgcgcccggcggcggcccgcttgccggcggggaacgtcccgacggcggcaacggcggtgggcgaggcgagatacggcggcagcgaccgctgttaccgcggcggcgggacccgcggctacgtgcgaggaggcgcaccgtaggcacgcgcggcggcgaccgtgacttacggcggaggtggcgacctcggactacggccgcgaccgtgtctacggcggacgcgctctgctatggcggatcgctacggtcgaggccacggtcgaggcggcccgcgtctgcttcaactgggggcacgacggccacatggcaacgcgactgctctcagcgccgctggctacggacgctgcatgcccttgctgacccgtcagagaccgctagggatcacgacatcagcccatatctgtcgcgactgcatccgaccaagcattaggcgtggtgccacattctcaagggatccatgggactcccatttcacctcctctccc

SEQ ID NO: 79797 - DNA, 923 bp, Zea mays
  misc_feature: Ceres CLONE 1564934
  misc_feature: Encodes the peptide sequence at SEQ ID NO. 79798
  misc_feature (400)..(400): n is a, c, t, g, unknown, or other
  misc_feature (467)..(467): n is a, c, t, g, unknown, or other
ccccgcggtggcggccgctctagactagtggatcccccgggctgcaggaattcgtctcacccctagaaaaaacaccgagcagcaagcaccaccaccgcccgggcggccactccacttcctcccctgctgcactgacgcgcccagcgccaaagcatcctttcacctcaaagataaggaggccgtaacctgtcggggccctcccccaatctccagcgacgccgtccccccaactcgccacccatggccatgtcgttccacttccacccgctggccgcctcgcgcgtccacttctccccactcccgttcgccgccgctgccgcgggggtgccctccccctcctcctccgtcgccatcgcggcgcaccaccaccaccaccagcacggtcgccgccgcttctccnccatcgtggccacggcggccgccgcgtcggcggcgaccacggagttcgacttcaaggcgtacatggnggagcgcgcggtcgcggtgaaccgggcctctggacgcggccgtccccggccggggagccccccgcggcgctgcacgacgacctcccctgcatggacgacgaccaacctccgccgcggcaagcccaccctgcccacgtcgtctaagggggagcccattgcccgtcctcgcccggggaacgcgctggttcttggttttcctttcaccaaaatggccaagcgtcggggtccctaccctccggaaagtggaccccggaaaaacaccccccgccccgcgttttccgaaaccatttggggaaaccccccccgccttactccgaatacccaagggaaaccctccccccgcggcccggtttgtcaaatttctaaaaaggaagggggccccataaaaaaaagggggcgccctctctaaacccctccggaaaaatatcccccccttccaagaaagagcccgccgtt

SEQ ID NO: 79798 - protein, 211 aa, Zea mays
  misc_feature: Ceres CLONE 1564934
  misc_feature (54)..(54): Xaa is any aa, unknown, or other
  misc_feature (76)..(76): Xaa is any aa, unknown, or other
MAMSFHFHPLAASRVHFSPLPFAAAAAGVPSPSSSVAIAAHHHHHQHGRRRFSXIVATAAAASAATTEFDFKAYMXERAVAVNRASGRGRPRPGSPPRRCTTTSPAWTTTNLRRGKPTLPTSSKGEPIARPRPGNALVLGFPFTKMAKRRGPYPPESGPRKNTPRPAFSETIWGNPPRLTPNTQGKPSPRGPVCQISKKEGGPIKKRGRPL

SEQ ID NO: 79799 - DNA, 893 bp, Zea mays
  misc_feature: Ceres CLONE 1564936
  misc_feature: Encodes the peptide sequence at SEQ ID NO. 79800
ccgcggtggcggccgctctagaactagtggatcccccgggctgcaggaattcgtctcacccctagaaaaagcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaggttcaacttccccgagaacggcgtcgagctctacgccgagaaggtcgtcaaccgcggcctctgcgccatcgcgcaggctgagtccctccgctacaagctcctcggaggccttgccgtccggagggcctgctatggtgttcttcgctttgttatggagagtggtgccaagggttgtgaggtcattgtggagtggaaagctcagggctcaaaagagcaattccatgaaaattcaaggatggctacatgatctcatctgggtcagccagtgaatgagtacatccgactcggctgttgagacacgtccctcctcagacaagggtgttcctggggtatccaaggtggaaggatcatgtcttggactggggaccccgaaagggcaaagggttgggccccgaattcccccccttcttccgggaacctggggtgacacattccaatacccccggaaagggagaggaggaaataagcctgtgcgcccctttcctggttcttgtgg

SEQ ID NO: 79800 - protein, 157 aa, Zea mays
  misc_feature: Ceres CLONE 1564936
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVEWKAQGSKEQFHENSRMAT

SEQ ID NO: 79801 - DNA, 837 bp, Zea mays
  misc_feature: Ceres CLONE 1564938
  misc_feature: Encodes the peptide sequence at SEQ ID NO. 79802
ccgcggtggcggccgctctagaactagtggatcccccgggctgcaggaattcgtctcacccctagaaaaaacagtctggggataataatccacactccacaagcagccatggcgccacccatcacgtccctgtcgtctctgatggcgtccagcccaatcccgacgccgccgccgctcccgaagaccagcggaagagcgctctccgtcgcgccctgcggctccgcgtcgtcctcgtcgccgtccacttcctcgactcctcatccggtggcggcgtcggcgtcggcgggcaggagggggctgctggcgctgggcgccgggttcctggcctcggccgcgctgctgtccccggcgggcgacgccggcgccacgcgcatcgagtactacgcgacggtcggggacaagatgtgcgacctgagcctcgtcaagtccgggctcgcgtactgcgacgtcgaggtcggcaccggcgtccagcccccgcgcggcgagctcatcaatgtgcactacaccgcgagatttcccgacggtacgctgttcgacagcagctacaagcgcggggaggccactgaccatgcccataggccccagggcaaaaccctccgaagggcttgaacaggggaaccagggggcggggggcgggggtggcccccccaaccttttgttggggggaaaaccccaaacctgaaaaaaacccgggggtccacgtgggggtaagggggcctgaaaaccggggggggggtttcttttctttgggggaaaaggggaaaaatttcccccgggggaaaaacccccccccctctttatataaagaaccttttttccctcccgcgggggggaaat

SEQ ID NO: 79802 - protein, 166 aa, Zea mays
  misc_feature: Ceres CLONE 1564938
  misc_feature: SWISSPROT Homolog: EC 5.2.1.8 Peptidylprolyl isomerase
MAPPITSLSSLMASSPIPTPPPLPKTSGRALSVAPCGSASSSSPSTSSTPHPVAASASAGRRGLLALGAGFLASAALLSPAGDAGATRIEYYATVGDKMCDLSLVKSGLAYCDVEVGTGVQPPRGELINVHYTARFPDGTLFDSSYKRGEATDHAHRPQGKTLRRA

SEQ ID NO: 79803 - DNA, 896 bp, Zea mays
  misc_feature: Ceres CLONE 1564939
  misc_feature: Encodes the peptide sequence at SEQ ID NO. 79804
  misc_feature (1)..(1): n is a, c, t, g, unknown, or other
  misc_feature (73)..(73): n is a, c, t, g, unknown, or other
ntttcggctccctcctcttaaaagcaaataaaggaatgcgttttaaattcaattacgccccggttagataaantgtaaaagctggagctcaccccggtggcggccgctctagaatagtggatcccccgggctgcaggaattcgtctcacccctagaaaaaagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccagcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcagagggcgggctggactacctggggaaccccaacctggtgcacgcacagagcatcctggccatctgggcgtgccaggtggtgctcatgggcttcgtcaagggctaccacgtcgagcggcggcccgctcggggaaggggctcgacaaggtgttaccccgggcggcacctttctacccgctggggcctcgcccggacgacccgggacacccgcccgccaaagcctcaagggtgtaaaggagcttcaaagaaaccggcccgca

SEQ ID NO: 79804 - protein, 220 aa, Zea mays
  misc_feature: Ceres CLONE 1564939
  misc_feature (59)..(199): Pfam Name: Chloroa_b-bind Pfam Description: Chlorophyll A-B binding protein
MAASALHQTTSFLGQALVSRAASVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVKGYHVERRPARGRGSTRCYPGRHLSTRWGLARTTRDTRPPKPQGCKGASKKPAR

SEQ ID NO: 79805 - DNA, 1000 bp, Zea mays
  misc_feature: Ceres CLONE 1564941
  misc_feature: Encodes the peptide sequence at SEQ ID NO. 79806
aacacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatacttgtatgcgtgtaccgtagacatacgtattcgtatatgtactgcaggagatgtaccagtatttgtgaagaagggagcatgggctcagagattgtatcaaaaaaaaaaaaaaa

SEQ ID NO: 79806 - protein, 264 aa, Zea mays
  misc_feature: Ceres CLONE 1564941
  misc_feature (63)..(231): Pfam Name: Chloroa_b-bind Pfam Description: Chlorophyll A-B binding protein
MAAATMALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKEIKNGRLAMFSMFGFFVQAIVTGKGPVENLADHLADPVNNNAWAYATNFVPGK

SEQ ID NO: 79807 - DNA, 886 bp, Zea mays
  misc_feature: Ceres CLONE 1564942
  misc_feature: Encodes the peptide sequence at SEQ ID NO. 79808
  misc_feature (393)..(393): n is a, c, t, g, unknown, or other
ccgcggtggcggccgctctagaactagtggatcccccgggctgcaggaattcgtctcacccctagaaaaacccacttccgcccaaatccaccaccgccataccagcgtgtccgcgattccgtcgagtagactgggcgagagagtagtctcggacgagaagaggcgaatatgagttccggcggcggcaggggcaagcccaaggggtccaaggctgtgtcgcggtcgaccaaggccgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaanaagaaccgcatcgtgccgcgtcacatccagctcgccgtgcgcaacgacgaggaactcagcaagctgctcggagctgtcaccatcgccgccgggagtgtgttgcccaacattcatcagacgctgctgcccaaaagggccgtgggaagggaaagcccacatcggttccgcatcccaggagttctaagccggccccgccgcggttgccaggtttctctgactttgttcaactgggagctccaactgcctggaagcccccccgtccccccaagttccctcaattagaagggttaaggggggttttccacctttgggtagggtttagggtttgcccaaaggaggggtttcccaaaaaaaaattttggggaaccaggggcttcccttatgttaccaaccacccctgcgggaaaagggaaaaaaatttgtggtgttgaaaaagacgcccaccttttttcccggggattttggggggggagagccgccccccccccccccg

SEQ ID NO: 79808 - protein, 168 aa, Zea mays
  misc_feature: Ceres CLONE 1564942
  misc_feature (18)..(91): Pfam Name: Histone Pfam Description: Core histone H2A/H2B/H3/H4
  misc_feature (75)..(75): Xaa is any aa, unknown, or other
MSSGGGRGKPKGSKAVSRSTKAGLQFPVGRIARYLKAGKYAERVGGGAPVYLSAVLEYLAAEVLELAGNAARDNXKNRIVPRHIQLAVRNDEELSKLLGAVTIAAGSVLPNIHQTLLPKRAVGRESPHRFRIPGVLSRPRRGCQVSLTLFNWELQLPGSPPVPPSSLN

SEQ ID NO: 79809 - DNA, 1105 bp, Zea mays
  misc_feature: Ceres CLONE 1564947
  misc_feature: Encodes the peptide sequence at SEQ ID NO. 79810
aaattaatccgaaaaaataacctcccccattaaacaagaattttatgatacacaacaaccctaaataaaaaaaactggagctccccgcggtggcggccgctctagaactagtggatcccccgggctgcaggaattcgtctcacccctagaaaaatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccgacactcccatgccgacctccctctcccaactcctagacgccgctccagccggcggcggcacgaccgtcaacgtcagctggggcggtgtccacgtcgatgctgggcacggtaagcccgggggttacgacggttgacccacgcaagggcggcgtcggcgtcaacgttaaccctggcaagaacggcaagcccggcggcacaaccgttggcgttccggaaagggctggaatccggcgttaaactttaaaccccgggctacacgaaaagccccggcgggcccccacccgtttgggcgttcggggaaagggttgggccgtttggcggtttaaaacgtccaaccccccgggtaaaaaccacgggtggggccaaaaaacattgatccggtccggttcgtgcctaataggggcaccggaaaaatgtggggtcatattcaaaaccgcatctataattctccccggggcaaaaaacaccgggcccccggggggggggtgccccggggtaacacaaaaccacccttgggccggtttgtgggcaaaaaagagccagacaccttgtgggccattaggtccccttcaaaaacccctgggggcaacaggtgctaaaactcggggcgcggaacccccacggattctggggtttttgccaaaagggcccggggtttttgcctcccccacccggaaaccccccggaaaaaaaaagcccgcctccacaattaaacgacctttcccttttactccaaacattagaacccactgtcccgaaaacaatcg

SEQ ID NO: 79810 - protein, 78 aa, Zea mays
  misc_feature: Ceres CLONE 1564947
MERLIAGLLGFLLVASVGSHAARAPDQYWKSALPDTPMPTSLSQLLDAAPAGGGTTVNVSWGGVHVDAGHGKPGGYDG

SEQ ID NO: 79811 - DNA, 798 bp, Zea mays
  misc_feature: Ceres CLONE 1564948
  misc_feature: Encodes the peptide sequence at SEQ ID NO. 79812
ctccccgcggtggcggccgctctagaactagtggatcccccgggctgcaggaattcgtctcacccctagaaaaaaccagtgtcgagctccccacgcccaccgctactcctagcccctctcctccctggatttcgcccagtctccatctctctttctagccatggacggcgacctctcctgcctacagcaggtcagcgccccatctcctcaacatctcggctccctgtcccatctctctcacgagccactcttctcgttcttcatggcgtcgacatggggctcgcccctgcaacctcgcctcgctgggtttcctcagggcgccgggatgctgcttcctatacatcgtgcgactccctggtgcttgctctcgccctagtccatggagcagtagcagccacgacactccttcgtgtcgcgccctcgacgtgttcgatgaaatactgcagcgagctccaactcgatctgcacagcccctgcgcgatgtcacaaactccgctcgttgtcgatgtcgtgcttcgggcatcgcgtgttcgacgaaaatcccaagtccatggacagcacatgcacaactcaaatccgatcggccaggtacgttaattgatcacgtgctatggaagacgagtggaattgatctccaagtgatgctgatggacgaagctaaaatggatgaaatcaccaagtgtcaggatggaagatactttaccagtggtcgtcaattacacccctacatagtgttatcccaagttataatttttgtctggtggggatgctgcttaatggcggtgggcctcgccttct

SEQ ID NO: 79812 - protein, 31 aa, Zea mays
  misc_feature: Ceres CLONE 1564948
MSCFGHRVFDENPKSMDSTCTTQIRSARYVN

SEQ ID NO: 79813 - DNA, 837 bp, Zea mays
  misc_feature: Ceres CLONE 1564949
  misc_feature: Encodes the peptide sequence at SEQ ID NO. 79814
ctccccgcggtggcggccgctctagaactagtggatcccccgggctgcaggaattcgtctcacccctagaaaaaccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctactgtggcggcggcggctacagtggtggtggcggcggctacagcggtggcaacccgtggcggcggctacggcaactccgacaggaactggaggaactgagcggtggggcccgcgcggccaagttatcctgttcgctaccgtgatgtttaccctagtccagagggtttatcttcgttcgtggcgtgtttgttgtttgccctctgtgtttttgattgcaaggtccctcctgtgtcaatggttagtggccgtgttcttccctcggttttcggcgaacccgtccatcaaacagcaa

SEQ ID NO: 79814 - protein, 170 aa, Zea mays
  misc_feature: Ceres CLONE 1564949
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYCGGGGYSGGGGGYSGGNPWRRLRQLRQELEELSGGARAAKLSCSLP

SEQ ID NO: 79815 - DNA, 770 bp, Zea mays
  misc_feature: Ceres CLONE 1564952
  misc_feature: Encodes the peptide sequence at SEQ ID NO. 79816
gcggtggcggccgctctagaactagtggatcccccgggctgcaggaattcgtctcacccctagaaaaatgtacctcgcccgaaatcgccgagagcctcccctcagtttacgccgcacgaaccgacgcactagaccgacccgcgaatcccccgcgcgcgcgccgtgcggtcaccgtccgaggccacggcaccgccggcccccgcccccgccccggccgccaagagcaaaggcaaggccgacgcttcctcctcgtcgtcctcctcctccactccaccgaggtcgcgccgcgcgcttgccgtcgtgatggccgcgtcgctgctcgtgctcgccgtggcgttcttggttggctctggctccggggggatcgatgggggcgcagcggctcccgtcgaggtggaaggcaccgaggtggcccacagggagtgggatccagctgatgccccaaaaagaacaagccaccgtctgcactcgcacgatgtgcccctacgggttcagggcagcggtcagcagtcctgtcccccggggttttcctggaagggaatgactccaaaaagctaccgggatcataaagggcccccccccaaattcctccccccctcaaacaagggggggagcccctcccaaaacggggggggggccaccccggggggggaaccccctttagatatagggcccggggggggggttttaaaaagaaacagtgggggcgagtctttaaccggggtgtttggggggagaccccctgaggggaggtagcgcgtgttttcccc

SEQ ID NO: 79816 - protein, 150 aa, Zea mays
  misc_feature: Ceres CLONE 1564952
  misc_feature: SWISSPROT Homolog: EC 2.7.11.25 Mitogen-activated protein kinase kinase kinase
MAASLLVLAVAFLVGSGSGGIDGGAAAPVEVEGTEVAHREWDPADAPKRTSHRLHSHDVPLRVQGSGQQSCPPGFSWKGMTPKSYRDHKGPPPKFLPPSNKGGSPSQNGGGATPGGEPPLDIGPGGGVLKRNSGGESLTGVFGGRPPEGR

SEQ ID NO: 79817 - DNA, 874 bp, Zea mays
  misc_feature: Ceres CLONE 1564954
  misc_feature: Encodes the peptide sequence at SEQ ID NO. 79818
ctccccgcggtggcggccgctctagaactagtggatcccccgggctgcaggaattcgtctcacccctagaaaaaagcgcgagtggtggcacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaaggtcgactacctgctcggcaggcagggcatagggcggcaagaccgactcccaagggcgggttccgagaccggcgcccgtggaccaccggcaacgttcttgaaaagcttcccccccccctggatccgacgggcaagcaggtacctaccgcccgtgggccggtgccccccccaaggacggggggaacgggcataccaaggggcgggacaagcaaccaagccttctttctggagtgccccccgttctctcccgagaaggtttaataa

SEQ ID NO: 79818 - protein, 243 aa, Zea mays
  misc_feature: Ceres CLONE 1564954
  misc_feature (57)..(244): Pfam Name: PsbP Pfam Description: PsbP
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQGRLPARQAGHRAARPTPKGGFRDRRPWTTGNVLEKLPPPLDPTGKQVPTARGPVPPPRTGGTGIPRGGTSNQAFFLECPPFSPEKV

SEQ ID NO: 79819 - DNA, 780 bp, Zea mays
  misc_feature: Ceres CLONE 1564955
  misc_feature: Encodes the peptide sequence at SEQ ID NO. 79820
  misc_feature (381)..(381): n is a, c, t, g, unknown, or other
  misc_feature (480)..(480): n is a, c, t, g, unknown, or other
ccccgcggtggcggccgctctaaactagtggatcccccgggctgcaggaattcgtctccccctagaaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctgggactccttactaagatgaattaagtcttcccgcggtgcgtcgaagctggcgctgagtttctatgccgccgctggacgagacgtctctgcggctgtagcctcagattccctggtaaggctgttggtgtaatctgccntgcgggatcagctcctgcggcagctgctcctgcggatgaggctgagggatgatgatgacccttgatcttttttgggggatgaacctgaggaaggacaangaaggcccctttaaataaccgtggcttgccccctgccaaggggcccttttctaaaaaagaaagaaaggggggaaaacccccccggcccccttttggagggtaaaaaaccctgggggccccatgaaacctttaattttaaaaaaaccctggggggaaagggctttccccccccgggtccccaaaaaaggaaggggctttcaacttttggggaaaaatcaaaaaacatttgtgcccccctttgggaaaaccgccccccccaaaaaaaaaaaccacttttcttgttaagaaaattgtgtcccc

SEQ ID NO: 79820 - protein, 31 aa, Zea mays
  misc_feature: Ceres CLONE 1564955
MAVFSDLHTADGLKSLEAHLAGKTYVSGTPY

SEQ ID NO: 79821 - DNA, 941 bp, Zea mays
  misc_feature: Ceres CLONE 1564957
  misc_feature: Translation starting site: 421
ccccgcggtggcggccgctctagaacctagtggatcccccgggctgcaggaattcgtctcacccctagaaaaaagtcggcagagcagagaacgcaggcagaggcaccataccagtcaaccaccgcttcgttctcctcccacaccgctcgccttcgcctccccatcttctatcatccccgagctccagttctccacacctcacgtctataaataataaataaggcgcccgcccatcaattcgtgtcaccgcgtcccgagagcgcaaatcattccgcgcgacgcaaaaaccctagcctagccaccgatccctctcatggcaaccaccaccacccaggcgagcctcctcctccagaagcagctaagagatctcgcgaagcaccccgtggatgggttccccccctgggctgttcgacgacagcaatgtcttcgagtggcagggtcaccatcatcgggaaccgcctgacacccttatatgatgggaaggttacttccaatgccaaaaaggagcctttcccccaaaattaccccaaaacagcccggcccttttagtcaaaaatttaccctctggaaaatggtgggaattccaaaaatggtctatatccctgaaaagggggcaggggttttggaaacctccaaaattcggctccagaccccccccgggggggaaaaaatctcaaaaaggggttttttgagggttcccccaaaggtgggggccggggggggacacccggggtggcccccccggttagaaaaagacctatagttttcttggggagctttttatttaccagggggctctcttaggggccccaaagggggaggaggtgcccccacaaaaaaatttatgtgggggcgccctttagaaaagtgggggggggacaacagaggggggggggttttttccaaaaaaaaagagggggtggcgcccccctcggggggaa

SEQ ID NO: 79822 - DNA, 861 bp, Zea mays
  misc_feature: Ceres CLONE 1564964
  misc_feature: Encodes the peptide sequence at SEQ ID NO. 79823
ctccccgcggtggcggccgctctagaactagtggatcccccgggctgcaggaattcgtctcacccctagaaaaacacatgttctcgtgaaggcaaaacaacacagcgcgagcaacagcagcgaggtttaccccaattccccatttcccgtagcacggcagacgcgctcccttctgatttctgaatccccgacgccatggcctccgcaccgacgccgccgcccctcctcccggtgaccaaccctgcgtccggatcgtccccggccgccgccggaggctccgatgcgccgatcgctacgccggctttccggctcttcctgagccggatctccgactcggcgcggcgctcgctgtcggatcgccggccgtggggagagctcctcgaccgttcggcgttctcgaagccagactctctctccgacgccacctcccgcctgcgtcgcaacctcgcttacttcccgcgtcactacgccgccgtggtcggcttcgcgctgggggcctcgctcctggcgcaccccttctcgctcctcatcctcctgggcctccttcgcgcctgttgcttcctcaacctcttcggccctccgacagcctgttgtcttcttcggcggaactttttccgaccgaaaaaccttgttgggttcgtcggggcctcctttaatccgggtttttttcaccccgggggggggcctaataattccggggttgttttttggggggggcccttttcggggggcaagggggggttccggggggccgagaggaacctttttctgaaaagaaccaaaagggcccccccgggaacacgggggggcccaggggggtggttttttttttcttggggaaaaccccaaatatgggggtgc

SEQ ID NO: 79823 - protein, 222 aa, Zea mays
  misc_feature: Ceres CLONE 1564964
  misc_feature (47)..(201): Pfam Name: PRA1 Pfam Description: PRA1 family protein
MASAPTPPPLLPVTNPASGSSPAAAGGSDAPIATPAFRLFLSRISDSARRSLSDRRPWGELLDRSAFSKPDSLSDATSRLRRNLAYFPRHYAAVVGFALGASLLAHPFSLLILLGLLRACCFLNLFGPPTACCLLRRNFFRPKNLVGFVGASFNPGFFHPGGGPNNSGVVFWGGPFSGGKGGFRGAERNLFLKRTKRAPPGTRGGPGGWFFFSWGKPQIWGC

SEQ ID NO: 79824 - DNA, 855 bp, Zea mays
  misc_feature: Ceres CLONE 1564966
  misc_feature: Encodes the peptide sequence at SEQ ID NO. 79825
ctccccgcggtggcggccgctctagaactagtggatcccccgggctgcaggaattcgtctcacccctagaaaaaatccgcatccgctgcctccgcctctcgagtctcgtccacccgtcgtcctcctagctcctctactcgccagtcgccatgggcaagattaagatcggaatcaacggcttctgaaggatcggcaggctcatggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccgagacccttctcttcggtgacaagccggtcaccgtctttggcaacaccaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgttttcaatgctagctgcaccacaaactgccttgctccccttgctaaggtcattcatgacaacttcggcattgttgagggtttgatgacaactgttcatgccatcactgccaccccgaaaaactgtttgacggacccttcagccaagggaactggaaagggtggccagggccctgccaagctttttaacatcaattgcccaaagccgacaccggggggctgtccaaaaggtgtgtgtttgggaataagattccttatcccgg

SEQ ID NO: 79825 - protein, 218 aa, Zea mays
  misc_feature: Ceres CLONE 1564966
  misc_feature (2)..(137): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MARVALQSEDVELVAVNDPFITTDYMTYMFKYDTVHGHWKHSDITLKDSETLLFGDKPVTVFGNTNPEEIPWGEAGAEYVVESTGVFTDKDKAAAHLKGGAKKVVISAPSKDAPMFVVGVNEDKYTSDVNIVFNASCTTNCLAPLAKVIHDNFGIVEGLMTTVHAITATPKNCLTDPSAKGTGKGGQGPAKLFNINCPKPTPGGCPKGVCLGIRFLIP

SEQ ID NO: 79826 - DNA, 773 bp, Zea mays
  misc_feature: Ceres CLONE 1564967
  misc_feature: Encodes the peptide sequence at SEQ ID NO. 79827
  misc_feature (474)..(474): n is a, c, t, g, unknown, or other
ccccgcggtggcggccgctctagaactagtggatcccccgggctgcaggaattcgtctcacccctagaaaaaactcgccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaaggagaggcttctgaangagggcccaagctgagaatgaaggaaaaactgttgagtcaaagaaaccaattggttgggaagaagggccttaacccctgggaactttcctctttggacaaaaaaaaggccccccttgtgtgtccccccccccaggaacggggggaccccaattaaaaccggggtttgggggggttttccccccccttttttccaaaaaaaaaaaggaggggcccccccctcctccgcggttttgtgtaaaaaaaaaaagagaagggcccccccccgcggggaaaaaaaatgtttttttcccaaaaaaaa

SEQ ID NO: 79827 - protein, 160 aa, Zea mays
  misc_feature: Ceres CLONE 1564967
  misc_feature (110)..(110): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKGEASEXGPKLRMKEKLLSQRNQLVGKKGLNPWELSSLDKKKAPLVCPPPQERGDPN

SEQ ID NO: 79828 - DNA, 698 bp, Zea mays
  misc_feature: Ceres CLONE 1564968
  misc_feature: Encodes the peptide sequence at SEQ ID NO. 79829
  misc_feature (271)..(271): n is a, c, t, g, unknown, or other
  misc_feature (305)..(305): n is a, c, t, g, unknown, or other
  misc_feature (318)..(318): n is a, c, t, g, unknown, or other
  misc_feature (630)..(630): n is a, c, t, g, unknown, or other
  misc_feature (631)..(631): n is a, c, t, g, unknown, or other
ctccccgcggtggcggccgctctagaactagtggatcccccgggctgcaggaattcgtctcacccctagaaaaatctcctccgtccgtccgcccccgtgacgcgagcgtcgccagggagccgaaagtaagcctcagttccgccggcgtgcgaggggttcgatctgggttagcctctcacgatgccgccagcccccaagtccggcgacgccctcttcgccagcgtggatcgcgtcaatgcggagctgttcacgctcacgtacggcgccatangtgcggcagctgctcacggatctggaggaggtcngaggaggtcaacnaagcagctcgatcaaatggggtttacaacattgtggaacacgaatgggtcgatgaagttcttagcaaagtcaaatgtattcaagggtgtgttgacttccaaggaaactgcccgatggtaattgccaaaccttggcttccaaaattgtccttggggggggaaccgcaaacttggaaccaattggggaagttttgagggggaaaaaattttgcaacaatttttccccccaaaaaaaaaaccccccccctggggggaaaattttgtggggaaaacccccccgggaaaaaatttttgcaaaaggggggccctcccnnaaaattttggcgcaaatttttttttttttaaggggggggggggtgttttttttttgtgggggggggg

SEQ ID NO: 79829 - protein, 85 aa, Zea mays
  misc_feature: Ceres CLONE 1564968
  misc_feature (31)..(31): Xaa is any aa, unknown, or other
  misc_feature (42)..(42): Xaa is any aa, unknown, or other
MPPAPKSGDALFASVDRVNAELFTLTYGAIXAAAAHGSGGGXRRSTKQLDQMGFTTLWNTNGSMKFLAKSNVFKGVLTSKETARW

SEQ ID NO: 79830 - DNA, 785 bp, Zea mays
  misc_feature: Ceres CLONE 1564972
  misc_feature: Encodes the peptide sequence at SEQ ID NO. 79831
ctccccgcggtggcggccgctctagaactagtggatcccccgggctgcaggaattcgtctcacccctagaaaaaacctatccgccgcctcccaatcatcctgcccccaaactcccaccccgcagcatccccacgccaccacacctcgtcgcgtcgcgtcgtcaccggcgtgaagatggtcgggccaggcctctacaccgagatcggcaagaagaccagggatctgctgtacaaggactaccagactgaccacaagttcaccctcactacctacacctccaatggcgtcgctgtaactgcttctagcacaaagaaagctgacctgatccttggcgagatccaatcacagataaagaacaagaacatgaccatagatgtgaaagcaaactcggagtcaaatatcattacgacaattactgttgatgagattgcaacaccagggctgaagaccatcttaagctttgctgttcctgatcagagatctggaaaggttgagctccagtatttgcatgattatgctgggagtaatgcaagcatcggtctgacagccaatcctgtagtcaacctctctgctgcctttggtactaaagctgttgcagttggtgccgatatctcacctgaaactgcaactgggaaactgactaaatccaaggctgcactgaaggttcatcatggaagaccttgtcgccatccctggaacctgaaaaaacaaggagagaaagcctttccgggagacctacctttcccaagggggagggaaattgacccaacacagcctggtggggg

SEQ ID NO: 79831 - protein, 203 aa, Zea mays
  misc_feature: Ceres CLONE 1564972
  misc_feature (3)..(203): Pfam Name: Porin_3 Pfam Description: Eukaryotic porin
MVGPGLYTEIGKKTRDLLYKDYQTDHKFTLTTYTSNGVAVTASSTKKADLILGEIQSQIKNKNMTIDVKANSESNIITTITVDEIATPGLKTILSFAVPDQRSGKVELQYLHDYAGSNASIGLTANPVVNLSAAFGTKAVAVGADISPETATGKLTKSKAALKVHHGRPCRHPWNLKKQGEKAFPGDLPFPRGREIDPTQPGG

SEQ ID NO: 79832 - DNA, 1333 bp, Zea mays
  misc_feature: Ceres CLONE 1564973
  misc_feature: Encodes the peptide sequence at SEQ ID NO. 79833
  misc_feature (54)..(54): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (870)..(870): n is a, c, t, g, unknown, or other
  misc_feature (1249)..(1249): n is a, c, t, g, unknown, or other
  misc_feature (1261)..(1261): n is a, c, t, g, unknown, or other
agaaaaaggaaaaaaaaaaattcagagaccccagcgcgggcgccgggggggggntttgtggtgagaaaggnnnngaaaactggagctcccctcggtggcggccgctctataacagtggatcccccgggctgctttgtattcgtctcacccctagaaaaagggccgacaagatagggtcggaaagccccgccgccgacggcgtcggcgacgccgcgcgcaagcggcccagcggcgatgttggccccaccccggggccagccgacaagcgccgccgcccggagcacccttcttcctcctccgcgggctcccgcgaccgccaccaccaccaccacggccgccgcccgccgtcctcggccgacgagaaggtgcgcgcctctcacatcctgatcaagcacgagggctcccgccgcaaggcctcgtggcgggatcccgaaggcgtaggaatgtacaccactacacgcgacgacgcggccgacctcgcgcgcgcgctccgcgaccagatcgtctccggagaccgcgagttcgaggacgtcgctgccgagaaactccgaactgcaggctcgggccaaagcgccagcgagtgacccctcgagttcattctggggaagggggtaaacatcgcatgaatacccctttcgaagaaaagagcccacggttttggctccctgtaatgtggtctcggcggaaataaaccgcgccgggaccgggagatattgaaaaatacccggagatataaaaacgcaaggggggtaatacaaaccaaattcctattttcccgaagggcaagagggacaacacctggggactgtatgggaaaacaaagaaagccgggcagaccccctcttgagcactttcggtgtccccaataanttataattttcccccacgcgcttttaaaaatataaaaccacataagcggagtgtgtaatatcgagaccaacgctcgccgggaggaggaaaaattcaaaaagaagccttgcgggggtagaaaagggggggggaagtataaaaaaggtgttaaaggccattaacttcccagtttcggaggcaccacagaacgaagtctttctatggagtaactgacggggggagggagacattacttaatgcgtatgatgagttcaactcaaacccatcaaaaatcaagccaggaggtcatagacgcgcatgtgagcagggaagcgcgcacgatataaatacgaagagcgaacaaccttgcacagagaatgagacacagaagtgagacgcntatttacgcacnagaccgcgttgacaattacctatatgctcaccctaattcaaaagtgcattggcaagtcatatataatattgt

SEQ ID NO: 79833 - protein, 193 aa, Zea mays
  misc_feature: Ceres CLONE 1564973
  misc_feature: SWISSPROT Homolog: EC 5.2.1.8 Peptidylprolyl isomerase
  misc_feature (18)..(18): Xaa is any aa, unknown, or other
  misc_feature (24)..(24): Xaa is any aa, unknown, or other
KKEKKKFRDPSAGAGGGXCGEKGXENWSSPRWRPLYNSGSPGLLCIRLTPRKRADKIGSESPAADGVGDAARKRPSGDVGPTPGPADKRRRPEHPSSSSAGSRDRHHHHHGRRPPSSADEKVRASHILIKHEGSRRKASWRDPEGVGMYTTTRDDAADLARALRDQIVSGDREFEDVAAEKLRTAGSGQSASE

SEQ ID NO: 79834 - DNA, 1237 bp, Zea mays
  misc_feature: Ceres CLONE 1564974
  misc_feature: Encodes the peptide sequence at SEQ ID NO. 79835
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (37)..(37): n is a, c, t, g, unknown, or other
  misc_feature (49)..(49): n is a, c, t, g, unknown, or other
  misc_feature (51)..(51): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
cgcggtcgtggccagggnnnggngggggggggggggngggggggggggngngggggggcggccgcgnnnnnnnnnnncgggaactccccgcggtggcggccgctctagaatagtggatcccccgggctgcaggaattcgtctcacccctagaaaaaaataagactctacagcgccagcgcatgctcgctgcaagcgcaaagcagcctcggcacccacctgcacctggagactgcaaccggaatgtctggctcgcgggacgctctccggccgcgctgccggtgtctccggcctcctccgcctccgccgccgagccgccccagcccccgcgatcgcggcgccctcgcacctccccgctggaaccgtcaagtgcgcggccgccgtgcccgatgccgccccgatcgtctggggccgtcagctccgcccggcgctcctcctacccgtgggaccgctccctttgttgtcagccgccaggacgcacacaccccccaccgcgcgtcgcagagcgcctagttccccatgggaaggccagagtctgttgggttatcctgggaacaaaataccgcagccccctgggtcacgcgaggcttccttactatccgtgcaatgtaggtaagctagcgatccaaacggtcattatttccaaaccgaccgctgcttatcaagggatagaaatcttagcaaatacaagccttttcccctcatttcgcccccaggaaccagtgtgtggagtaccccatctgcgcagtaccccattcgtgtaaggaacagaactgactgaggtgtgctcccgagtaaattgatacttaagccccccacccattcgctccgcatgcttcgtcgcgcttagtggttggtaggcgtttctatcccactccccgaaaaggccgtctggcgacggacgccttattattacaatatgagttacaacgcttctgtctattcaatcgtaagagtatgtggcctaatgttgtcgccgcggacaaaacacaactcttgagtgggcccccactggtaatagaaatagagacaccgagcacacatataatcttgtatgcacgatattattgatctctattttagtccaaggtgggaggttctaggcttacgccccatttatatttcatcagccttctgctcatgagaaatagtggtcttaaatgataccgcttttctatataaggactatggcacggggggatgttacctatagtgattaaatcacctatcggagacgtg

SEQ ID NO: 79835 - protein, 30 aa, Zea mays
  misc_feature: Ceres CLONE 1564974
MGRPESVGLSWEQNTAAPWVTRGFLTIRAM

SEQ ID NO: 79836 - DNA, 837 bp, Zea mays
  misc_feature: Ceres CLONE 1564975
  misc_feature: Translation starting site: 204
  misc_feature (588)..(588): n is a, c, t, g, unknown, or other
ctccccgcggtggcggccgctctagaactagtggatcccccgggctgcaggaattcgtctcacccctagaaaaaccagcgtaacaagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggaagctttggtggttgtcaaacctggacagaataaatcaatcgctggcattgtcactgagagagattatctccggaaaatcatagtggcagggaaggtcttccaagtncaactaagggtgggcgacatcatgactgaagagaacaaactgatcacagtgaatcccgacaccaaagtcctggcagcaatgcagctcatgacaagaaaacgcgtcagacaccttcccggtgatcgacggcaacgggaaggctgggggatagtctcatttcggcaactcctgtgccccccgtggtggcctaaccacagggaagaactggaccggctcaatgactacatccagggaggcttccttaggaaa

SEQ ID NO: 79837 - DNA, 968 bp, Zea mays
  misc_feature: Ceres CLONE 1564976
  misc_feature: Encodes the peptide sequence at SEQ ID NO. 79838
  misc_feature (1)..(1): n is a, c, t, g, unknown, or other
  misc_feature (28)..(28): n is a, c, t, g, unknown, or other
  misc_feature (30)..(30): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (137)..(137): n is a, c, t, g, unknown, or other
nggcgggggggggttttccccgccgggngnttggggcnnccgtnnntgattgttnggnnnnnnnnnnnnnnnnnnnnnnnnaaaaaactggagctcaccgcggtggcggccgctctagaactagtggatcccccggnctgcaggaattcgtctcacccctagaaaaactttttactattttttttctattcccatttccaccctcgcaccgcatccacctccaccgcgccgccgcgagagaggggaaggagggtttccgatggagaacggcgaggagacgttcgcctcccccactgccgccgccgccgcggacttcgagatctccatcaacggcggggacagcacgcccaagctccacaatttggcggacgagatggaggccctccgcgcggcgaagcgcgacctggaggagaagctcgatgccgtgggacacgagaaccggttcctgtcctctgagtcccggcgcctcgaggtcctcgtgtcccaggcccgcgaggaagtcgccgctgccgggcaaaccgcccgcacccacgagagcgagggccgccacgctccgcggccaaggtcgaaacgtctccggggccttcctaccccccaaaaaaggcccgcccaggaggaagaaaaagccccgggggccccaagggtctcggggaaaccaacttgccaagaccccggttccccaggaaaaaagggccccccccttttggggaaggaaaaattcgaaaacccccttaaagggggttccccccccccttccccaagggggcaaaggggggcggaaaaggaggggaaaaaggggggggggacccggatttccccttttttttcccccggggcgcgggggaaacccccctaaagaaataaaaaaggggccgggggtgtctctcccccccccctctcttgggggggggtccccccggcgtttgtgtttgggaaaaaacattcccccacagggggtgggtcccaac

SEQ ID NO: 79838 - protein, 198 aa, Zea mays
  misc_feature: Ceres CLONE 1564976
MENGEETFASPTAAAAADFEISINGGDSTPKLHNLADEMEALRAAKRDLEEKLDAVGHENRFLSSESRRLEVLVSQAREEVAAAGQTARTHESEGRHAPRPRSKRLRGLPTPQKRPAQEEEKAPGAPRVSGKPTCQDPGSPGKKGPPLLGKEKFENPLKGGSPPPSPRGQRGAEKEGKKGGGTRISPFFSPGARGKPP

SEQ ID NO: 79839 - DNA, 794 bp, Zea mays
  misc_feature: Ceres CLONE 1564977
ctccccgcggtggcggccgctctagaactagtggatcccccgggctgcaggaattcgtctcacccctagaaaaaatcgcgccatgcctcctcccccagacctctcccctccccgcgatccttctttggccaggcggtctgtcggtgcttgcgcccgggcccctcgcgcgctcgcccggcgtcccacggacagcaggggcggcggcggcaagccggtgcgtcagcttctgtcgcacgtcgcccgcacgatgcgacccgcgcccgcggcccgccccctttccctcgctgccacacgatggtcgacaccgggcggagcttcgtggtcaatcaccggggcccgtccgagaagtcccctccgtcaccgccaccgacgcaggcggaggccacgacttccctaacgaaggcaggcgcgccggtggagcccgcgtcgcccccaccgccgtcctagagccgatcggccaagcccaccaaggttgttgtgcgggcggaggacccccggtgcgcgcggcgcaaagcggtgggcccagccgcggccgacgtcctcgaagttccgtcctggcaaacttgcaggggatggccaaggccttcgggggtcaaaaggggcccttttttcccccggggccaaattccgaagggcccgggaaggggtttttttaaaaaaccctaagggtttcccggggtaccgggggggaaaaaaaaaaaaaacgcccgggaagggggttccccccaacggaaaagggggcacccctttgaaaaaaacaaaatcccccccaagtgggccccccctttttttcc

SEQ ID NO: 79840 - DNA, 753 bp, Zea mays
  misc_feature: Ceres CLONE 1564978
  misc_feature: Encodes the peptide sequence at SEQ ID NO. 79841
  misc_feature (268)..(268): n is a, c, t, g, unknown, or other
  misc_feature (285)..(285): n is a, c, t, g, unknown, or other
  misc_feature (354)..(354): n is a, c, t, g, unknown, or other
  misc_feature (688)..(688): n is a, c, t, g, unknown, or other
ctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgnttcccctagagcatatnggtacgggcctctgatcgccccaaagtatcttggcccgtttctcccggagcagacgcccgttcgtaccntgaccgggcgagttccccccgggcgactaccggggtggggaaccccgcggggccttttccggccggaacccgggaaaacattttccccccccaacccggggagacctgggaagggtgaatccccccccccggggggggggcaaatccttgggggccccccctggggcccccccttttttccccgggagaataccccggggccaaacaaaaacgggggggtcccaaaatttttccgccaaaaaaagggggtgttgttttttttttaaagaaggggggccgcgcccgccccccaaaaaaattttcttttttttctgggaaaggggggggggggggnccttaaaaaacacaacaccctcccggggggggggggagaaaacccccccccccccctccgtgggg

SEQ ID NO: 79841 - protein, 155 aa, Zea mays
  misc_feature: Ceres CLONE 1564978
  misc_feature (39)..(39): Xaa is any aa, unknown, or other
  misc_feature (45)..(45): Xaa is any aa, unknown, or other
  misc_feature (68)..(68): Xaa is any aa, unknown, or other
MAASALHQTTSFLGQALVSRAAGVDAGGRITMRRTVKSXSPRAYXYGPLIAPKYLGPFLPEQTPVRTXTGRVPPGRLPGWGTPRGLFRPEPGKTFSPPNPGRPGKGESPPPGGGQILGGPPWGPPFFPRENTPGPNKNGGVPKFFRQKKGVLFFF

SEQ ID NO: 79842 - DNA, 838 bp, Zea mays
  misc_feature: Ceres CLONE 1564981
  misc_feature: Encodes the peptide sequence at SEQ ID NO. 79843
gcggtggcggccgctctagaactagtggatcccccgggctgcaggaattcgtctcacccctagaaaaaactctactgctcaggtcggaaagtttctgtgccgactgccgagcgagaacgagaagacaagaggaagccaaaaggagaaccgagttcgggagggagcggatggcaatggctctgcttccgctattgctctcggtcctcatcgtctcctgcgtcgcgcagtcgccggcctcgtcgccgtccgcgtcgaatgctcctccggtcagcgcctcggctccgcggggctctgtcgcgccaccgacaacggcggtctcggcgccgcaggcctctgtcgcggcaccgacaacggcagcctcggcgccgcaggcctctgcagcgccaccgacgacaacggcggtctcggcgccaacggtctctgtcgctgcaccgcaggcctctgcacagccgccagcaccagttttcgcgtcggcgccccaggcgtcggccgcgtcaccaacaaaagcagccgccgcccctcaggtctcagccgcggcgccggcaacagcagccttgccgccaactacatcagcctccgcgccccaggcctcggccgcggcaccaacaaaagcagccttgccgccacaggcctttgctgcggcgccaactacatcagccgcggcgccgcaggcctctgccaccgcacctcctaacggcgcccgcgcgccacccgacgcagctgctttctcgcagctggctgccacgttgccctcgggtttcttccccgcactggccgctacgccacctgtctctgctactcctccagcacgctacctcccgtcgcatcgcctacggtc

SEQ ID NO: 79843 - protein, 221 aa, Zea mays
  misc_feature: Ceres CLONE 1564981
MALLPLLLSVLIVSCVAQSPASSPSASNAPPVSASAPRGSVAPPTTAVSAPQASVAAPTTAASAPQASAAPPTTTAVSAPTVSVAAPQASAQPPAPVFASAPQASAASPTKAAAAPQVSAAAPATAALPPTTSASAPQASAAAPTKAALPPQAFAAAPTTSAAAPQASATAPPNGARAPPDAAAFSQLAATLPSGFFPALAATPPVSATPPARYLPSHRLR

SEQ ID NO: 79844 - DNA, 831 bp, Zea mays
  misc_feature: Ceres CLONE 1564983
ctggagctccccgcggtggcggccgctctagaactagtggatcccccgggctgcaggaattcgtctcacccctagaaaaatgaaccctaaacgacgacgacggcgccggcggccgcctgaagacgatccatatctatcccgccgtcgtcggcgcctgcggttcggaccgtcatgaccatatctacctacgcatgatcacgacttgcatgtctactactactactgaataaaaaacctctccgcgcacgtcgtccttgtgtctgtgtgtgtgagagagagaggagagccggccatgtccttttggctgtttggtttatttttgagttcatgcggtctttatttatttccatgtacccagtacccaccttgtaccatgcatgttccttatgatacactcacctctttttgtttgcaaaatccctcgactgtgttcacgaacagtaaaaaaataaaaaaaaaaaaaacctggccgcaccgcaattagccgcgaccctccgcaaaatcggctcacgtttccgatccagaggtccagactgttccccgagttttcccactgtgtcctctcctcgcgagtcccggcaaaacagggaaaccccgaacatgtgccccaccggcaggtacctgggggtcgacctctccggcgctggcggggacctgagggccggctttcaaactggcttggaccggaaccggggacggcccggtatcaccccgggaacaacccttaaggtccttttctaacccccgcccggggggggccgcccccaccgggggaaaccgggtttataacaaaaaaaacaaacctcccccggggcccaatttaatccccga

SEQ ID NO: 79845 - DNA, 910 bp, Zea mays
  misc_feature: Ceres CLONE 1564984
  misc_feature: Encodes the peptide sequence at SEQ ID NO. 79846
  misc_feature (400)..(400): n is a, c, t, g, unknown, or other
  misc_feature (432)..(432): n is a, c, t, g, unknown, or other
  misc_feature (525)..(525): n is a, c, t, g, unknown, or other
  misc_feature (550)..(550): n is a, c, t, g, unknown, or other
ggagctccccgcggtggcggccgctctagaactagtggatcccccgggctgcaggaattcgtctcacccctagaaaaaggtccccaccaggcaatcaagaacaccacctaccgctgacttgtcaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcggcatcgaggactcggtccgcacgggcggcggcgcgctgctcccgatccttggcttcatcgtcctcccagtcctctggtcgctcccggaggcgctggtcacggccgagctcgcatccnctttccccaccaacgccgggtacgtggcctgngtgtccgccgccttcggccccgccgtggcgttcctcgtcgggttctccaagtgggcgtcggggacgctcgacaacgcgctctacccggtgctngtcctcgactacctccgctccggcngcgggctggcgctgcccgcgccggcccgctcgctggcggtcctcgcgctcaagggcgcgctcacctaccttcactacggggggctccacatcgtcggccttctcggcgctggcgctcacggcgttcttggttttccccgttcttggggttcccgtggttcggggcccccaaaaacccccccgtccggttgggttggcattaaaagccccggcccgttaacctcgggggttaacttcaactccctggtctcggaaaccccaactttcgggaaaaaggcccccccccctcccgggggggggttgaaggaccccccggaaaaacttctccccaagggggtttttcgggcccccttggggtctt

SEQ ID NO: 79846 - protein, 244 aa, Zea mays
  misc_feature: Ceres CLONE 1564984
  misc_feature (75)..(75): Xaa is any aa, unknown, or other
  misc_feature (85)..(85): Xaa is any aa, unknown, or other
  misc_feature (125)..(125): Xaa is any aa, unknown, or other
MTGAAAVDPPVPRPRRLTVLPLIALIFYDVSGGPFGIEDSVRTGGGALLPILGFIVLPVLWSLPEALVTAELASXFPTNAGYVAXVSAAFGPAVAFLVGFSKWASGTLDNALYPVLVLDYLRSGXGLALPAPARSLAVLALKGALTYLHYGGLHIVGLLGAGAHGVLGFPRSWGSRGSGPPKTPPSGWVGIKSPGPLTSGVNFNSLVSETPTFGKKAPPPPGGGLKDPPEKLLPKGVFRAPLGS

SEQ ID NO: 79847 - DNA, 828 bp, Zea mays
  misc_feature: Ceres CLONE 1564988
  misc_feature: Translation starting site: 158
ctccccgcggtggcggccgctctagaactagtggatcccccgggctgcaggaattcgtctcacccctagaaaaagcagggtcctccgagtcggacttcctcacggccgccgcgccaaatcccgtctcgttgctccggtccgctgcgcatcctcaggaatggaacttggcgccaccactgccctctaccctctgcaccgctgcaaaaccatttacctggtcaggcatgcccagggcattcacaatgtcgcgggggagaaggactttggtgcatacatgtcacatgatctgttcgatgctcagctcactcctttgggttggaaccaagtcgatggtctgcgggagcatgtgaagaaaagtgggcttgcagaaaagattgaattagttatttcttcccctttactgaggactatgcaaactgcagttggtgtctttggtggtgaaaagtatatttgatggtgtaaatgcacctccactaatggtcgaaaatgccggacacagtggtcgtccggcagtttcaagtttgaactgccccccatttattgcagtcgaaacctgcagagagcacttgggtgtccatccctgtgacaagaggaagagcataacagaataccggcctctctttcctgcgattgatttttcattgatagagaatgatgaagatgttctttggggaacagatgtgagagaacaaatgaggctgtcgctttgagggggtatgaaagtcatgggactgggttgtggacaagagaggagaaagagattgctattgtcaggtcaaagggggtttctttgtttcacaccctttagcatgttacaagtaaggaatc

SEQ ID NO: 79848 - DNA, 788 bp, Zea mays
  misc_feature: Ceres CLONE 1564989
  misc_feature: Encodes the peptide sequence at SEQ ID NO. 79849
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (702)..(702): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (741)..(741): n is a, c, t, g, unknown, or other
  misc_feature (742)..(742): n is a, c, t, g, unknown, or other
  misc_feature (744)..(744): n is a, c, t, g, unknown, or other
  misc_feature (757)..(757): n is a, c, t, g, unknown, or other
  misc_feature (767)..(767): n is a, c, t, g, unknown, or other
  misc_feature (768)..(768): n is a, c, t, g, unknown, or other
  misc_feature (771)..(771): n is a, c, t, g, unknown, or other
  misc_feature (776)..(776): n is a, c, t, g, unknown, or other
  misc_feature (784)..(784): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaaagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaactttcgccaagaaccgcgagcttggagggtgatcccactggcccccttggggcccaatggtttggggggcgcccctcggggggggggggtgttttttccccgggggaggagttcctcccccccccccccccccggggggggtttttttttttttttttggggggggggggggggggggggtgttttttttttttttgggggggggggccgcccccccccccccccctctcctttttttttttttngnnnnnngggggggggggggggggggggnnnnngcgnnnnctctcctccccccncccgcgcccnnncncccccccnnnnccgcgcccgcgcgnngnggggggcgcgcgngtgcccgcgnnccnccccnccccgccncnct

SEQ ID NO: 79849 - protein, 215 aa, Zea mays
  misc_feature: Ceres CLONE 1564989
  misc_feature (171)..(171): Xaa is any aa, unknown, or other
  misc_feature (172)..(172): Xaa is any aa, unknown, or other
  misc_feature (173)..(173): Xaa is any aa, unknown, or other
  misc_feature (181)..(181): Xaa is any aa, unknown, or other
  misc_feature (182)..(182): Xaa is any aa, unknown, or other
  misc_feature (183)..(183): Xaa is any aa, unknown, or other
  misc_feature (184)..(184): Xaa is any aa, unknown, or other
  misc_feature (189)..(189): Xaa is any aa, unknown, or other
  misc_feature (192)..(192): Xaa is any aa, unknown, or other
  misc_feature (193)..(193): Xaa is any aa, unknown, or other
  misc_feature (196)..(196): Xaa is any aa, unknown, or other
  misc_feature (197)..(197): Xaa is any aa, unknown, or other
  misc_feature (202)..(202): Xaa is any aa, unknown, or other
  misc_feature (203)..(203): Xaa is any aa, unknown, or other
  misc_feature (207)..(207): Xaa is any aa, unknown, or other
  misc_feature (211)..(211): Xaa is any aa, unknown, or other
  misc_feature (212)..(212): Xaa is any aa, unknown, or other
MAAATMAITSRALVGKPAAGTRDVFGEGRITMRKTAAKPKPAASGSPWYGADRVLYLGPLSGSPPSYLTGEFPGDYGWDTAGLSADPENFRQEPRAWRVIPLAPLGPNGLGGAPRGGGVFFPRGRSSSPPPPPGGGFFFFFWGGGGGGGVFFFFGGGGRPPPPPSPFFFFXXXGGGGGGGXXXXSPPPXRAXXPPXXRARAXXGARXCPRXXPPR

SEQ ID NO: 79850 - DNA, 852 bp, Zea mays
  misc_feature: Ceres CLONE 1564993
  misc_feature: Translation starting site: 185
  misc_feature (820)..(820): n is a, c, t, g, unknown, or other
tggagctccccgcggtggcggccgctctagaactagtggatcccccgggctgcaggaattcgtctcacccctagaaaaaactctactgctcaggtcggaaagtttctgtgccgactgccgagcgagaacgagaagacaagaggaagccaaaaggagaaccgagttcgggagggagcggatggcaatggctctgcttccgctattgctctcggtcctcatcgtctcctgcgtcgcgcagtcgccggcctcgtcgccgtccgcgtcgaatgctcctccggtcagcgcctcggctccgcggggctctgtcgcgccaccgacaacggcggtctcggcgccgcaggcctctgtcgcggcaccgacaacggcagcctcggcgccgcaggcctctgcagcgccaccgacgacaacggcggtctcggcgccaacggtctctgtcgctgcaccgcaggcctctgcacagccgccagcaccagttttcgcgtcggcgccccaggcgtcggccgcgtcaccaacaaaagcagccgccgcccctcaggtctcagccgcggcgccggcaacagcagccttgccgccaactacatcagcctccgcgccccaggcctcggccgcggcaccaacaaaagcagccttgccgccacaggcctttgctgcggcgccaactacatcagccgcggcgccgcaggcctctgccaccgcacctccctacggcgccgccgcgccaccgaacgcagctgcttctccgcagctggctgccacgttgccctcgggtttcctccccgccactggccgctacgccacctgtctctgctacttcttcagncacgctacctcccgtcgcatcgcctaccggcg

SEQ ID NO: 79851 - DNA, 853 bp, Zea mays
  misc_feature: Ceres CLONE 1564994
  misc_feature: Encodes the peptide sequence at SEQ ID NO. 79852
  misc_feature (756)..(756): n is a, c, t, g, unknown, or other
  misc_feature (757)..(757): n is a, c, t, g, unknown, or other
  misc_feature (768)..(768): n is a, c, t, g, unknown, or other
ctggagctccccgcggtggcggccgctctagaactagtggatcccccgggctgcaggaattcgtctcacccctagaaaaagagaagaaaggaacaaagaagagaagatctcgatccgcacacctcacgcctgaaggccagatctagggtctgtttggtttgatgactaacttgccacactttgcctaacttttctgactaaggttagttattcaattcgaatgactaaccttaggcaaagtgtgacaggtttagccacgaaccaaacagcccctagccttcctcttcctctcgccccaaggacaacgataacatcaaacaagagaaccaaaggaaacagagcaagagcatcgctctctaagcaaaacgcgcagcacgccggccggccacttcgcacgtacgtaggacgcgcacgcaccggtgcatatatggggctcctggaccagctgtgggacgacacggtggccgggccgcgcccggactccggcctcggcaagctccgcaagtacgcctccttctccccttcgtcgtcggcggcgccgggctccgcgccgcctcccggcgccgtgacgcatagcgtcaccatgctgcggcggccggcggcgctgtccgtcgtcacgtcgccccgcagcgagtccagctccgcgccgtcgtccccgtcgcccgcaagcggcgctccggattcgcccttcggcgcagctgcagcgacgacgccccaggggagaagggctggaagaagctgcgcgggaaagccagnnatggccggcgncggcggcaacgcccccggcacgccgaggaagcccaccgtgtacgacctggggtgggtaatcagttccgctgggacctctgaagcc

SEQ ID NO: 79852 - protein, 142 aa, Zea mays
  misc_feature: Ceres CLONE 1564994
  misc_feature (7)..(139): Pfam Name: Auxin_repressed Pfam Description: Dormancy/auxin associated protein
  misc_feature (110)..(110): Xaa is any aa, unknown, or other
  misc_feature (114)..(114): Xaa is any aa, unknown, or other
MGLLDQLWDDTVAGPRPDSGLGKLRKYASFSPSSSAAPGSAPPPGAVTHSVTMLRRPAALSVVTSPRSESSSAPSSPSPASGAPDSPFGAAAATTPQGRRAGRSCAGKPXMAGXGGNAPGTPRKPTVYDLGWVISSAGTSEA

SEQ ID NO: 79853 - DNA, 910 bp, Zea mays
  misc_feature: Ceres CLONE 1564995
  misc_feature: Encodes the peptide sequence at SEQ ID NO. 79854
  misc_feature (533)..(533): n is a, c, t, g, unknown, or other
  misc_feature (705)..(705): n is a, c, t, g, unknown, or other
  misc_feature (707)..(707): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (724)..(724): n is a, c, t, g, unknown, or other
  misc_feature (725)..(725): n is a, c, t, g, unknown, or other
acccgcggtggcggccgctctagaactagtggatcccccgggctgcaggaattcgtctcacccctagaaaaagcgcaaaacacctcgccttttgtactcttgcgtctctgccctcgcgttatcgccttcgtcacgctcgctcgcctggctggcttgtgtgccttgccttgctcggcgtacgcgaacgcagcgagagggaggagcaaggaaatagagagagacagagagagagagagagaaaaaatcaagtcatccccctttcctctgagctcgttccatggagaactcttctcacaagcgggcgcgggaggcgggcgacctcgtcgccggcggctgcggagaggagggctcgccgcaggccgacgccaagaggctgcggccgcaggacctgctcgacatgctggaggacgacacggacgcggccgcggccggcgacctagcgtcggtcatgcggagcctggaggaggagatagccagcttcgacgaggcccgcgaagcgccggcgccggagctgggcttcctgctcgaagccntcgacgacgagctggggctgccgccgcctcctccttcgaagaggaagaagcccgggcccccggggccccaattaacgccccccgcccttcaagggcaagattgggggctccaaggacaaaatcgtggaccggagggggcttgggcggttacccccgggaaggcccggggcgncnctttttggcgggnnncnnccgggggggaaaaaaaaaggttttgggcccggccttttttctttttggggggaaaaaccctttggggccccttgaaaatttgggccttggcccaaaaaaaataccccccccttttgggggccttcccccgggggccggggaccccccaccaaaaaaaacccctcccttttttttttttttttttt

SEQ ID NO: 79854 - protein, 211 aa, Zea mays
  misc_feature: Ceres CLONE 1564995
  misc_feature (86)..(86): Xaa is any aa, unknown, or other
  misc_feature (143)..(143): Xaa is any aa, unknown, or other
  misc_feature (144)..(144): Xaa is any aa, unknown, or other
  misc_feature (148)..(148): Xaa is any aa, unknown, or other
  misc_feature (149)..(149): Xaa is any aa, unknown, or other
  misc_feature (150)..(150): Xaa is any aa, unknown, or other
MENSSHKRAREAGDLVAGGCGEEGSPQADAKRLRPQDLLDMLEDDTDAAAAGDLASVMRSLEEEIASFDEAREAPAPELGFLLEAXDDELGLPPPPPSKRKKPGPPGPQLTPPALQGQDWGLQGQNRGPEGAWAVTPGKARGXXFWRXXXGGEKKRFWARPFFFLGGKTLWGPLKIWALAQKKYPPLLGAFPRGPGTPHQKKPLPFFFFFF

SEQ ID NO: 79855 - DNA, 877 bp, Zea mays
  misc_feature: Ceres CLONE 1564996
  misc_feature: Encodes the peptide sequence at SEQ ID NO. 79856
atccccgcggtggcggccgctctagaactagtggatcccccgggctgcaggaattcgtctcacccctagaaaaagagaagaaaggaacaaagaagagaagatctcgatccgcacacctcacgcctgaaggccagatctagggtctgtttggtttgatgactaacttgccacactttgcctaacttttctgactaaggttaattattcaattcgaatgactaaccttaggcaaagtgtgacaggtttatccactaaccaaacagcccctagccttcctcttcctctcgccccaaggacaacgataacatcaaacaagagaaccaaaggaaacagagcaagagcatcgctctctaagcaaaacgcgcagcacgccggccggccacttcgcacgtacctaagacgcgcacgcaccggtgcatatatggggctcctggaccagctgtgggaccacacggtgggccgggccgcgcccgggactccgggctcggcaagctccggaagtacgccttctttctcccccttcgtcgtcgggcggcgcccagggctcctcgcccaccttcccggggcccgttgacgcaataacggtccaccattgaccggcgggcgggccccggaggacgccttgtcccttcggtcccagtccgccccccccaagcgaaagttccaggcttccccagccagttatttccccgtcccccccccccaaagcggggccctcccagaattcccccccttgggggtgccaatctgcacccctacgaaaccccccaagggtgaaaaagggctttgaaaaaaaacctctccgggggaaaagccccacatattggaccgggcggcccccctgttaaacaccccccccagaaaaccccagaaaaaa

SEQ ID NO: 79856 - protein, 50 aa, Zea mays
  misc_feature: Ceres CLONE 1564996
MGLLDQLWDHTVGRAAPGTPGSASSGSTPSFSPFVVGRRPGLLAHLPGAR

SEQ ID NO: 79857 - DNA, 894 bp, Zea mays
  misc_feature: Ceres CLONE 1564999
  misc_feature: Encodes the peptide sequence at SEQ ID NO. 79858
tccccgcggtggcggccgctctagaactagtggatcccccgggctgcaggaattcgtctcacccctagaaaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggtatcttggtgccggaagctcttgggcctgggcaactgggtgaagggccaggaatggggcggccgtcccccggcgggcaaggccacgtaccctggggcgcccccggtgccctgggggccacgctttccgaacattcccgggggatacgaatttccggggccattcgcccttttggccgagaccccccatcccccccccattgggaaaaaaggcccccccgagaaaaaaaaaattttcccccgggggggggccctttctaaaccgcgtttgtggttttcctcaagggagcccccccccaaatttctctaggagatacaactcctcccggggggaattccatagaaggggcgccccctcccccatgtttgggcctttctggtggggttttttttgtgtcaaaaagaaagggggtgttacccccgagtactcgtttccactttttaaaaaaacccccccg

SEQ ID NO: 79858 - protein, 114 aa, Zea mays
  misc_feature: Ceres CLONE 1564999
  misc_feature (54)..(114): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGYLGAGSSWAWATG

SEQ ID NO: 79859 - DNA, 796 bp, Zea mays
  misc_feature: Ceres CLONE 1565002
  misc_feature: Encodes the peptide sequence at SEQ ID NO. 79860
ctggagctccccgcggtggcggccgctctagaactagtggatcccccgggctgcaggaattcgtctcacccctagaaaaagacgacccaagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcacctttcttgcattggttcctctctctctctctccctccttttttttccctttatctcatcatttcttttctc

SEQ ID NO: 79860 - protein, 170 aa, Zea mays; identical to SEQ ID NO: 76343
  misc_feature: Ceres CLONE 1565002
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 79861 - DNA, 970 bp, Zea mays
  misc_feature: Ceres CLONE 1565004
  misc_feature: Encodes the peptide sequence at SEQ ID NO. 79862
acccgcggtggcggccgctctagaactagtggatcccccgggctgcaggaattcgtctcacccctagaaaaaaccgcctccacctccgccccccaccgccccgccccacagcaggaaggatggaagccccgggctccccctacgcctcctcgccggaatccgcccccaagcgtgccccacgctcccctccgcagcagcagcagtctccctccgaggaaggagatgacaaggagaaaccaacacatttgagatttctagtgtctaatacggcagcagggtgcatcattggcaagggtggatcaaccattaatgattttcagtcccagtctggggctcgtattcagttatcacgtagcaatgagtttttccctgggacaaatggaagaaaccccatggttttctggactgttttgatgaagtaaatgaaaggcctggaagcttaatttcttgaagaaattgttgggctttaggggttaaaaaaattccatcgaagccgaaagacctgaaaccttaagagttagaaccttggaggtttcccacaaagacctgcttggggggggggtaaaaaattggggtaaaaggggggggatgaagaaaccgaaaagggtctgtctttttgttaggaaaaaatcccactttgcgttagagagaaaccaaaactcgcccgcctccacgaggaaaagaacaaacatatggtgttaggtctttccgcgtagaaaaggggttggggtgggccaagcaacgggggacacgttttgaatatacgcccgatggattggcgacggagagtttgggagtctgccgaaaggatgttttcgcgagggagagcgttacagagtcgcggagaataatgtggggctcgccctattcatatagggagggggctcatatttatccgaaggctccccaggagggtgtctcgcggggccaatataccacgaccccggggggtgtctagcgaatagatatt

SEQ ID NO: 79862 - protein, 100 aa, Zea mays
  misc_feature: Ceres CLONE 1565004
  misc_feature (42)..(100): Pfam Name: KH_1 Pfam Description: KH domain
MEAPGSPYASSPESAPKRAPRSPPQQQQSPSEEGDDKEKPTHLRFLVSNTAAGCIIGKGGSTINDFQSQSGARIQLSRSNEFFPGTNGRNPMVFWTVLMK

SEQ ID NO: 79863 - DNA, 855 bp, Zea mays
  misc_feature: Ceres CLONE 1565006
  misc_feature: Encodes the peptide sequence at SEQ ID NO. 79864
  misc_feature (534)..(534): n is a, c, t, g, unknown, or other
ctccccgcggtggcggccgctctagaactagtggatcccccgggctgcaggaattcgtctcacccctagaaaaaaacttttctcctaaaaatcctccaaaaaaacaaaaaaggggaggggaaaatattctcgtcttcttccccgtgcttgccagctcccgaagtcggcgagctctccgaaagcggcggctatgggttccagccaggcagataagccactgcgacgtatcgcggcgtcgttcgaggagctcgccgccgtcgccaagcagcatcccgcggtgcccatggacgctggggccttctcgcgcgcctgctccaacgtctccgtcctcttcggctgtctcggcatcgctttcaagttcgcggagatggactacgtcgcgaaggttgatgatttggtggaggcgtcccaagtcatttcaacatttgccttctatgggttgagcgagacattcagaaccgacactgtcagggaaaaccagggagccatacaaggaattctggcttagagtgaaagcgcgggattgaaatgggntaaagtccgtgtttaagcaaatctcttggcccccaaggcccaactcccctaggggatgcccccttcgggggccttatggctcagggcctttgcccccccccccatgggaggcgccaaataaggaaaaacgttttccgcgggaaaagtacccccctttccccccaaaagcccccgctttttggaaaaatattggaattgaagaagaaggaaaccccccaaagggtccaaaaggggaaaatttttttgcagggctcccccgccccccgaaaaacgcgggcgttgggtggagaccctttcctcccccccaaggagaattggggg

SEQ ID NO: 79864 - protein, 105 aa, Zea mays
  misc_feature: Ceres CLONE 1565006
MGSSQADKPLRRIAASFEELAAVAKQHPAVPMDAGAFSRACSNVSVLFGCLGIAFKFAEMDYVAKVDDLVEASQVISTFAFYGLSETFRTDTVRENQGAIQGILA

SEQ ID NO: 79865 - DNA, 829 bp, Zea mays
  misc_feature: Ceres CLONE 1565007
  misc_feature: Encodes the peptide sequence at SEQ ID NO. 79866
ctccccgcggtggcggccgctctagaactagtggatcccccgggctgcaggaattcgtctcacccctagaaaaattttggtggagtctaggctctcggatacgtatcttactaactcctgaacccctaaaggacagaacacaccgggtcgagcttgcgatgggtgtcatcggattcgtcgagggcggaatctcctccatgctggtcggctgctcctccctcccgctggagctcatcaaggtccgcatgcagctgcacggggaggcggtcgttgccgtggagacataaacggtactgtacccagcgatcgctttcatggcaaggggcaacgccgtcgcgatcctgcacctcacgacattcctgtagatcctcggaagcaccgggtggtagccctctctgctcggatgtgcgaccacagggtgccgctggcctctactctggcgtgatcgccaccgtgtgtacgcctatatgatacacgtcacctcgaagggtgctgagcatctccacaagatcaccagcgccccgccaaacggcagattcctctctctgctgcggaagatcaatgtcgatcttgatgcccgcgggtgcagctccattctgagcaacctgccgacgatgcaatcgggctgagctcgcagagagcgatggacacctgtgaatcggtagactcccaggtcttagcttatcccaatgctgtatgcccaaaaaaaagtctccgcaacctctggggcgggtaaagatgaaggcaaccaggcaggaattaatcaaagggtaagctgggctttgagaaattgccgaaaatgtcctcaagaatggggaggcctgggaac

SEQ ID NO: 79866 - protein, 42 aa, Zea mays
  misc_feature: Ceres CLONE 1565007
MGVIGFVEGGISSMLVGCSSLPLELIKVRMQLHGEAVVAVET

SEQ ID NO: 79867 - DNA, 814 bp, Zea mays
  misc_feature: Ceres CLONE 1565008
  misc_feature: Translation starting site: 166
  misc_feature: SWISSPROT Homolog: EC 1.1.1.37 Malate dehydrogenase
ccgcggtggcggccgctctagaactagtggatcccccgggctgcaggaattcgtctcacccctagaaaaagctatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgcccttgaagcccatgcagctcccaactgcaaggtttctggtggttgccaacccagcaaacaccaatgctcttatcttgaaagaatttgctccatctattccagagaagaacgttacttgccctgacccgtctgggacacaacagggctcttggccagatttctgagagacttaatgtccaaagtagtgatgtgaaagatgttatcatctgggggtaaccactcgtcctctcaggtcccctgatgttatccatgccacagtgtagacttccactgggggaaaagccttgttcgtgaggctgtcc

SEQ ID NO: 79868 - DNA, 878 bp, Zea mays
  misc_feature: Ceres CLONE 1565009
  misc_feature: Encodes the peptide sequence at SEQ ID NO. 79869
  misc_feature (740)..(740): n is a, c, t, g, unknown, or other
  misc_feature (760)..(760): n is a, c, t, g, unknown, or other
tggagctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcacgaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctcccccttgctaaggtcattcatgacaacttcggcattgttgaaggtttgatgacaactggtcatgccatcactgccacccagaaactgttgacggaccctcaancaaggactgaagagtgggcngggctgccagctttaacatcttcctagcagcaccgtgcttgccaaggtggtgggaaaagtcctcctgatctgatggcaagctccctgggaaggtctttccgggtcccaacgggggaat

SEQ ID NO: 79869 - protein, 163 aa, Zea mays
  misc_feature: Ceres CLONE 1565009
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGITNPEEIPWGEAGAEYVVESTGVFTDKDKAAAHLKGGAKKVVISAPSKDAPMFVVGVNEDKYTSDVNIVSNASCTTNCLAPPC

SEQ ID NO: 79870 - DNA, 825 bp, Zea mays
  misc_feature: Ceres CLONE 1565012
  misc_feature: Translation starting site: 165
  misc_feature (520)..(520): n is a, c, t, g, unknown, or other
  misc_feature (523)..(523): n is a, c, t, g, unknown, or other
ccccgcggtggcggccgctctagaactagtggatcccccgggctgcaggaattcgtctcacccctagaaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgctgccgctgncanggcctcttctaaaaagaaagaaagtggtaaatcctccgtcccttatggatgtaaaaccatgggacgatgagactgatatgaagaagctggaggaagctgtccgccgtgtccagatggagggtctgacttggggagcatcaaagcttgtgcctgtgggatacggatcaagaagatgactatctgttgacaatgtcgacgaatcttgggtcatccaaccttttatttgaggaccacttacccaagagcccatcaatgagtacgttccgaagttgcgaaattgtgggctttcaacaaaatctagg

SEQ ID NO: 79871 - DNA, 850 bp, Zea mays
  misc_feature: Ceres CLONE 1565013
  misc_feature: Encodes the peptide sequence at SEQ ID NO. 79872
acccgcggtggcggccgctctagaactagtggatcccccgggctgcaggaattcgtctcacccctagaaaaagagcgctgcctctatagtaaccggcccgggagtttcacactctgctcctgtaatggctgcctcatggatggcgatctcttctacggcgatggcgcgcacccccttcatggtggactccctcggagacgggctcctcgccaggccctggaccgtgcggccatgcccggtggcggcgtcctggaggccctggcacggacccgacagctggaagtacgaccgcctcgtcgccggtgagcccccgagctacctcacccacgacctccagatccacgactgatggttcaccgacgagctgttcaccgacatctacaccttcaccaacaactgcgagcgtgtagatgatccacagcactcttcgggctgtctcggctgccctcgacatgcgtctgacgcacgatccgatatgcaaagaccggacgccgacctccgacgatggcctatcttggtccataggcctcgactctccatatacttcaggccatgcccggccatgaatatacatacgcgcaatacccatgactgaattcacaccacagaagtctcaatcgccaggcctgagcctgccactgcggatggttctcctgatgtacacctagggactagagaatgctccaggtgggcccgcctccggccaaataaggttgaccctggtgtgcccctgaggcgtatctacggacccccgttgtccaaagccttaggaccccccaagtgggcgctccagaacaaagattaaccatgtccttgaaaatcccgacccctccggaattgcaagggtagg

SEQ ID NO: 79872 - protein, 62 aa, Zea mays
  misc_feature: Ceres CLONE 1565013
MARTPFMVDSLGDGLLARPWTVRPCPVAASWRPWHGPDSWKYDRLVAGEPPSYLTHDLQIHD

SEQ ID NO: 79873 - DNA, 878 bp, Zea mays
  misc_feature: Ceres CLONE 1565015
  misc_feature: Encodes the peptide sequence at SEQ ID NO. 79874
ctccccgcggtggcggccgctctagaactagtggatcccccgggctgcaggaattcgtctcacccccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctgggggaaccccacctggtgcacgcacagagcatcctggccatctgggcgtgccaaggggtgctcatgggcttccgtcaaaggctaccgccgtcggcggcggccccgctcggggaagggcttccaacaggtggtacccccgggggggcctttctacccgcctggggcctccgcccaaaaaccccgggacaaccgccgccccaggctccaagggtgaaaggaggctcaagaaaagggccgccccttgcccatggtttctcccatggtttcgggccttccttctcgggcaagggcacttcgttcc

SEQ ID NO: 79874 - protein, 241 aa, Zea mays
  misc_feature: Ceres CLONE 1565015
  misc_feature (59)..(199): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGEPHLVHAQSILAIWACQGVLMGFRQRLPPSAAAPLGEGLPTGGTPGGAFLPAWGLRPKTPGQPPPQAPRVKGGSRKGPPLAHGFSHGFGPSFSGKGTSF

SEQ ID NO: 79875 - DNA, 1064 bp, Zea mays
  misc_feature: Ceres CLONE 1565019
  misc_feature (1064)..(1064): n is a, c, t, g, unknown, or other
ccccgcggtggcggccgctctagaactagtggatcccccgggctgcaggaattcgtctcacccctagaaaaaatgatagctccagttgtttgttcctcactctgtgcctgaccagctaggattgtcggaatcagctatggtgatagcgtcatcgagcttgctgaggacctgctagcgccgtgggcgtgcccagcctgctggcgccgtcgacccggtccggacgcctggcgccgttctgcagccaactcaacctcctctgtccgcgtcacgatgacctcggatgggatgccctgccagccacgccctgcccacctcgacggctcctctcccggggacttcggattctatccggtgggcgtcgcgaccgagccgtaaaacttcgagcggagaagagatgccacaggtagtaccaccgtcgtctgggcaatgggtaaacgtcccccaggaatcctagttgccaaaaaagctcaggggcccatggacatcgagaagtgaaaggcgccttgaaattgtgctggacccatcccccaagcagagcagaggcccacgtttacaatgtatgggaccaccagtttgcacttatctggtatcacgacatgccctgagccaatcccctggagggaatcctataatttcctcaacggagcgaactccttcactttcctccccaaagtcaatacctttacgtaatcctcgccaggagaacaaaaggataggcgccctgagagaacggaacaccttgttacctgcaccagggccgggaggtaccttaacaatacccaacatatcggggtttttccttgacataggggaccccctcgacaccaaaatctataataagtagatttggtgtgcctgataaagtgtctatacgttgagtgcaggatagcactctcgcgacatggggtggggacacaataaatcaggattagtagcacgatacaggctgtgcctaacacaaaaccacttgcgctccgggtcacgcccttttatgaagaacttctcccctcctagatattctaaataacaacttgtgtctttacaaacttattcgcgcacaattn

SEQ ID NO: 79876 - DNA, 867 bp, Zea mays
  misc_feature: Ceres CLONE 1565026
  misc_feature: Encodes the peptide sequence at SEQ ID NO. 79877
agctccccgcggtggcggccgctctagaactagtggatcccccgggctgcaggaattcgtctcacccctagaaaaactagaaaaaaatagaaaaactccgcgttttccacctcagtcctagctagcaggtagcagctccgtttactcatccgtcacccccttcccctccattctccatcccttcctcaagaagccgagagcgagaggcgcaatgggcgaccgggcgtacgcgccggccgtgaagccggttcccgtgcgggccaccaacggcaccgcgaacggcggcggcgtggggcctccgcggcccgcgccgccgtccatggtgcccggcgggcgcgtgccccctccgccgatgtacaggcggaggcccgcgcagtcgcgtcctccggcgcggcgccccgggcggagcgcccgcgggtggtgctgcgcgtgctgcctgtggctgacgctggtgctggtggggctggcgttcctgggcgccatcgcggcgggggtgttctacgtggtgtaccggccgcggccgcccagcttcgcggtgacgtcgctgcgcctggcggcgctgaacgtgtcggactcggacgcgctcacctcccgcgtggagttcacggtgacggcgcgaaacccgaaacgacagatcgccttcgactacggcgacatggcggtgtccttcgcctcgggcggcgcgaacgtgggcgacgccgtggtcccgggggttctggcacccggcggggcacaccgacggtcaatccggggcggcggcgtcaccaccggcgtccaccatcaaccccgttccaggcggcgggggcttagatccaggaaagtccccacctgatttcggcgccaaaagggaccccaaagggtcgggtt

SEQ ID NO: 79877 - protein, 206 aa, Zea mays
  misc_feature: Ceres CLONE 1565026
  misc_feature (97)..(204): Pfam Name: Hin1 Pfam Description: Harpin-induced protein 1 (Hin1)
MGDRAYAPAVKPVPVRATNGTANGGGVGPPRPAPPSMVPGGRVPPPPMYRRRPAQSRPPARRPGRSARGWCCACCLWLTLVLVGLAFLGAIAAGVFYVVYRPRPPSFAVTSLRLAALNVSDSDALTSRVEFTVTARNPKRQIAFDYGDMAVSFASGGANVGDAVVPGVLAPGGAHRRSIRGGGVTTGVHHQPRSRRRGLRSRKVPT

SEQ ID NO: 79878 - DNA, 797 bp, Zea mays
  misc_feature: Ceres CLONE 1565030
  misc_feature: Encodes the peptide sequence at SEQ ID NO. 79879
tggcggccgctctagaactagtggatcccccgggctgcaggaattcgtctcacccctagaaaaaacagcatctcaagccaccatcgaccttcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggacccgtggtacggccccgaccgcgtgctgtacctgggcccctgtcggcgagccccgagctcctgacggcgagttccgggcgactcggctgggacacgcggggctgtcggcggacccggagacgttcgccaagaaccgggagctggaggtgatccacttccgctggggcatgctggggcgcgctcgggctgcgtctttcccccagctgctccgcccgcaacgggcgttcaagttcggcgaaagcccttgttgtttcaaaggcccggcttcccaaaatcttcaagcgagggggggggcttgggactacctttgggggaaaccgaaagccttattccaggggggaaaaacaacctttggctatttgggggcgctgcccggggttgtgcccccagtgggggcccctttaaagggtttcccgatattcccgggggggccccccttggggaaggggtttttaaaccccttttttacccgggggggggaatttttaaacccgcttggggctcccccaaaaaaaccccag

SEQ ID NO: 79879 - protein, 221 aa, Zea mays
  misc_feature: Ceres CLONE 1565030
MASSTMALSSTAFAGKAVNVPSSSAFGEARVTMRKTAAKAKPAAASGTRGTAPTACCTWAPVGEPRAPDGEFRATRLGHAGLSADPETFAKNRELEVIHFRWGMLGRARAASFPQLLRPQRAFKFGESPCCFKGPASQNLQARGGAWDYLWGKPKALFQGGKTTFGYLGALPGVVPPVGAPLKGFPIFPGGPPLGKGFLNPFFTRGGEFLNPLGAPPKKPQ

SEQ ID NO: 79880 - DNA, 1021 bp, Zea mays
  misc_feature: Ceres CLONE 1565037
  misc_feature: Encodes the peptide sequence at SEQ ID NO. 79881
  misc_feature (919)..(919): n is a, c, t, g, unknown, or other
gagctccccgcggtggcggccgctctagaactagtggatcccccgggctgcaggaattcgtctcacccctagaaaaagactgagtggctcgggcgcggacgctgccgctcgcgatatttgctagagagagagaagagagggcccgagagccgaggacgagtgcagtctggctggcgtgatgctgcttcggagcgcgtcctcgccgctgctcagctgtgggcgcgcgccggctgcggcggcgtcggtcgagcacctcgcggctggtttcaacattgttgtcaccggcagtggcctgctcctaggcacgggtcggtgctgtgccgcgctctgttcgagggggacctcgccacgtcgctcgggtcacacattgatgatggacacgggagggcgccgaggccccccacgttcctgttcatgaccgcccccatcctccgacaagggagaacgcccagggccaggcacaaggaggagggaacttgttccccgttttcgggatccacggggcccccgcgttgaaagtaactccctgcccgccttcggtccggtttgtgggaggaaacccgggggggccggtgacgatatttcttacccctccccgggcggctttggccggtctccttctgtagggtgtgggggggtatttgggttgcccctccccgaggcgggtggggcgtgtgtataaagagcttgttgcgggccccccgctttttggactctcttcaatgggttttgtggggcttcagggggaaaatagtctcaacccgggtgggtgttgtctaacccgcggagcacgcacacacgtaaacccttctcgtttttcaagcggcgcccatttgatcgtggggggggatttgcgggggaaaacctccggatttctctcgcggggggagaaattatcccgaggctttctctccaaganataattgtgttggagcacccctcattaagggggcctttatgagttttatttataaaggggcccccccttctccccttatcccgggagaacttcccggcgttg

SEQ ID NO: 79881 - protein, 79 aa, Zea mays
  misc_feature: Ceres CLONE 1565037
MLLRSASSPLLSCGRAPAAAASVEHLAAGFNIVVTGSGLLLGTGRCCAALCSRGTSPRRSGHTLMMDTGGRRGPPRSCS

SEQ ID NO: 79882 - DNA, 839 bp, Zea mays
  misc_feature: Ceres CLONE 1565040
  misc_feature: SWISSPROT Homolog: EC 2.7.1.68 1-phosphatidylinositol-4-phosphate 5-kinase
  misc_feature (785)..(785): n is a, c, t, g, unknown, or other
  misc_feature (791)..(791): n is a, c, t, g, unknown, or other
ctccccgcggtggcggccgctctagaactagtggatcccccgggctgcaggaattcgtctcacccctagaaaaagagaagaaagagctgattaagaatctctacaataaacttcaacaagaaaaacaggatgcaggtgcagaaggagattggtttgacaattggggctatgaagtgatgatgcaccttcacggcacatggttgctgatactcaattttgagtggcagtgttcatgttaagattaatttctttccttctctccaaggcatgcatacctaaccttctcgaggacaattcaggagaatctcagttgttcctcatgtggagaacctccagaggctcacatgtattcctacactcaccgcaacgagaatctgattgttcttgtgaggcacttgctgcctaaatattgtttacctggtgaatcagaaggaaagattcggatgtggactagatgcttaaggtgtgaacgtgaaagtggggtccccagatcatcacgaagggtgataatgtcagctgaagcacactgcctttcacttgggaagttccttgaacttagtttttcaagccactcaaccgctagaaggctgccaatatgcgggcattcactcaatacggattgtgtgcgcttttttgggttgggctccaaagttgcaatgttccagtattcctcagtcgaaatttacaatgcctgcaaaccacaacctactcttgagattcacaatcccgatatgcacaaagatgccccaagggttgctgcccctcgtgtttcgtgctctgaatgntgagtnctcatgagagctgattccagttatatagagctacaatgcttccgagag

SEQ ID NO: 79883 - DNA, 807 bp, Zea mays
  misc_feature: Ceres CLONE 1565041
  misc_feature: Encodes the peptide sequence at SEQ ID NO. 79884
  misc_feature (556)..(556): n is a, c, t, g, unknown, or other
  misc_feature (620)..(620): n is a, c, t, g, unknown, or other
  misc_feature (621)..(621): n is a, c, t, g, unknown, or other
ctccccgcggtggcggccgctctagaactagtggatcccccgggctgcaggaattcgtctcacccctagaaaaaattcccccaacggacattgcctaggaggctaggacagaaccacccagagcgcacaaccttatccgaatcgccgttgcatggaggccgtgcgcgcgtcggcggcgtgggttgccagtcgctcctcccatgtcacggtcgaccttcaagaaattgagaaggtagtggaccaaatccaaggagatgttccaaaagttcagtgggattacgaaggaattcactactttgacaatgggccactcacagtccagtacctgttcgtcttggatgcactaaacttctgcttctggccagataaggacttgagctatgaccatttggcttctggactgaagtcagccttggagaaagacaaaaatgcccttgattcagatcgtctccagaattacactgggccccagctccgccaacttctgaaactggcacgaccactgccaattttgagagaaagagtacgccttctccacgaggtggggcaggaactnaaagaagctttggaggtcaggctgctatctagtggagtctgctggaaactctgctgcaactctnnatgaactgattactcgacattttccctggttcccgggaccattcactctccaaggggcaccaggttttcttgtcaaaaaaaccccaatctttggtggctaattttgggggggccctcaagggaaaaaactttggggaagtccccaatttcaatccccccccccttttttcgggaaaaattggtccc

SEQ ID NO: 79884 - protein, 156 aa, Zea mays
  misc_feature: Ceres CLONE 1565041
MEAVRASAAWVASRSSHVTVDLQEIEKVVDQIQGDVPKVQWDYEGIHYFDNGPLTVQYLFVLDALNFCFWPDKDLSYDHLASGLKSALEKDKNALDSDRLQNYTGPQLRQLLKLARPLPILRERVRLLHEVGQELKEALEVRLLSSGVCWKLCCNS

SEQ ID NO: 79885 - DNA, 906 bp, Zea mays
  misc_feature: Ceres CLONE 1565044
  misc_feature: Encodes the peptide sequence at SEQ ID NO. 79886
acccgcggtggcggccgctctagaactagtggatcccccgggctgcaggaattcgtctcacccctagaaaaactctactgctcgtgtctgaaagtttctgtgtcgactgccgagcgagaacgagaagacaagaggaagccaaatggagaaccgagttcgggagggagcggatggcaatgcctctgcttccgctattgctctcggtcctcatcgtctcctgcgtcgcgcactcgccggcctcgtcgccgtccgcgtcgaatgctcctccggtcagcgcctcggctccgcggggctctgtcgcgccaccgacaacggcggtctcggcgccgcaggcctctgtcgcggcaccgacaacggcagcctcggcgccgcaggcctctgcagcgccacccacgactactgcggtctcggcgccaacggtctctgtcgctgcacctcaggcctctgcacagccgccagcaccagttttcccgtccgcaccccaggcgtcggccgggtcaacaacaaaggcagccgccgccgctcaggtctcagccggcggcgccggcaacagcaaccttgaccccaaaataaatgagtcttctgcgcgccaaggcttagtccgcggtaccgacaaaagcagccttgccgccacatggcttttttttgccggggccaacttaatctgcccgctgccgccccagggcctctgtcccccagaaccttcctaacggggggcgccccacacccgcggaccggaaagtttgctttttcccccaccttggtctcccccgctttgccctcccgggtgttcctcccccccaaccttgggccgcctagagccccccttgttttttgtgtaaaatccttccgaacggaagggtgtgccttccgcgtgtgggagttttttctttacgggatcggccg

SEQ ID NO: 79886 - protein, 177 aa, Zea mays
  misc_feature: Ceres CLONE 1565044
MPLLPLLLSVLIVSCVAHSPASSPSASNAPPVSASAPRGSVAPPTTAVSAPQASVAAPTTAASAPQASAAPPTTTAVSAPTVSVAAPQASAQPPAPVFPSAPQASAGSTTKAAAAAQVSAGGAGNSNLDPKINESSARQGLVRGTDKSSLAATWLFFAGANLICPLPPQGLCPPEPS

SEQ ID NO: 79887 - DNA, 1000 bp, Zea mays
  misc_feature: Ceres CLONE 1565050
  misc_feature: Encodes the peptide sequence at SEQ ID NO. 79888
acccgcggtggcggccgctctagaactagtggatcccccgggctgcaggaattcgtctcacccctagaaaaaactcaattcaggctggtgttggtgctggaattgacatgctcctggttccgttcagatacgccgaattcatcgtcgatctgacgacacacgttcagaacatggccatccccatgactagaatcgagcacgccgtctacaggatcttccgtgtcacgttcaccctgggtctgttccagaacccttaccgcgactgtatcctcgtcggcgaggtctggaagcaataacgccgggaactggcacgcgaagtcgtcaggaaaatcctttttctcttgaagaatcgcaagatctcctacgctccgttgctgcccgttcccaagaaggcccccccacatctgggtcggcggggcgcccctccaaactaacctgcccaaccagtgggggggggggggacttatcacgggggaaaggaatgcgtttcggccatcgccactggtccgggggcgactaattcttattccggggaatccgaagccctcgcgttttatatccccatgcaccacagggtgggataggtcccctctgaaggacccccgggaacaagcttaaatgtatgtagtgctcaatcgaaaggccccgccactctcccgccgattttagcgggtggtatcgctggcaataccccccccttatattattaaggaaatctatgttccgggcgccccgggtcttgtatctctgtgttgaaactcctcaaaggactgtggtcgccgcggtgtcgtgggattcactcctactcgggggacgggtgagtgtgtctgcggggaggtaactcatttgtaggtattaatcccccgagaagtctccctcgggagtttgaaattagatgtcttagtgggccataacggggtgagtcatgggggtgttgtccaagcggccgggaggtttatgccggctgggaggtggtgacgtaaatatgttctgttcctcc

SEQ ID NO: 79888 - protein, 62 aa, Zea mays
  misc_feature: Ceres CLONE 1565050
MLLVPFRYAEFIVDLTTHVQNMAIPMTRIEHAVYRIFRVTFTLGLFQNPYRDCILVGEVWKQ

SEQ ID NO: 79889 - DNA, 841 bp, Zea mays
  misc_feature: Ceres CLONE 1565053
  misc_feature: Encodes the peptide sequence at SEQ ID NO. 79890
ctccccgcggtggcggccgctctagaactagtggatcccccgggctgcaggaattcgtctcacccctagaaaaaatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaggaccaaggctaagcccggcaaagccgccgctgccaagacaacgcccccaaaccgggcaagggccgcgccgccaaatcaaagaaagcaagcgctgccaagccaaaaaaagccctgctgctgggaccaaacccaaatgcccaaaaaaaaggccttggcaaaaccaaaaaatccccccccccccaaggccaagcccaaaccaaaaacggggaatccccttccctccaaaaaaggccggaaagccccccccaaaaaaaggggttgctttagggccaaacccccaaatgtggggggggggcccctttggggcccggacacaaacaaaggggtgggccccaaa

SEQ ID NO: 79890 - protein, 225 aa, Zea mays
  misc_feature: Ceres CLONE 1565053
  misc_feature (35)..(105): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPRTKAKPGKAAAAKTTPPNRARAAPPNQRKQALPSQKKPCCWDQTQMPKKKALAKPKNPPPPKAKPKPKTGNPLPSKKGRKAPPKKRGCFRAKPPNVGGGPLWGPDTNKGVGPK

SEQ ID NO: 79891 - DNA, 880 bp, Zea mays
  misc_feature: Ceres CLONE 1565054
  misc_feature: Encodes the peptide sequence at SEQ ID NO. 79892
ctccccgcggtggcggccgctctagaactagtggatcccccgggctgcaggaattcgtctcacccctagaaaaaccctcccggcctcccctcccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgccagcaagcaccagcgcctcccgctcgaggcgctctccgccaagctcccgcgctgcgacgtctgccaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctggagcgacgcctgcgacgcccacgactccgaccaacaggccccgcccaaaggcaaccatcgagccaaccggaggcggccgtttccgccaggggtgcagcaggtgccctcccccggccgaatttcctgccgcaagggctggggccgtgcaacaagcccctggacatttctccaaactacaagttcaggcgaacaagctggcacaagggagcccaacgcccggggttcagaggaactctggatggggttcggccaaaaatcggaccctctttccagaaagaaggggggcccataaggccaactaaggaatcttttgggcgggagaagtccc

SEQ ID NO: 79892 - protein, 208 aa, Zea mays
  misc_feature: Ceres CLONE 1565054
  misc_feature (1)..(47): Pfam Name: zf-B_box Pfam Description: B-box zinc finger
  misc_feature (52)..(99): Pfam Name: zf-B_box Pfam Description: B-box zinc finger
MKIQCDACEGAAATVVCCADEAALCARCDVEIHAANKLASKHQRLPLEALSAKLPRCDVCQEKAAFIFCVEDRALFCQDCDEPIHVPGTLSGNHQRYLATGIRVGLASASAWSDACDAHDSDQQAPPKGNHRANRRRPFPPGVQQVPSPGRISCRKGWGRATSPWTFLQTTSSGEQAGTREPNARGSEELWMGFGQKSDPLSRKKGGP

SEQ ID NO: 79893 - DNA, 847 bp, Zea mays
  misc_feature: Ceres CLONE 1565055
  misc_feature: Translation starting site: 117
  misc_feature (447)..(447): n is a, c, t, g, unknown, or other
  misc_feature (721)..(721): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (757)..(757): n is a, c, t, g, unknown, or other
ctccccgcggtggcggccgctctagaactagtggatcccccgggctgcaggaattcgtctcacccctagaaaaacagacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcagctgaggcggcggaaaggggagggtgccgtggccaccaagcccaaggccgagaagccgccgccgatcgggcccaagaggggcgccaaggtgaagatccttaggagggagtcctactggtacaacgggatcggcaacgtcgtcaccgtcgatcaggatcccaacacccgctacccggtnggttgtgcggttcaacaaggtgaactacgccggcgtgtccaccaacaactacgccttggacgaggtctcagaggtgaaatgagtggggccggccggctcaagggctccgcgctagctaccgtgtgattgatttgtagtagttgtgaaatgaggctgtgaagctgcatgctgtgctggctagcgtcacaacatcgatcctatgtgtaatagcataatccacataatcatatcatgtaattgcttgctttattcaccgtgtactcaataatctctnctgctctctaaaatnnngtgtatggtaaaatgtggnttttgtacatgcacataaatcgctctctgccaccaaaaaaaaaaaaaaaaacatcctgctcggcaagttcgagctctctggcatccctcc

SEQ ID NO: 79894 - DNA, 1309 bp, Zea mays
  misc_feature: Ceres CLONE 1565057
  misc_feature: SWISSPROT Homolog: EC 2.5.1.6 Methionine adenosyltransferase
  misc_feature (30)..(30): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (77)..(77): n is a, c, t, g, unknown, or other
  misc_feature (482)..(482): n is a, c, t, g, unknown, or other
  misc_feature (937)..(937): n is a, c, t, g, unknown, or other
  misc_feature (1109)..(1109): n is a, c, t, g, unknown, or other
tttatatttcgatcgattctaacccgccanctccgtacccttaccccggcccaacttnnnnnggnnnnnnnnnaaantgggactccccgcggtggcggccgctctagactagtggatcccccgggctgcaggagttcgtctcacccctagaaaaagtgccacacatccgtttgcctcttctccctcttgccggtcccgaataaagagcagcagcgcaagaggtcggtagagcgagaagaaggcaatggcggtcgagagcttccttttcacctccgagtccgtgaacgacgggcacccccactagctgtgctaccaggtgtcggacgccgagcttgacgcatgcctcgctcaggaccccgacagcaaggtggcctgtaagacctgcaccaagaccaacatggtgatggtgttcggcgagatcactacacacgccaccctggactataagaagatcttgcgcgattttaggttgttgccacccnaatcaccttccaagaacatgggcctctaacccccaccccatgcaagggggctggttaaacatttgggccagacattcccccttaatatttgcacaggggtgttgcgtaagggctattttttcccaaatccggcccttaagaaaaaaccgggtgtcggttcaatcccctgggggcccatacattttatcttggcgtaaccccctcactccgaccagagaacccctcctccggaggccacgcatattgcccgtcgttagataaactcctgttgcccgctttgtgggccatcttaaccacatatactatgaagagacgagttcttttgccccctctatattatcttgaggagggagcttgatccgctcacaaggaaaaaattgaatcgtttactccttgtgtcgacgccccatcgatagcggtataaatagagtcgcccctatctcgctggcccgatngacacctctcctccgggtcggagctccatttgtttggaaattataagtttctggtcataccccacgatgcgcttttgtgttccatctttggttatggtgagtggacgtgggttatccagctggtgtgaacacacctctcgaggggtttcttctttctttagtgtacaccgtnctgatcgagcatagcgtcacatgcagctctcatctcacctactacgctgcgcgagaaagagtatagctttcgggctctgatattccatataggatgcttccacctctatattttcgtctgcatcctcccgctattactttagtgtgaagagcgaactcgtcactatactagatcatagacactacatataattctttctc

SEQ ID NO: 79895 - DNA, 794 bp, Zea mays
  misc_feature: Ceres CLONE 1565058
  misc_feature: Encodes the peptide sequence at SEQ ID NO. 79896
acccgcggtggcggccgctctagaactagtggatcccccgggctgcaggaattcgtctcacccctagaaaaaactcacccagcaccgcagagctctcatcctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccccgggccgccgccaagccgaagcccaagtcccagaaccgctgtgaagaaagcccaggcccgtgccaaagaagccccaaggccgccaccccagccccaagccgaagctcaaaggccaagtcccccccgcccaggcctaaccccgcccccaaaaccccaagcaaccgcccaaagccccgccccctaaacccgaaaccccgcaacggggccaagccccaagggggggccccccaagcccaaagggccaaacccagcttgccaagggttaaacccca

SEQ ID NO: 79896 - protein, 135 aa, Zea mays
  misc_feature: Ceres CLONE 1565058
  misc_feature (49)..(119): Pfam Name: Linker_histone Pfam Description: linker histone H1 and H5 family
MATEVAETPAPLAEAVPETPAEAPAAPAAEAKPTKAKKASAPKKRANPTHPPYAEMISEAVTSLKERTGSSQYAIAKFVEDKHKDKLPPNFRKLLLGQLKKLVAGGKLTKVKNSYKLPARAPGRRQAEAQVPEPL

SEQ ID NO: 79897 - DNA, 1024 bp, Zea mays
  misc_feature: Ceres CLONE 1565059
  misc_feature (537)..(537): n is a, c, t, g, unknown, or other
  misc_feature (690)..(690): n is a, c, t, g, unknown, or other
  misc_feature (1024)..(1024): n is a, c, t, g, unknown, or other
ctccccgcggtggcggccgctctagaactagtggatcccccgggctgcaggaattcgtctcacccctagaaaaattccaagtcgagatcagtggccgcttcatcaggaccgtctcaaactggccagtactcaccccgccgcattcagggacagggagctcgtgcgcgcgccccaactgcgccgacgcgatgcgggccaaggttcctcttccctcgcctccgctgcggggttctttcaatgacgatgctatgaaaccgtgtcctacgtagctttgcggacgtagtctttttctaggttttcgccgatggctgtgcgtggccagaggcgacaatccctgcgaggtggtggctttgggccccagatccgccttgttcgtcttgatggacgaggatgcccccgccccacgggtcaaggagcactccgcagtattcccctgacaaaggcccctattgcgggtcccctggttgaagccccaaaacggaaacaaaaaactgcatacccgacgtctacgtccagccgcacaccgaagaacatttnggagggaaacaatccccttccgtcaaacaagccctctcgtgacagggaatgctcccgcacccgctcggggggttctctaaacgaaaccaatgcgcttgggattttcccccccgccccctatgtcaaccactttttcctaaacaggtttacgtnttcccgaagatttccgtgcccttccccggaatatatcccggatattgaaaacaacacaggcggaacctccccccctcttctagactttcaacgagaaacacggcgctttaattcacgaattcctccgaacaccccctttttcttttgtttcaaacaaaatccccccgtcgcccacacccatttgccgacccgcttggggccggtccctccctatcgaaaatttgcgcgatttcctatgaggaaccggcttcctgtcatacccagggataaaaccccggggcgcactctctccctggggataaaaaacctttccccccccccgtagtgtaggccn

SEQ ID NO: 79898 - DNA, 953 bp, Zea mays
  misc_feature: Ceres CLONE 1565062
  misc_feature: Encodes the peptide sequence at SEQ ID NO. 79899
  misc_feature (704)..(704): n is a, c, t, g, unknown, or other
  misc_feature (897)..(897): n is a, c, t, g, unknown, or other
tccccgcggtggcggccgctctagactagtggatcccccgggctgcaggaattcgtctcacccctagaaaaaatacgcctgcctgcccacccacctccccttttccttcctcttcgccccagcgacgcggccgcccggagaccgagcgaggcaggcaactaaccaccgagaggcagggacaggaacaggaagccggaggcgaagatgtcgtcggtgttcagcggcgatgagacggcccccttcttcggcttcctcggcgccgccgccgccctcgtcttctcatgcatgggcgccgcgtacgggacagcgaagagcggcgtcggcgtggcgtcgatgggtgtgatgcggccggagctcgtcatgaagtccatcgtgcccgtggtcatggctggtgtgctcggcatctacgggctcatcatcgccgtcatcattagcacggggatcaaccccaaggccaagccctactacctctttgatggctacgcccaccttttgtcccgggcttggctgggggtctccctgggcttggcaactgggaagggccattcggcatttgtcggggaatgcctggaatcaggggcgaaagcccccaccacccccaaagcctttttccgtccgggaaggggtacccccatcccccatttttttggcgcaaaagcgcctggcatcctcccatgggggctcacttcgcgggggaagtatanccttttcctcgccccccgctcgggtacaacccgcgcgggggggagatttggggccccgcgcacttcctgggagtatacccccccccgctttatttaattgttaatttggaggaaagagatggaaccacgtatcccctatggcgcaggtgatgactcccggtgacgggttaataagagtagctactcaaaagcnagagagaggggtggcttctctctccccgcgcggttttatggatattagattagatg

SEQ ID NO: 79899 - protein, 198 aa, Zea mays
  misc_feature: Ceres CLONE 1565062
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase
  misc_feature (167)..(167): Xaa is any aa, unknown, or other
MSSVFSGDETAPFFGFLGAAAALVFSCMGAAYGTAKSGVGVASMGVMRPELVMKSIVPVVMAGVLGIYGLIIAVIISTGINPKAKPYYLFDGYAHLLSRAWLGVSLGLATGKGHSAFVGECLESGAKAPTTPKAFFRPGRGTPIPHFFGAKAPGILPWGLTSRGKYXLFLAPRSGTTRAGGRFGAPRTSWEYTPPRFI

SEQ ID NO: 79900 - DNA, 853 bp, Zea mays
  misc_feature: Ceres CLONE 1565066
  misc_feature: Encodes the peptide sequence at SEQ ID NO. 79901
  misc_feature (681)..(681): n is a, c, t, g, unknown, or other
ccccgcggtggcggccgctctagaactagtggatcccccgggctgcaggaattcgtctcacccctagaaaaattttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcaaatgagggtgtccgttctttctacaagggtttgtctgccggattgctgaggcaagcgacgtacacgactgctcgtcttggatcctttagggttctaactaacaaagcagttgaaaagaatgaagggaagccattgcctctaattcagaaagcttttattggtctgactgctggagcaattggtgcttgttttgggtagtctgctgatctggcactcattagaatggcagccgactcgaccctgccagctgcancacgacgcaactataagaatgctttccatgcactctaccgtatcagtgctgatgagggaggtcttgcgctttgggagggggcagggtccactgtgggtgagagctatggacttcaataggggaggcctgcctccctaggaccgagtggtcgagctatttaggggacaatttg

SEQ ID NO: 79901 - protein, 133 aa, Zea mays
  misc_feature: Ceres CLONE 1565066
  misc_feature (23)..(108): Pfam Name: Mito_carr Pfam Description: Mitochondrial carrier protein
MADAKQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACFG

SEQ ID NO: 79902 - DNA, 836 bp, Zea mays
  misc_feature: Ceres CLONE 1565068
  misc_feature: Encodes the peptide sequence at SEQ ID NO. 79903
  misc_feature (722)..(722): n is a, c, t, g, unknown, or other
  misc_feature (727)..(727): n is a, c, t, g, unknown, or other
ctggagctccccgcggtggcggccgctctagaactagtggatcccccgggctgcaggaattcgtctcacccctagaaaagttttttctcttctcttgctccgcaaaccagcgcaagcccttccctgacagcggcggcgacatggtgctcgaggcgacgatgatctgcatagacaactcggagtggatgcggaacggcgactacgccccgtcgcggttccaggcgcaggccgatgccgtcaacctcatatgcggtgccaagacccagtcgaacccggagaacacagtaggcgtgatgacgatggccgggaagggcgtccgcgtgcttgtcactcccaccagcgacctcgggaagattctcgcctgtatgcacgggttggaagttggtgctgaggcaaacttggctgcagcaatccaggttgctcagcttgcgctaaagcatcgccagaataagaggcagcagcagaggattatagcattcatcggaagtcctgtgaagtacgacaagaaagttttggagacaatcgggaagaagctgaaaaagaacaatgttgctcttgacattgttgactttggtgaatccgatgatgaaaagcctgagaaactggaagcattgatcgctgctgttaacagcagtgatagcagtcacattgttcatgtccctcctggtgaaatgctctttctgatgtcctctaagcactcctatattactggtgaagaagtnaaaantggttttgctgcttccgcagcagctgccgtagctactggagcatctggattttgaatttgtgtgggaccccaatgtagatccagagttggccctcgcccctgcggttgt

SEQ ID NO: 79903 - protein, 213 aa, Zea mays
  misc_feature: Ceres CLONE 1565068
  misc_feature (196)..(196): Xaa is any aa, unknown, or other
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGESDDEKPEKLEALIAAVNSSDSSHIVHVPPGEMLFLMSSKHSYITGEEVKXGFAASAAAAVATGASGF

SEQ ID NO: 79904 - DNA, 728 bp, Zea mays
  misc_feature: Ceres CLONE 1565073
  misc_feature: Translation starting site: 135
  misc_feature (337)..(337): n is a, c, t, g, unknown, or other
  misc_feature (359)..(359): n is a, c, t, g, unknown, or other
  misc_feature (403)..(403): n is a, c, t, g, unknown, or other
ctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgaagctacctcaccnggcgagttccccggcgactacngctgggacaccgccgggctgtcccgcgaccccgagacctttcgncaaagaaccgcaagcctgaagggtgatccactccccgctgggcatgctccgggcgcctcggttgcttcttccccaaactggctccccccaaaaggggttaaaattttgggcgaaggcccctctgggttcaaaggcccggctcccacaaaattttcacaaaggggggggggggaaacccctggggaaaccccccccttgtatccccccccaaaaaaaaccctcccccctttggggccccccccaaggttgtgtctctaggggggccccccccaaaggggaaccccctttttttgcgggggggggcgccccctccgaaaagaaaatc

SEQ ID NO: 79905 - DNA, 841 bp, Zea mays
  misc_feature: Ceres CLONE 1565074
  misc_feature: Encodes the peptide sequence at SEQ ID NO. 79906
  misc_feature (556)..(556): n is a, c, t, g, unknown, or other
  misc_feature (596)..(596): n is a, c, t, g, unknown, or other
  misc_feature (684)..(684): n is a, c, t, g, unknown, or other
ccgcggtggcggccgctctagaactagtggatcccccgggctgcaggaattcgtctcacccctagaaaaagcagctcattcgccgaggaaacgagatcctctagaggtttgtgctgtttagcgtgagtttttttggggccgatttgctttgctcgcatgggggatcatgtcgcggtggatgttggggagctcgtagcgtcccgagtcggtgaggcagcggggctagtgtccggcgccaaggaggaaacagaggcgctgattgggatggtggagtgccgcatttgccaggaggaggacctcaggaagaacctcgagagcccctgcgcttgcaacggcagcctcaagtatgctcacagagaatgtgtgcaacgatggtgcaatgagaaaggggatacaatctgtgaaatctgccatgagttgtacaagcctggttacactgccccaacccaggtgcatcatgatgaaactaccatagagataagtggtggagattggaccatctctggcaaccgtttggatttacatgatcctagaatattggcaatggctgctgctncacaccgtctacttgaagacgactatgatgaatatactgncacaaacaacaacgctgctgcattttgccgctctatatttctgattttgatggcccttttgctcctgaggcatacactgaccattacntacagcgatgatgaagatgatgcatctgctatttttctcgctattttctttgagagccgctggatttttgctgccatgctatattatgggctggggctattagatcatgcaacgtcaaaaacaagacgggaagaaccatgctattcccaacggagtg

SEQ ID NO: 79906 - protein, 228 aa, Zea mays
  misc_feature: Ceres CLONE 1565074
  misc_feature (40)..(85): Pfam Name: zf-C3HC4 Pfam Description: Zinc finger, C3HC4 type (RING finger)
  misc_feature (134)..(134): Xaa is any aa, unknown, or other
  misc_feature (147)..(147): Xaa is any aa, unknown, or other
MGDHVAVDVGELVASRVGEAAGLVSGAKEETEALIGMVECRICQEEDLRKNLESPCACNGSLKYAHRECVQRWCNEKGDTICEICHELYKPGYTAPTQVHHDETTIEISGGDWTISGNRLDLHDPRILAMAAAXHRLLEDDYDEYTXTNNNAAAFCRSIFLILMALLLLRHTLTITYSDDEDDASAIFLAIFFESRWIFAAMLYYGLGLLDHATSKTRREEPCYSQRS

SEQ ID NO: 79907 - DNA, 770 bp, Zea mays
  misc_feature: Ceres CLONE 1565078
  misc_feature: Encodes the peptide sequence at SEQ ID NO. 79908
  misc_feature (42)..(42): n is a, c, t, g, unknown, or other
  misc_feature (332)..(332): n is a, c, t, g, unknown, or other
ctccccgcggtggcggccgctctagaactagtggatcccccngggctgcaggaattcgtctcacccctagaaaaacagaaaaaactcaccgggaagaaggaaccagaagctaaccggcacgtcgtgaagctaaccgggattccgggaagcagagacgtccgcccgtcgcccgtcgtccgtcgtcatggccgccgtggaggtgtgcgtgaaggccgccacggggaagcccgacacgctcggcgactgcccgttctcgcagagggtgctgctcacgctggaggagaagaaggtcccctacgaggtgaagctcgtcgacctcgacaacaagcccngaatggttttctgaagatcagccccagaagggtaaaggtgccctgtgtttcaaacgggtgggtgatggggcgaatgcaattgcctgaattctggaggtaaatcaccccaaaaccattttgaggagaaattcccaacctccattcttctgggtcaccttcctggtagaaaatatgccatcacggggggaatccaaagattttttccccggcccttttaattaaatttttttttttaaaaaaaccaaagggaagggcccaagggggaaaggggtttccccgaaaaaaaaggggggccctttcttttggggttaaaaaaacttttctccgggggcccatttggggaaatataaaaaccttttcttttctaaaaaaagtctctcttttgggggggggcccccccctctttttattttataaaaaggggggggggtgggagaa

SEQ ID NO: 79908 - protein, 53 aa, Zea mays
  misc_feature: Ceres CLONE 1565078
  misc_feature (50)..(50): Xaa is any aa, unknown, or other
MAAVEVCVKAATGKPDTLGDCPFSQRVLLTLEEKKVPYEVKLVDLDNKPXMVF

SEQ ID NO: 79909 - DNA, 839 bp, Zea mays
  misc_feature: Ceres CLONE 1565081
  misc_feature: Encodes the peptide sequence at SEQ ID NO. 79910
ctggagctccccgcggtggcggccgctctagaactagtggatcccccgggctgcaggaattcgtctcacccctagaaaaaaccaacgagcacctccaagccaaagcaagttgctaggtcctttgaaccagcaactgaagcttcctcgtctcatcatcgagaccagtaagcaacatggcggctaatctcaagtgggctcctgttctagccctcctcgtcgtcgttgctgccatggttggcaccaccagcgccggcaacatcgcagtgtactggggccagaacggcaacgaaggcagcctggcggacgcctgcaactccgggctctacgcctacgtcaacatcgcgttcctcacaaccttcggcaacggacagaccccagttctcaacctcgccggacactgcgaccccggctccggcagctgcaccggccagagcagcgacatccagacctgccagtcgctgggcatcaaggtgctcctctccatcggcggcgccagcggcagctacggcctctcctccaccgacgacgccaacagcgtggccgactacctgtgggacaacttcctgggcggcagcggctcgtcccgccctctcggcgccgccgtgctcgacggcatcgacttcgacatcgagaacggccagtcggcgcactacgacgacctggcgaacgcgctcaagggcaaggggagcgtgctgctgacagcggcgccgcagtgcccctacccggacgcgtcgctggggccggcgctgcagacgggccagttcacaacgtgtggatacagttctacaaacacccccgggtgcgcgtacgccaacggggtacgacaccaacctggtgaa

SEQ ID NO: 79910 - protein, 222 aa, Zea mays
  misc_feature: Ceres CLONE 1565081
  misc_feature (27)..(222): Pfam Name: Glyco_hydro_18 Pfam Description: Glycosyl hydrolases family 18
  misc_feature: SWISSPROT Homolog: EC 3.2.1.14 Chitinase
MAANLKWAPVLALLVVVAAMVGTTSAGNIAVYWGQNGNEGSLADACNSGLYAYVNIAFLTTFGNGQTPVLNLAGHCDPGSGSCTGQSSDIQTCQSLGIKVLLSIGGASGSYGLSSTDDANSVADYLWDNFLGGSGSSRPLGAAVLDGIDFDIENGQSAHYDDLANALKGKGSVLLTAAPQCPYPDASLGPALQTGQFTTCGYSSTNTPGCAYANGVRHQPGE

SEQ ID NO: 79911 - DNA, 769 bp, Zea mays
  misc_feature: Ceres CLONE 1565083
  misc_feature: Encodes the peptide sequence at SEQ ID NO. 79912
acccgcggtggcggccgctctagaactagtggatcccccgggctgcaggaattcgtctcacccctagaaaaacccaaaacctcacctcgcagccaacctctgctcggaggggaagggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacacgcagtctccaggtcgacggcaaggtcatcaaggcccagatttgggacaccgccggccaggagaggtaccgtgcaatcacaagtgcctattaccgaggagccgtaggggcactgctggtctacgatgtcacccgtcgcaccacgttcgacaacgtgggccgttggctgagggagctcagagaccacaccgaccagagcatcgtggtgatgctggtcggcaacaagtccgatctccggcacctggtggccgtctcgaccgacgacgccaaggagttcgccgaggccgagtccatgtacttcatggagacgtccgccctcgacgccaccaacgtggacagctccttctcggaggtgctgacccagatataccagatcgtgagcaagaagacggtggagtccccgaaggaggggggcggtcgccccgggcaaggggggagaagataaacgtcaagggatgacgtttctgcgatgaaa

SEQ ID NO: 79912 - protein, 203 aa, Zea mays
  misc_feature: Ceres CLONE 1565083
  misc_feature (19)..(180): Pfam Name: Ras Pfam Description: Ras family
  misc_feature (19)..(133): Pfam Name: Miro Pfam Description: Miro-like protein
  misc_feature: SWISSPROT Homolog: EC 2.7.11.1 Non-specific serine/threonine protein kinase
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRTTFDNVGRWLRELRDHTDQSIVVMLVGNKSDLRHLVAVSTDDAKEFAEAESMYFMETSALDATNVDSSFSEVLTQIYQIVSKKTVESPKEGGGRPGQGGRR

SEQ ID NO: 79913 - DNA, 831 bp, Zea mays
  misc_feature: Ceres CLONE 1565084
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (236)..(236): n is a, c, t, g, unknown, or other
  misc_feature (317)..(317): n is a, c, t, g, unknown, or other
  misc_feature (678)..(678): n is a, c, t, g, unknown, or other
  misc_feature (679)..(679): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnccaaaactggagctccccgcggtggcggccgctctagaactagtggacccccgggctgcaggaattcgtctcacccctagaaaaaaaacactcgtcgatctacacacatacatagtttcttctactacacgacgacaaacatgggggaagcctngcgaagatcggagagtggggtggatacgccggcgatcgtcgggatctgagggctactccggaacggctgaccgaggtgaanggtcacggcggaacacagcagctgcatcccgctcatctccttcatctacatcggagccgaatggcaagccgtacgaggagggggccatgggggttttccggcccaatggctggggccccgggaaagtacaaaaatttgatttcttggggcaaggtttttcaaaacaaaaaaacctttttacaggggaaaaattttcccgggggaaacacacgggggccccccccccctaaaaaaaattttttggaaaaaaatattttgggggaaaaaaaaaattcccttccaaaaaaatttgtgttttccccccccaaaaaaaaaaaaaaggggtttttttttttttttgggggaccacctcctttttttnnggggggggggggggggaaaaaaaaaaagagggggggccccccccccccccccccctttttttttttttgggggggggggnnnnnnnngggggggggggggggtggggagttaaaaaaaaaaaaaaaaaaaaaaagaaaggcggggccccccc

SEQ ID NO: 79914 - DNA, 840 bp, Zea mays
  misc_feature: Ceres CLONE 1565087
  misc_feature: Encodes the peptide sequence at SEQ ID NO. 79915
  misc_feature (768)..(768): n is a, c, t, g, unknown, or other
tccccgcggtggcggccgctctagaactagtggatcccccgggctgcaggaattcgtctcacccctagaaaaattcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagcgctaaaccagtctgttaatcttttcttggaaattggtaggttgaacatggctgcaagatacagcaaggacattggtgagatatatcagcaagaacaagatttagagaaggctacagattacctggaaagggcagctgacctttttgacagtgagggacagtcgtctcaatcaaacacattcaacagaaagttgcagaaattgctgctcaggttgaacagtacccaaaagcaactgaaatttttgaagcgatccctcgtcagtcaaataacaaatccttcttaagttaaggggccaaaggaatccntcttaggcctggctcggcaactttgttaagagggatccctttggccttccaaattccttgggaggatacagg

SEQ ID NO: 79915 - protein, 187 aa, Zea mays
  misc_feature: Ceres CLONE 1565087
MGDHEARGDDFEKKAEKKLSGWGLFGSKYEDAADLFDKAANSFKLAKNWSRAASVYIKIANCHLKGDSKHEAASAYVEAANCYKKFSPQEAAQALNQSVNLFLEIGRLNMAARYSKDIGEIYQQEQDLEKATDYLERAADLFDSEGQSSQSNTFNRKLQKLLLRLNSTQKQLKFLKRSLVSQITNPS

SEQ ID NO: 79916 - DNA, 771 bp, Zea mays
  misc_feature: Ceres CLONE 1565089
  misc_feature (230)..(230): n is a, c, t, g, unknown, or other
  misc_feature (231)..(231): n is a, c, t, g, unknown, or other
ctccccgcggtggcggccgctctagaactagtggatcccccgggctgcaggaattcgtctcacccctagaaaaaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggcccttccttggccacnntctagcccgcctcgggcccggcaaccggcggttcgccccaacgaaagggcgcaagcccctccaagggggggggaaggcccaaagggggcccaaatgggggtttccccccggggggcttttttcccctttccccccctcttttttttactcttttgaaaagggggggggaccccccttgggggggggggggggggaaaaaaaaggggggggttttctccccaccccccccccccttttggggggggcccccctcgggggggggggggaaagaagagaacccccccccccccaaaaaaaaaaaaccccccgcccccgggggggggggggggggcccccccccccggttgaagaaatttgccgggcggaaaaaaaaaattttttgggggtgggggtataaaaaaaaacaaccccccccccccccggcgggggggggggggagacacccacccttattctttttttttttgttttgggggggggggggggggagggccccccccccccccgccgggagaaaaaattaatttttgctgcttcccc

SEQ ID NO: 79917 - DNA, 831 bp, Zea mays
  misc_feature: Ceres CLONE 1565091
  misc_feature: Encodes the peptide sequence at SEQ ID NO. 79918
ccccgcggtggcggccgctctagaactagtggatcccccgggctgcaggaattcgtctcacccctagaaaaaaagtccgcaccgcaactgcagttggaaaaccagctcgccgccactagataatctcgtctcgccagggacgggaacggcaggccgtgccgtcacgagactcctagcgaccgagagagaggagagcgcgcacgcgcgtggtggaagagacttcgttctagagctcccgcgaggatggagcgcggcagttcctggcgactcccggcggtggtcgtcggcatccttgtctacgcggccctcttctcgccgcccgccgccgcgctcaacatcggcatccagtccgccggcgacggggtgagcaagcagcaggcgtgcagccgcacgtgcgagtcggaccactgcacgacgccgccgttcctgcggtacggcaagtactgcggcatcctgtacagcggctgccccggcgagccgccgtgcgacgcgctggacgcctgctgcatgcaccacgacaactgcgtccaggcaaagatggactacctgagcacggcttgcaacgaggccctgctggactgccctggccagctgcgggagggcacgtccacgtttcacgggaaacagtgcatgatcgacgaggtcatcgacgtgatctcgctcgtcatagagggccgccgtcgtcgccggcagggtactggcacaacccgtagccgcgccgcgcgccagggacatgttgaacgccaccttgccgttgggtgggcgaaacaatctttttttcggccttggtttaagggcggccctttccggctttggcggggccccggggct

SEQ ID NO: 79918 - protein, 196 aa, Zea mays
  misc_feature: Ceres CLONE 1565091
  misc_feature: SWISSPROT Homolog: EC 3.1.1.4 Phospholipase A(2)
MERGSSWRLPAVVVGILVYAALFSPPAAALNIGIQSAGDGVSKQQACSRTCESDHCTTPPFLRYGKYCGILYSGCPGEPPCDALDACCMHHDNCVQAKMDYLSTACNEALLDCPGQLREGTSTFHGKQCMIDEVIDVISLVIEGRRRRRQGTGTTRSRAARQGHVERHLAVGWAKQSFFRPWFKGGPFRLWRGPGA

SEQ ID NO: 79919 - DNA, 943 bp, Zea mays
  misc_feature: Ceres CLONE 1565092
  misc_feature: Encodes the peptide sequence at SEQ ID NO. 79920
  misc_feature (283)..(283): n is a, c, t, g, unknown, or other
  misc_feature (878)..(878): n is a, c, t, g, unknown, or other
ctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcangtgtggccggcctacggcaacaaagagttcgagacgctgtcgtacctgcccgcgctgtcaacggacgacctgcttgagcaagtggactacctgctgccgcaacggctggataccctggcctcgaatttcgcaaaggccggctttcttgttacgcggaaaaacttccacttcccccggggtaattacaaaggggcgctttttgggaacccaggtggaaaacctgccccatgttttggggttgaaaaaaaaccccccccccagtgtttaaaaaggaacctttccggaaaggccctttaaatatcttaccccgggaaaccctttttccccccggggtttttttgggttttttgaaaaaaattcaaaggtaaaaaccccggggggggccaaactttttttaccccctcaaaaaagcccccccgggggagagacaaaaaaaaacaggggccccccggggggggcccccccccccggggggggaaaaaaaaaaaaaaataaccccccccgggggagaaaaaaaaaaaaaagggcccgaggggggggccccctttatgttatggggttttttttttggggagcacccggaaacccccttttncgtggggggggtgccaccaccccccctttctctcccttttatttctccagaactgccccgcgggg

SEQ ID NO: 79920 - protein, 147 aa, Zea mays
  misc_feature: Ceres CLONE 1565092
  misc_feature: SWISSPROT Homolog: EC 4.1.1.39 Ribulose-bisphosphate carboxylase
  misc_feature (49)..(49): Xaa is any aa, unknown, or other
MAPTVMMASSATAVAPFQGLKSTASLPVARRSSRSLGNVSNGGRIRCMXVWPAYGNKEFETLSYLPALSTDDLLEQVDYLLPQRLDTLASNFAKAGFLVTRKNFHFPRGNYKGALFGNPGGKPAPCFGVEKKPPPQCLKRNLSGKAL

SEQ ID NO: 79921 - DNA, 843 bp, Zea mays
  misc_feature: Ceres CLONE 1565094
  misc_feature: Translation starting site: 182
agctccccgcggtggcggccgctctagaactagtggatcccccgggctgcaggaattcgtctcacccctagaaaaaactctactgctcaggtcggaaagtttctgtgccgactgccgagcgagaacgagaagacaagaggaagccaaaaggagaaccgagttcgggagggagcggatggcaatggctctgcttccgctattgctctcggtcctcatcgtctcctgcgtcgcgcagtcgccggcctcgtcgccgtccgcgtcgaatgctcctccggtcagcgcctcggctccgcggggctctgtcgcgccaccgacaacggcggtctcggcgccgcaggcctctgtcgcggcaccgacaacggcagcctcggcgccgcaggcctctgcagcgccaccgacgacaacggcggtctcggcgccaacggtctctgtcgctgcaccgcaggcctctgcacagccgccagcaccagttttcgcgtcggcgccccaggcgtcggccgcgtcaccaacaaaagcagccgccgcccctcaggtctcagccgcggcgccggcaacagcagccttgccgccaactacatcagcctccgcgccccaggcctcggccgcggcaccaacaaaagcagccttgccgccacaggcctttgctgcggcgccaactacatcagccgcggcgccgcaggcctctgccaccgcacctccctacggcgcccgcgcgcccacgaccgcagctgcttctccgcagctggctgccacgttgccctccggtttcctccccgccactggccgctacggcacctgtctctgctactctttcagccacgctacctcccgtcgcatcgccta

SEQ ID NO: 79922 - DNA, 823 bp, Zea mays
  misc_feature: Ceres CLONE 1565098
  misc_feature: Encodes the peptide sequence at SEQ ID NO. 79923
  misc_feature (769)..(769): n is a, c, t, g, unknown, or other
acccgcggtggcggccgctctagaactagtggatcccccgggctgcaggaattcgtctcacccctagaaaaaccccacaccaagaatcacacaacagcagctcaaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcatggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcagtgtgcaggtacggcgtgctcaccgtgaccgtcgagaagctgcccccgcccgagccccagaaacccaagacatcgaggtcaggtcgcctgaggtgggactaggtcgaccgatcgtggctctgaagatgtgggagcagtgccagcgaagtgtgatgacctctacctgtgtggaatgtgcgagaaatatccntatctggagtgggggtgcttctggggtgcttgtttgcttcctccggcgggtggc

SEQ ID NO: 79923 - protein, 168 aa, Zea mays
  misc_feature: Ceres CLONE 1565098
  misc_feature (60)..(160): Pfam Name: HSP20 Pfam Description: Hsp20/alpha crystallin family
MDGRMFGLETPLMVALQHLLDVPDGDAGAGGDKASGAAAGGGPTRTYVRDARAMAATPADVKELPGAYAFVVDMPGLGTGDIMVQVEDERVLVISGERRREEREDAKYLRMERRMGKFMRKFVLPDNADMDKISAVCRYGVLTVTVEKLPPPEPQKPKTSRSGRLRWD

SEQ ID NO: 79924 - DNA, 965 bp, Zea mays
  misc_feature: Ceres CLONE 1565100
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (385)..(385): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactgggactcccggcggtggcggccggctctagaactagtggatccccctgggctgcaggaattcgtctcacccctagaaaaaactctactgctcaggtcggaaagtttctgtgccgactgccgagcgagaacgagaagacaagaggaagccaaaaggagaaccgagttcgggagggagcggatggcaatggctctgcttccgctattgctctcggtcctcatgcgtctcctgcgtccgcgccagntcgccgggccctcgtcgccgtccgcgtcgaatgcatctccggtcagcgccctcggctccgcggggctctgtcgcgccaccgacaaagggcggtctcgggcgccgcaaggcctctgttccccggccacccaaaaaccggtaagacctcgggggcccccaagggccttttgggaaaggcccccccaaaaaaaaaaaaggggggggtttctggggggcaaaaaggggtttttttttttcccttggccacccaaaaggggccctttttgtggaaaaaaacccccccaagaggccccggggtttttacttcccctttttggggggccaccccccagagggggggtttttggtccccccttttttcccccaaaaaaaaaaaaaannnaaatttgtgggggccccccccataaagggggtgttttaaaaaccccgcggggcgcccccggtaaaaaaaaaaaaaaaatctttttttgcgcccccccccaaaattttattttgaaattctttttttggcgcccccaaaaaaaatttttgtgggcccccccccgtttacacaaaaaaaaaaaaaaggcccacccctcttt

SEQ ID NO: 79925 - DNA, 868 bp, Zea mays
  misc_feature: Ceres CLONE 1565103
  misc_feature: Translation starting site: 196
  misc_feature: SWISSPROT Homolog: EC 1.3.1.33 Protochlorophyllide reductase
acccgcggtggcggccgctctagaactagtggatcccccgggctgcaggaattcgtctcacccctagaaaaatccccccgcgtagaggagaggagaggaagaagaagaacccagccaaatcctcagtcctcaggctgctcacagctcgtgccgtccactctcccccgagcctgtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcccccccgtcagtgactcccgcgtcgccgtctggcaagaagaccctccgcaagggcacagcggtcatcacccgcgcgtcgtccggcctcggcctcgccacggcgaaggccctcgcggagacaggcaagtggcacctcatcatgggcctggcgccacttcctcaaggcttcgcgcgcgagccaagcggccggcatggacaaggacagcttcaccgtcctgcacctggacctcgcctccctggacagcgtctcccagttcctcagggacctgcgccagctggagatgcccttcgacctggtggttctgaaacgcccccctggaccagcccaccgccaaggagaccttcctaaacgcccaacgggttttcaaaaagaagtttggcgtaaaccaccttgggcaacttccttctttggggggaaacttcttgaggaacctcaagtccctccgaaatacccctttaaaggcccttatttttgt

SEQ ID NO: 79926 - DNA, 788 bp, Zea mays
  misc_feature: Ceres CLONE 1565105
  misc_feature: Encodes the peptide sequence at SEQ ID NO. 79927
  misc_feature (136)..(136): n is a, c, t, g, unknown, or other
  misc_feature (148)..(148): n is a, c, t, g, unknown, or other
  misc_feature (149)..(149): n is a, c, t, g, unknown, or other
  misc_feature (162)..(162): n is a, c, t, g, unknown, or other
  misc_feature (163)..(163): n is a, c, t, g, unknown, or other
tggagctcaccgcggtggcggccgctctagaactagtggatcccccgggctgcaggaattcgtctcacccctagaaaaaacagtctggggataataatccacactccacaagcagccatgggcgccacccatcacngtccctggtcgnntctctgatggcgnntccagcccaatcccgacgccgccgccgctcccgaagaccagcggaagagcgctctccgtcgcgccctgcggctccgcgtcgtcctcgtcgccgtccacttcctcgactcctcatccggtggcggcgtcggcgtcggcgggcaggagggggctgctggcgctgggcgccgggttcctggcctcggccgcgctgctgtccccggcgggcgacgccggcgccacgcgcatcgagtactacgcgacggtcggggacaagatgtgcgacctgagcctcgtcaagtccggcctcgcgtactgcgacgtcgaggtcggcaccgggcgtcagcccccgcgcggcgagctcatcaatgtgcactacaacgccagatttcccgaacggacgcctgttcgacagcagctacaaggcgcggggagccactggaccatgcgcctagggcccaggccaaaatccctcccagggcttgaaaacgggggatccagggcgggcggcgggggtgccccccccagctttgttggggggaaaaccccaacctgaaaaaaacccggcgccaccgggggtaacggggcccttaacccgggggggtgcttttccgggggaaggggaaaacccccgggaaaaacccccc

SEQ ID NO: 79927 - protein, 92 aa, Zea mays
  misc_feature: Ceres CLONE 1565105
  misc_feature: SWISSPROT Homolog: EC 5.2.1.8 Peptidylprolyl isomerase
MCDLSLVKSGLAYCDVEVGTGRQPPRGELINVHYNARFPERTPVRQQLQGAGSHWTMRLGPRPKSLPGLENGGSRAGGGGAPPSFVGGKTPT

SEQ ID NO: 79928 - DNA, 1033 bp, Zea mays
  misc_feature: Ceres CLONE 1565106
  misc_feature: Encodes the peptide sequence at SEQ ID NO. 79929
tccccgcggtggcggccgctctagaactagtggatcccccgggctgcaggaattcgtctcacccctagaaaaaagacagactaactgagcacccgctgcaaggagtccgcgcccatggcgagcaccaacattggcgtcagccacctcgcggtccatgctggccgagggcgtgcccaacggcagtcagccgcgggccacaatcaacttcacttcggcgccctactggctttggtaggaggcctcttgccccgggccaacaactaggccacccacatctaagccggcccaaaagggaaaggttctctggtctcccatgcccaaggcagaaaagtccccctcctaatgggccaaaaaggggcccctaagtcgacatcctcttagaatgggcgttctattggtacccaccggatttgtcaaatgtttttttcccgacagaaagggcattccaaaaaaaaggtatacccgggtggttggtgccgggggcatctatatgtgtatgaacatccccgtagttgttccccccttaaatcacctacgcccactatgatcagaagaatcccccccccccccccccccctcgatgttgtggggcgccccccccccccccatggtgtggtggttatcctgatacccgtttccccccacacccttaatattccctcattattctattttcctattgcatattaaaatataacccctggtaattgtccgtcagcacacaactcttatttcttgttctgcatctgtctgtgacaaacatgatattcattgttgtgtatagatattccgcgaatgtggactgccccccggtgtgtgcgcaccccccaacagccccacaaaaattagcctcataatattgtgtgaaacaacagataatatcaccttctctttggtgcataataagagttgtattcttactagctacttagtgccactctaatctttaaaaaatcgacttttctcaactcttatgtttgctttggtgacaacataattcggtccgaggagacaacagtccgctattctctaa

SEQ ID NO: 79929 - protein, 49 aa, Zea mays
  misc_feature: Ceres CLONE 1565106
MASTNIGVSHLAVHAGRGRAQRQSAAGHNQLHFGALLALVGGLLPRANN

SEQ ID NO: 79930 - DNA, 838 bp, Zea mays
  misc_feature: Ceres CLONE 1565107
  misc_feature: Encodes the peptide sequence at SEQ ID NO. 79931
caagctggagctccccgcggtggcggccgttccagaactagtgtatcccccgggccgtccgaattcgtctcacccctagaaaaaaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgccggcttcatcagctccggctccaacaccgtctacaccaagacgctgtacgccggcgacatcatggtgttcacccaggggcctgctccactaccagtacaacgccggcaccggcgctgccgtgagcctcgtccgccttcagcagcccccaccccgggtctgcagaatcaccgacttttgcgctcttttgcacaaaaccctctcgttccgccgttcgtgggagaaaggtcacccttctttggtacgaaggcggcgggtgaaggaaagcctcaaaaatttggacaacgagtggatcagcccgtattaacattcggactataactaaaaaaag

SEQ ID NO: 79931 - protein, 226 aa, Zea mays
  misc_feature: Ceres CLONE 1565107
  misc_feature (55)..(206): Pfam Name: Cupin_1 Pfam Description: Cupin
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQGKINPLIKAAVTPAFVGQFPGVNGLGISAARLDIEVGGVVPLHTHPAGSELLFVTQGTVAAGFISSGSNTVYTKTLYAGDIMVFTQGPAPLPVQRRHRRCREPRPPSAAPTPGLQNHRLLRSFAQNPLVPPFVGERSPFFGTKAAGEGKPQKFGQRVDQPVLTFGL

SEQ ID NO: 79932 - DNA, 754 bp, Zea mays
  misc_feature: Ceres CLONE 1565111
  misc_feature: Encodes the peptide sequence at SEQ ID NO. 79933
  misc_feature (540)..(540): n is a, c, t, g, unknown, or other
  misc_feature (541)..(541): n is a, c, t, g, unknown, or other
ccgcggtggcggccgctctagaactagtggatcccccgggctgcaggaattcgtctcacccctagaaaaagtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccctgccgtccgcagggcttgctatggtgttnnctcgtatgttatgggagagtggtgccaaggggttgtgaggtgattggtgagtggaaagctcagggcccaaaggagcaggtccatgaagttcaaggatggctacatgatctcatctggtcagccagtggacgagtacattgactcggctggtgagaaacgttcctcttcaaaaagggtgttcttcgggattaaaggtgaaaatcatgctttgaa

SEQ ID NO: 79933 - protein, 136 aa, Zea mays
  misc_feature: Ceres CLONE 1565111
  misc_feature (45)..(102): Pfam Name: KH_2 Pfam Description: KH domain
  misc_feature (123)..(123): Xaa is any aa, unknown, or other
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGPAVRRACYGVXSYVMGEWCQGVVR

SEQ ID NO: 79934 - DNA, 789 bp, Zea mays
  misc_feature: Ceres CLONE 1565113
  misc_feature: Encodes the peptide sequence at SEQ ID NO. 79935
  misc_feature (711)..(711): n is a, c, t, g, unknown, or other
  misc_feature (753)..(753): n is a, c, t, g, unknown, or other
ctccccgcggtggcggccgctctagaactagtggatcccccgggctgcaggaattcgtctcacccctagaaaaactccacgcagctccactccacgggctagcagcagcagcagcttccccatgcatgcaatggcgtggtggggcggcgaggagggcgagccgttattcccgtccgtggacaagtgcgacgcgtcccgcctcggtcgggactccacgctggtggcggacctggacggcgcgctgctccgctccccggacgccttcccctactacgcgctcgtcgccttcgagacgggcggcgcggcgcgcctggcgctgctgctgctgctggcgccgctggccgcggcgctgcgccgcgcggtgtcggagtccgcgggggagcgggtgctggtgttcgcggccacggcgggcgcgcgcgtcgccaacgtcgagtccgcggcgcgcgccgtgctgcccaggttctacgccgccgacgtgcgccgggacgcgtggcgcgtcttctccgcgtgcggggggcggaggctggtgctcaccgccgcgccgcgggtcatggccgagccgttcctgcggcggtacctcggcgccgacgccgtcgccggcacggagctcgccgcgtggcggggacgcgccacgggggtgggtggacgcgcgccgcggcggcgtgctcgtcggcgagagcaaggcccaggcgctgcggcagatgctcgacngccggggaggtgcccgatgtcgggctcggccaccggagatcnggattacgccttcatgagtttctgcaaggaggccta

SEQ ID NO: 79935 - protein, 219 aa, Zea mays
  misc_feature: Ceres CLONE 1565113
  misc_feature: SWISSPROT Homolog: EC 2.3.1.15 Glycerol-3-phosphate O-acyltransferase
  misc_feature (194)..(194): Xaa is any aa, unknown, or other
  misc_feature (208)..(208): Xaa is any aa, unknown, or other
MAWWGGEEGEPLFPSVDKCDASRLGRDSTLVADLDGALLRSPDAFPYYALVAFETGGAARLALLLLLAPLAAALRRAVSESAGERVLVFAATAGARVANVESAARAVLPRFYAADVRRDAWRVFSACGGRRLVLTAAPRVMAEPFLRRYLGADAVAGTELAAWRGRATGVGGRAPRRRARRREQGPGAAADARXPGRCPMSGSATGDXDYAFMSFCKEA

SEQ ID NO: 79936 - DNA, 842 bp, Zea mays
  misc_feature: Ceres CLONE 1565114
  misc_feature: Encodes the peptide sequence at SEQ ID NO. 79937
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (661)..(661): n is a, c, t, g, unknown, or other
  misc_feature (663)..(663): n is a, c, t, g, unknown, or other
  misc_feature (796)..(796): n is a, c, t, g, unknown, or other
tggagctccccgcggtggcggccgctctagaactagtggatcccccgggctgcaggaattcgtctcacccctagaaaaagagcccacaccaaaagaaagaaaccaactaaaatcccaaaagagaggaaaggcacaaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcgccgacctcaccaacgacgagttccgcgccgcgtacctcggcgccatggtccccgccgcccgccggggagcctcgtgggggggagaggtaccgccacgacggcgccgccgaggagctgccggaaactcagtttnnngnngnaaaaaaaaggggccccctcgcgccctgtcaagaacaggggcaaatgccggaagttgctgggcttttctctgcagtaagctcaagtggatagcggttaaccagatcgtcacccgggtgagatgggtgacactgntctgaaacagaacctcgtagagtgctccgactggaccgagggaaca

SEQ ID NO: 79937 - protein, 201 aa, Zea mays
  misc_feature: Ceres CLONE 1565114
  misc_feature (56)..(118): Pfam Name: Inhibitor_I29 Pfam Description: Cathepsin propeptide inhibitor domain (I29)
  misc_feature: SWISSPROT Homolog: EC 3.4.22.14 Actinidain
  misc_feature (155)..(155): Xaa is any aa, unknown, or other
  misc_feature (156)..(156): Xaa is any aa, unknown, or other
  misc_feature (157)..(157): Xaa is any aa, unknown, or other
MAALGRGLPLLLLLLLAVAGAANAAAAPGGMSIITYNEEHGARGLERTEPEVRAMYDLWLAEHGRAYNALGEGEGERDRRFLVFWDNLRFVDAHNERAGARGFRLGMNQFADLTNDEFRAAYLGAMVPAARRGASWGGEVPPRRRRRGAAGNSVXXXKKKGPPRALSRTGANAGSCWAFLCSKLKWIAVNQIVTRVRWVTL

SEQ ID NO: 79938 - DNA, 913 bp, Zea mays
  misc_feature: Ceres CLONE 1565115
  misc_feature: Encodes the peptide sequence at SEQ ID NO. 79939
  misc_feature (402)..(402): n is a, c, t, g, unknown, or other
  misc_feature (425)..(425): n is a, c, t, g, unknown, or other
ccccgcggtggcggccgctctagaactagtggatcccccgggctgcaggaattcgtctcacccctagaaaaaagctttcaggcaatgtttctgcattgcgtgcgcgtgactgcatcttccgttttcagagctcagagttttcgttgttagtttcggatgacgacctgtcgcaccgcgaacgcagccgccgtcgtccgtctcctgctgctgtgctctttctgcgccgccgccgccattgcctgcgaccctcctaatggcgccaagttcgggtacaccggctccgtcggtcccgaccactggggcgcactgagccccagcttcaggcagtgcgcgacagggacgaagcactccccgatcgacatctccacggcccaggcggtctcacaaatccgggcgctccanccgctccacagggactacaccgntggccaacgccaccctcgtcgacaacgtcgtcaacgtcgcgctgcgcttcgacggcgacggcggcgcccggaagcgtgagcgtccgccggaagctgtacccgctgaagcaggtgcacttggcactcgcctttccgagcacaacgttcaacgggccgcccgttcccccgtccagactcacatgggtcacgcccagggacgacggcaacgtttcccggggtgggccaggctcctcccggtttgggagacgcggatacctttgctccggggaaatccagaaaaaacttggccccctctcccccggaggggttccaaaaaggacaaagggccctcccggtccccccccgaaaaactcacccctgggggggcgctcagggctcttttccccccccggatataaccgttatgggggggggtggtttaccaacacccccccctggccacaagaaacattttttggggagggtcctgtccccccaagagagggagt

SEQ ID NO: 79939 - protein, 28 aa, Zea mays
  misc_feature: Ceres CLONE 1565115
MGGGGLPTPPPGHKKHFLGRVLSPQERE

SEQ ID NO: 79940 - DNA, 1205 bp, Zea mays
  misc_feature: Ceres CLONE 1565116
ggtggagagggagaggagggaggggggaggggggggagagggggacgagggtggggaagaagtgatagagtgagagagggtgatatcccgcgggggcgggcgctctagaactagtggatcccccgggctgcaggaattcgtctcacccctagaaaaagagaaccgcagagacaggcgtcttcgtactcgcctatctccgcgactcagagctttccccaattcccccccttctcccatttctcagcaccgccgccgctccccccgttcaacaacaccatcgagggagtgcatctcgatccacactcggccaggcctggtatccaggggcagaaacgcttggctgtggagctgtgctgccctcgaaatgttgtattcatggcggatgcgccgggcccccggagaccaacaccatcgggggaaatacacctaatcccggtgcgcgccccatcatccattaaagagaacggaaagacgggggggaagggcaatggtgaaaagggtggaaagaaatgagtgggggtagggggaataaagttggcgacggggagggggggagcggtgtcgatggtagaaaacagagtgaatacggggggggggggatttgtgtgagtaagatgggggaaaaaagagaagctaagagattaatggccaggggggaggtgggtggcgggtataagacttgagggggggagggaggggatagaacttaatctaccgttataggggggggttggggatgtactggtaggggggggtgaggagaggtaatgggtgagaaacggagaaaaagggtgggggggcaagctagggtaaaggggggggaaaggttggagggacgggcggactggggggagaccttcaaggtgggaaaggaggggggtgaagaaggggtgggtgtaaatagaggagtaagtgtgggaggatgccgtggggggtggtagtaataacgtgagtgatagacgtgtgtgatattgataatgtggtgatacgaaggggcgagggtgtttaaacagagaagtgcatagttgtgtgttataagatggggggcgtgtgtataaaatgatatacaacagtgaggagtttgtgtgggaggggggggtggtaaactgatcgatatagaaccagacgtgtgataaaggatgcatagtggggactacgttgtgtggaagggatgtaggggggagaagagtgggagatggggattg

SEQ ID NO: 79941 - DNA, 888 bp, Zea mays
  misc_feature: Ceres CLONE 1565117
  misc_feature: Encodes the peptide sequence at SEQ ID NO. 79942
ctcaccgcggtggcggccgctctagaactagtggatcccccgggctgcaggaattcgtctcacccctagaaaaaaaaaacactcgtctgagccaccaaacacttgctatgcccgctcctccccgcgcactgctcagcacgccgtgcccgtgagaccatggacgcgagcgcggccaccgccaggcgcaagcgcaagcgccccgacgccgacatcaccgccgccgccgccgccgccgccccggtcgccgtcgacgaggcctcggacgccgaggtcgaggagttctacgccatcctgcggcgcatccgcgacgcctcccgccggctgtgcggcgccggcgcccggcccgccccgcgcgcgccggcgtggcggcccagcttctcctgggaggacttcgcgacccccccccctggcgcgccggcgcctgagaccccgacccccgcgcagcaggagccagcgcagccgcggcccgacgagcctgtagcccgcgtccgcgctaccgccccgttcgcgccgtgccggggtgggaactgaaaagcggaaccggaaaccggaagggcccagccacccccttggttagggggggcgttccgtgcgtttactggaagcgcggcgggcgcaactcattgacaggtctcccgagcacacgcgtcaaaggtgggggccccgcatacaaaaaatttcggagttattggggaaggggcggggagtgtcacatacaaacaaagtaggggggcgtgaacctaatctccgggtgaggggaagatagacgacgagagagaagacttccccccgccggagggaaaaacagttaaatttatgttacgggaggggcgcccccccgtggggtgagcgagcggaccccagggaatggtggccacaagtgaaaat

SEQ ID NO: 79942 - protein, 124 aa, Zea mays
  misc_feature: Ceres CLONE 1565117
MDASAATARRKRKRPDADITAAAAAAAPVAVDEASDAEVEEFYAILRRIRDASRRLCGAGARPAPRAPAWRPSFSWEDFATPPPGAPAPETPTPAQQEPAQPRPDEPVARVRATAPFAPCRGGN

SEQ ID NO: 79943 - DNA, 837 bp, Zea mays
  misc_feature: Ceres CLONE 1565120
  misc_feature: Encodes the peptide sequence at SEQ ID NO. 79944
  misc_feature (281)..(281): n is a, c, t, g, unknown, or other
  misc_feature (305)..(305): n is a, c, t, g, unknown, or other
  misc_feature (308)..(308): n is a, c, t, g, unknown, or other
  misc_feature (314)..(314): n is a, c, t, g, unknown, or other
ggagctccccgcggtggcggccgctctagaactagtggatcccccgggctgcaggaattcgtctcacccctagaaaaagtgcttgcccctccctttctcttctccccttgtgtcgcgctcgcgcatctgaagcaagggggggaagggccaagggggatcggtcttgttctcggagagggttgagctgcttgacggttttgactcggatcatggtgtgcagctctatcagatagagagctgacgtgaggtgtgagacgcggatcgtggagtactactcagtnaggagaggtgggggaagggggaanaangcgatngccggggaggatggtgcttgtgcttgcgctgggggatctgccatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatccagttgttccatggggcgacctgaactccctggcgatgctccagcggcagctggacgtggactccctggggacccggcacacgcaccgttcaaggcatataagccccagggaggggtggtgatcaaccctggctctgccacggggcgccttcagcagcatccctttcgaacgggaaccccaaccttggtgctgatgaacatcgacgggctccccggtgggggggttacttcttacaacctgatttt

SEQ ID NO: 79944 - protein, 104 aa, Zea mays
  misc_feature: Ceres CLONE 1565120
MLVPGKIQHIICTGNLCIKEVHDYLKSLCPDLHITRGEHDEDARYPETKTLTIGQFKLGLCHGHPVVPWGDLNSLAMLQRQLDVDSLGTRHTHRSRHISPREGW

SEQ ID NO: 79945 - DNA, 877 bp, Zea mays
  misc_feature: Ceres CLONE 1565122
  misc_feature: Encodes the peptide sequence at SEQ ID NO. 79946
  misc_feature (213)..(213): n is a, c, t, g, unknown, or other
  misc_feature (590)..(590): n is a, c, t, g, unknown, or other
  misc_feature (591)..(591): n is a, c, t, g, unknown, or other
  misc_feature (624)..(624): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (773)..(773): n is a, c, t, g, unknown, or other
  misc_feature (794)..(794): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (829)..(829): n is a, c, t, g, unknown, or other
  misc_feature (849)..(849): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
ctccccgcggtggcggccgctctagaactagtggatcccccgggctgcaggaattcgtctcacccctagaaaaaattccatcggtggcacgagacaggagacgccaaggccatagctagagcctagagcagcagcagaggcttgacctgaagctccacccgccatggcattcacgccccctacggcctgctgcaaggcttccctggcgctggncaccgcgggcgtcgccccgcgggccggcggcctgtgcgcaaggcggcctcctctgcacgccctcccaccccctgtgtccgcggcctcggggcccccgcatccgcccgcgccgggcccgccgccggcgccggctcggcggcgtccacacgggcatagtctgcggcaaagaaggtcccaagggaaacgtggccgccccaaactcaccctcaaggagaccaaaacggcgaaagcccgtgtcgctgaacaagtttcaagggcggaaccccgtccgtgggtttacattctaccccccccgacgacaagacccccggatgcacaaaagcagggcgtgcgcgtttcagggacttcctacgaaaaagttatcaaaaaagccgggnncggagagtgatacggatttcagcgggaaataanaaaaccgggtttccacacaaggggtccccccaaaaaataccccggtggnnnggcgttaaccctctttaagcaacaaagggaacccccttctcccccaaagaaaaggggggggctccccctcctcgacacttttcgggaacttcttccgntccggggcgcccaaaagaaantnnnnnnntctttggtaaaaaaaaggggggtcgtntgaaaaacctttcaaaaacnaaacagttcgcgccnnnnnnnnnncgcc

SEQ ID NO: 79946 - protein, 32 aa, Zea mays
  misc_feature: Ceres CLONE 1565122
  misc_feature (23)..(23): Xaa is any aa, unknown, or other
MHKSRACAFQGLPTKKLSKKPGXESDTDFSGK

SEQ ID NO: 79947 - DNA, 798 bp, Zea mays
  misc_feature: Ceres CLONE 1565123
  misc_feature: Encodes the peptide sequence at SEQ ID NO. 79948
  misc_feature (183)..(183): n is a, c, t, g, unknown, or other
ggagctccccgcggtggcggccgctctagaactagtggatcccccgggctgcaggaattcgtctcacccctagaaaaaaccagtagtcgtcgcgtttgcagctaggcagatctgagttagccggcggatccgatccgtgcgcgtgcgcagtgtgtgtgtgtgtgtgtgtgtgtgtgtgtgtcnggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctcccttcaccaagggggacccgtccacggggcccttcgctcaccctcaccggccgggaaaaaagagggccaacaacctggcaacctctccaaagcttgggccaagttcccccgggggattccttcttccggcgggatctccgggggggccttgggcccactt

SEQ ID NO: 79948 - protein, 195 aa, Zea mays
  misc_feature: Ceres CLONE 1565123
  misc_feature (44)..(195): Pfam Name: PsaL Pfam Description: Photosystem I reaction centre subunit XI
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGVASLHQGGPVHGALRSPSPAGKKEGQQPGNLSKAWAKFPRGIPSSGGISGGALGPL

SEQ ID NO: 79949 - DNA, 868 bp, Zea mays
  misc_feature: Ceres CLONE 1565124
  misc_feature: Translation starting site: 341
  misc_feature: SWISSPROT Homolog: EC 2.1.1.128 (RS)-norcoclaurine 6-O-methyltransferase
  misc_feature (868)..(868): n is a, c, t, g, unknown, or other
ctccccgcggtggcggccgctctagaactagtggatcccccgggctgcaggaattcgtctcacccctagaaaaacgtcgtcgagcagaccaccaacaggtggtggtgatgattcaaccgtccaaaggtatgacgacgaaactgtcgtcgtctacaggtggaaggcagcctcccgcttcctcgtcagcgacgacgtgagcacggcgaccttggctccctttgtgagtctggcgctccagcctatcgctgcctgtccgcatgccctgggtatctccgcgtggttccggcacgagcagcacgagccgtccccgtatggcctggcgttccgccagaccccaacgatgtgggaacatgctgaccacgtaaacgccttgctgaacaaaggcatgaccccccacagccacttcctcatgccaattgtgctgagggagtgcggcgagacgtttcgtgggatcgactcgttggttgacgtctgtggaggccatggtggcgccacggatcatcatcgccgccgccttcccccacttcaagtgaagcgtgcttgacctcccgcacgttgtcgccggtgctccgtctgatggcaacgtgcagttcgtcgcaggcaatatgtttgagagtattccacctgcaaacgctgatttccttcagaaaactctacatgactggggtgactatgaatgtgtccagattttgaaaatttgcaagcaagccttatctccacaggattgcaggggggaaggtaataatctttggatgtggtagttggatattaacaggcaaacttttaagctttcagaaggcctcgcgtaatggtttgagtttcgaaaagaaccgcccgcttaaattggaatttaagcgattaccaaatn

SEQ ID NO: 79950 - DNA, 791 bp, Zea mays
  misc_feature: Ceres CLONE 1565125
  misc_feature (40)..(40): n is a, c, t, g, unknown, or other
  misc_feature (55)..(55): n is a, c, t, g, unknown, or other
ccccgcggtggcggccgctctagaactagtggatcccccngggctgcaggaattncgtctcacccctagaaaaagagacgggcgatgaccgcacgcccgcacaagctgctccgggctccgctgctaggctagggtttggactttggattggagccgcaccgccgcaccggcaccgcagccgccgcagtgccgcacagccaccactcccatcttggtcttgcggccagtcgccctcggacctcggccatcgaccccttgcccgcttgccgagacgccgagtaagcgtcgaccgtcgtcgctgtcgtcaccgaggtccagcgcccaacagcccagcttcaagcctccagccatcggcgcccgccctcctccgccgagacgccgagtgccaagcgcccaagcaccccagtccccagcgcccaacaggctagcaggctgcaggtatgcactctttgttgatgcgtccaaggagttgagctcaatggccagcaggctgcagaaactgaaggaaaaagccggcatcaagaaccccggatgagttcttattttaaaatgatcaaccataggactgttggtggaattcctaaaacctaagcctgaaaataataggttttaccgaagaatgaaactccttctgttaaaaaaataaagaattggggaattcccctccaaaacggcctcaaaaggagaaaaaaagggttcctgggaattggagaacgggggaaaaaataccccctaaaaggggcgcggaaagaaaaaaaagtgggaatccaaacccgccccccccagaaggg

SEQ ID NO: 79951 - DNA, 844 bp, Zea mays
  misc_feature: Ceres CLONE 1565128
  misc_feature: Encodes the peptide sequence at SEQ ID NO. 79952
  misc_feature (667)..(667): n is a, c, t, g, unknown, or other
ccccgcggtggcggccgctctagaactagtggatcccccgggctgcaggaattcgtctcacccctagaaaaaatcgccgccactcctatttaagagctgccggaggtgggggcagatccggcgagccgttcccgctgtccagattcaggaactagactcctccggtccggtcctccccctcccgccccgtctcgctccagcggctccacgccaccgtttgccattcactgccagaatggcgctcaacaaggagtacacgtacgcggagctggagaaggagccgtactggccgttcgagaagctgcgggtctccatcaccggggccggcgggttcatcgcctcccacatcgcgcgccgcctcaagggcgagggccactacgtcgtcgcctccgactggaagaggaacgagcacatgcccgaggacatgttctgccacgagttccacctcgtggacctgagggtcatggacaactgcctcaaggtcaccacgggggttgaccacgtgttcaacctcgcggctgacatgggtgggatggggttcatccagtccaaccactccgtcatcatgtacaacaacaccatgatcagctttaacgtgcttgaggctgctagaattaacggcgtcaagaggttcttctatgcatcaagtgcctgcatctaccctgangtcaagcagctggaaactgtagttagcttgaaagagtcccatgctttgcctgcccaagcttcagatgcctatgggcctgaaaaacctcccaactgaaggaattgtgcaccccctttcaaagggattttgggctccaaggggccggatatggggcccttttttcaacaaaaattaggt

SEQ ID NO: 79952 - protein, 175 aa, Zea mays
  misc_feature: Ceres CLONE 1565128
  misc_feature (25)..(171): Pfam Name: Epimerase Pfam Description: NAD dependent epimerase/dehydratase family
  misc_feature: SWISSPROT Homolog: EC 5.1.3.18 GDP-mannose 3,5-epimerase
  misc_feature (144)..(144): Xaa is any aa, unknown, or other
MALNKEYTYAELEKEPYWPFEKLRVSITGAGGFIASHIARRLKGEGHYVVASDWKRNEHMPEDMFCHEFHLVDLRVMDNCLKVTTGVDHVFNLAADMGGMGFIQSNHSVIMYNNTMISFNVLEAARINGVKRFFYASSACIYPXVKQLETVVSLKESHALPAQASDAYGPEKPPN

SEQ ID NO: 79953 - DNA, 847 bp, Zea mays
  misc_feature: Ceres CLONE 1565130
  misc_feature: Encodes the peptide sequence at SEQ ID NO. 79954
  misc_feature (418)..(418): n is a, c, t, g, unknown, or other
  misc_feature (419)..(419): n is a, c, t, g, unknown, or other
  misc_feature (429)..(429): n is a, c, t, g, unknown, or other
  misc_feature (430)..(430): n is a, c, t, g, unknown, or other
  misc_feature (433)..(433): n is a, c, t, g, unknown, or other
  misc_feature (436)..(436): n is a, c, t, g, unknown, or other
  misc_feature (438)..(438): n is a, c, t, g, unknown, or other
ctccccgcggtggcggccgctctagaactagtggatcccccgggctgcaggaattcgtctcacccctagaaaaagcgattccgctcttgttcgcggaaatcggcatcctcccggctaccccgggccgggaatcgaaaaggctgccgtgttctccacttctccgccttcccctgctctcctggacctccgacgcaccccaaacaccgcagagatgcagaaccctagcggccaccacaccgcgacggccgccccgtcgtcggcgccgtccaagggcaagtcgtcggcgccgaaccctagcggcaaccacgctgcgacgccggcgccatcggggacgccttcaaagggcaagtcggcggcagcgcaggccgcggctttgggccacggttcctcctcccaccaccactctgccggggtggcnngtgggtggcnnctnacncntccgccaccaccctcaagcgcaagcgcggcgtcttccagaaagacctgcaacacatgatgtatggctttggggatgatccaaatccacttccagaaaccgttgcacttgtggaagacattgttgtggaatatgtcactgacctggtgcacaaggcgcagaacgttgcctcaaaaagggggaaactcctgaccgaggatttactttatcttaaacgcaaggatttacggaaaccgcacccgggcttctgaactactgtcccataaataataagcctaagcaagcaaggaaaacctttttgacgtgaaaaaaaaaaaccctgggctaccacctaaacataggaagtttttccaaaatccgaaaaatccgccctggttacttggaaaccaagttgtaaaatgcaaccagcaa

SEQ ID NO: 79954 - protein, 64 aa, Zea mays
  misc_feature: Ceres CLONE 1565130
  misc_feature (1)..(63): Pfam Name: TFIID-18kDa Pfam Description: Transcription initiation factor IID, 18kD subunit
MMYGFGDDPNPLPETVALVEDIVVEYVTDLVHKAQNVASKRGKLLTEDLLYLKRKDLRKPHPGF

SEQ ID NO: 79955 - DNA, 842 bp, Zea mays
  misc_feature: Ceres CLONE 1565131
  misc_feature: Encodes the peptide sequence at SEQ ID NO. 79956
ctggagctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgagctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcaagctgttcaacgccgtggccgtggaggacctcatcgtcaggggagggcgcgtcggcggcgtcgtcaccaactgggcgctcgtgtccatgaaccacgacacgcagtcctgcatg

SEQ ID NO: 79956 - protein, 223 aa, Zea mays
  misc_feature: Ceres CLONE 1565131
  misc_feature (64)..(223): Pfam Name: Thi4 Pfam Description: Thi4 family
MATAAASSLLKSSFASSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCM

SEQ ID NO: 79957 - DNA, 796 bp, Zea mays
  misc_feature: Ceres CLONE 1565133
  misc_feature: Encodes the peptide sequence at SEQ ID NO. 79958
  misc_feature (548)..(548): n is a, c, t, g, unknown, or other
  misc_feature (549)..(549): n is a, c, t, g, unknown, or other
  misc_feature (561)..(561): n is a, c, t, g, unknown, or other
  misc_feature (775)..(775): n is a, c, t, g, unknown, or other
  misc_feature (776)..(776): n is a, c, t, g, unknown, or other
ctccccgcggtggcggccgctctagaactagtggatcccccgggctgcaggaattcgtctcacccctagaaaaaaaaaaaaaaaaaaaaaaagacctcatcgagaatctcacgcgtcggcgaccatggcggcgtctccgtcttctccccatgccgcccccggagttagcggccagagcctgtccccctcagcgccgtctccccacctccccaactatttcatgtggagagaatttgtctggggaggaattgcaggtgcatttggggaaggcatgatgcatccagttgacactctgaaaacaaggcttcagagtcaagctataatgacaggggctaaggctcagaagaatatattccagatggtcaggacagtttgggcttctgatggtctaagaggtttttacagaggaatcagcccaggtgttactggatctcttgcgactggcgctacatattttcggtattattgaatcaaccaaagcatgggttggagattgctaatcctaatctaagtggacactggtcacattttatcgctggagcgatggnntgatacactggnatcccttttgtctatgtgcccttgcgaagtctggaaacaaaaattgcaatttcaggcaccccaaaatcttggggcatcagctgtagcccaaaggaatatttctcaactctggggattaaaaaaaagatgggtaccccccaaagggaatgttcccaggccgggctgttcctacctgaaagacatgggcttgaagggctttatgccgaaaaccgtnntttaccccttgcacaagtcc

SEQ ID NO: 79958 - protein, 114 aa, Zea mays
  misc_feature: Ceres CLONE 1565133
  misc_feature (32)..(115): Pfam Name: Mito_carr Pfam Description: Mitochondrial carrier protein
MAASPSSPHAAPGVSGQSLSPSAPSPHLPNYFMWREFVWGGIAGAFGEGMMHPVDTLKTRLQSQAIMTGAKAQKNIFQMVRTVWASDGLRGFYRGISPGVTGSLATGATYFRYY

SEQ ID NO: 79959 - DNA, 756 bp, Zea mays
  misc_feature: Ceres CLONE 1565134
  misc_feature: Encodes the peptide sequence at SEQ ID NO. 79960
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnaaaaaactggaactccccgcggtggcggccgctctagaatagtggatcccccgggctgcaggaattcgtctcacccctagaaaaaaaaaaagccttctctagtgcaatcgcggagctacctcagctgccgtgtcctgctcagcaagcaatcaagatcgatggggcggtcgccctgctgcgagaaggcgcacaccaacaggggcgcgtggaccaaggaggaggacgagcgcctggtggcctacatccgcgcgcacggcgaagggtgctggcggtcgctacccaaggcggcgggcctgctgcggtgcggcaagagctgccggcctgcggtggatcaactacctccgggcccgaacctgaagcgcggcaacttcaccgccgagaagacgacttcatcggtcagctgcacagcctcctcggggaccaagtggtcccttaattgccgccggcgcttccgggggggggacggggcaaccagattcagaaacctcctggaaaacccccccttccgggggggaaacctcttggggccaggggggaatttaaacccccccttttaaggggaaccggcccccaatatccccccccaaaaaaccccggggaacccgtggaacccaccccctttttttttttttttaaaacccccaaaacccccccgagggccccccccccccccccac

SEQ ID NO: 79960 - protein, 132 aa, Zea mays
  misc_feature: Ceres CLONE 1565134
MGRSPCCEKAHTNRGAWTKEEDERLVAYIRAHGEGCWRSLPKAAGLLRCGKSCRPAVDQLPPGPNLKRGNFTAEKTTSSVSCTASSGTKWSLNCRRRFRGGDGATRFRNLLENPPFRGGNLLGPGGNLNPPF

SEQ ID NO: 79961 - DNA, 911 bp, Zea mays
  misc_feature: Ceres CLONE 1565137
  misc_feature: Encodes the peptide sequence at SEQ ID NO. 79962
ctggagctccccgcggtggcggccgctctagaactagtggatcccccgggctgcaggaattcgtctcacccctagaaaaaatgtgcgcggttttcccgttgttcctcctccttattgcccactcatcaccactaccgcgctactcctgctcctacagacccacacgtctcgtcgtcaccagaccctggggaatggctgccgcgctgtggacgctggtggtggcggtggccctgtcggcggcgctggcctcgaacctccccgtggcggctgcggctaccgcggcggcggacgctgcgaacgaggtgctccgcgcgcaccagctgccggggggcctgctgccggcggggatcacagcgttccggcacgacgccgccacgggagcgttcgaggcccggctggacccgccctgcacggcgcgcttcgaggtcagcctccgctacaacgccaccgtctccggggtcatcagccccggccagatcgccgaaatctccggcgtcgccgcgcaggaacctctcatgtggtttccccgtcacaacatcaaggttgaaatccccctctccggggttttctaatttaacgttcgggttccttaaaaaagaacttcccggttggccggtttttaaacgcccccccgggtttgtgaaccccaaaccttttcttgaaagggttgggaaaacttttgggcaggggggaattgcccctggggggcccccccccgccttccccccaatatgggggggaaaaaaacaaaaaagtggttttaggggccccgcgaaaactaaattttaaataatgttttttttggaagaaaaaaaagggttaatacggcacctttttttaaaaaaaaaaaaaaaagtggggggggatatctccagtgtgtttttgttggacggacaaaataaaggagggct

SEQ ID NO: 79962 - protein, 126 aa, Zea mays
  misc_feature: Ceres CLONE 1565137
  misc_feature (13)..(127): Pfam Name: DUF538 Pfam Description: Protein of unknown function, DUF538
MAAALWTLVVAVALSAALASNLPVAAAATAAADAANEVLRAHQLPGGLLPAGITAFRHDAATGAFEARLDPPCTARFEVSLRYNATVSGVISPGQIAEISGVAAQEPLMWFPRHNIKVEIPLSGVF

SEQ ID NO: 79963 - DNA, 905 bp, Zea mays
  misc_feature: Ceres CLONE 1565138
  misc_feature: Encodes the peptide sequence at SEQ ID NO. 79964
  misc_feature (160)..(160): n is a, c, t, g, unknown, or other
  misc_feature (179)..(179): n is a, c, t, g, unknown, or other
  misc_feature (190)..(190): n is a, c, t, g, unknown, or other
  misc_feature (905)..(905): n is a, c, t, g, unknown, or other
tccccgcggtggcggccgctctaggctagtggatcccccgggctgcaggaattcgtctcacccctagaaaaactctcccaaaccctcgcgccgccgctccccagcacatcgctcccagcgcgccaaatcggcggcaacctcggacccttcactcacccangctatgggcgggaagcagnagggcgggcanaaaaggggtgggggggaaaaaaaggaggccacgggccgggggggagaagcgtggggggggggggttttttttggggggccccccgcggggggtttttgcgggttcccggcgagactgggtgggggccggccaaacgctaacaagatacagcataggagaggggaagaaaatgggaggtggacggtggcggggagggggaggggggggggtaacaagggtggggggggagagtggaggggggggggggggacaagaaatgggggagaaaagaaaagaaagaaaatttatagggttggtgtgggttgcggggaggtaaaggtggggggggaggagaggagggggcggggggggccaaaggggggggggggggggggggaaggggggaggaggggaacggaaagaggggggggggaatgtgggggagtaggagaagagaaagaggaaggggtgggagggtaaagggggagatattaagggggggtgggaggtggtggtcagttgttatataaaaaaaaaaaaaaagtttattttcggggtggggggcggggggggggggatgcggggaggaggcgtaggaagaggggtggggtggagagggggggggtggaatgagggggggagtgtgggggttttcatgtagagtggatatttggtagagagatgcggcggtatgtgggggaggagaagagacgctgcgttaacgggggaagaaggn

SEQ ID NO: 79964 - protein, 161 aa, Zea mays
  misc_feature: Ceres CLONE 1565138
  misc_feature (6)..(6): Xaa is any aa, unknown, or other
  misc_feature (9)..(9): Xaa is any aa, unknown, or other
MGGKQXGGXKRGGGEKKEATGRGGEAWGGGVFFGGPPAGGFCGFPARLGGGRPNANKIQHRRGEENGRWTVAGRGRGGGNKGGGGEWRGGGGTRNGGEKKRKKIYRVGVGCGEVKVGGEERRGRGGPKGGGGGGEGGRRGTERGGGECGGVGEEKEEGVGG

SEQ ID NO: 79965 - DNA, 811 bp, Zea mays
  misc_feature: Ceres CLONE 1565140
  misc_feature: Encodes the peptide sequence at SEQ ID NO. 79966
ccccgcggtggcggccgctctagaactagtggatcccccgggctgcaggaattcgtctcacccctagaaaaagcgctagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcaagaccggcgccgtgggcaccgcccacgtccctgaaagctcccacccccgtgatcgacggcaaacattactaacgccgggtccgtgctccccaggaccgcgggacggcgaacaagggcggcaaagaccagcctctta

SEQ ID NO: 79966 - protein, 222 aa, Zea mays
  misc_feature: Ceres CLONE 1565140
  misc_feature (57)..(221): Pfam Name: PsbP Pfam Description: PsbP
MASTSCCLLHQSTARLGASPRLAAAPPRSAQLLVCKARKQEAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQVDYLLGRQAYGGKTDSEGGFKTGAVGTAHVPESSHPRDRRQTLLTPGPCSPGPRDGEQGRQRPAS

SEQ ID NO: 79967 - DNA, 794 bp, Zea mays
  misc_feature: Ceres CLONE 1565141
  misc_feature: Encodes the peptide sequence at SEQ ID NO. 79968
ccccgcggtggcggccgctctagaactagtggatcccccgggctgcaggaattcgtctcacccctagaaaaagtccacctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaagctgctgcacatctgaagggtggtgccaagaaggttgttatctctgcccccagcaaagatgcacccatgtttgttggttggtgtcaatgaggaacagtaccccctcccatggtaaacatggttttcaatggctagctgcaccaccaaactgcccttggtcccccttggctaaggcattccatggacaccttttgcattatttgaggggtttggaagacaaaccgggttcaggccctctcctgggcccccccaaaaagaattgttgagggaccccacccacggactgaaagggggcgggcttcccc

SEQ ID NO: 79968 - protein, 138 aa, Zea mays
  misc_feature: Ceres CLONE 1565141
  misc_feature (4)..(137): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVGWCQ

SEQ ID NO: 79969 - DNA, 823 bp, Zea mays
  misc_feature: Ceres CLONE 1565142
  misc_feature: Encodes the peptide sequence at SEQ ID NO. 79970
  misc_feature (643)..(643): n is a, c, t, g, unknown, or other
ctccccgcggtggcggccgctctagaactagtggatcccccgggctgcaggaattcgtctcacccctagaaaaaatgtggtgattgaacaaaggtactttgattgcgagatgttcccagcaaacgatgatcatccctcgcatgatgtggcaaggggacagaggttcgtcaaagaggtgtatgaaacactgagagccagtccgcagtggaacgagacggccctgattatcacatatgatgagcatggtggattctatgaccatgtacctacgccggtcgttggagtgccccagcctgatggaatagttgggcctgatccatactacttcaagttcgaacggcttggggtgcgtgttcccacctttctcatctcaccttggatagagaagggcactgtgatccatgaaccaaatggtccacaggatacctcgcaatatgagcattcgtccatccctgcaacagtaaagaagctattcaatttacattctaactttctgacaaagagagatgcatgggctgggacctttgagagctacttcaaaatccggaaaacaccaagaactgactgtccagagaagctcccagaagtgacgaagtcattgcgaccattttggtccaaggaagattcgtctctctcggaattnccagtggagttgattcaacttgcttcacagctccacggtgatcacgtactgaacacgtacccccgattttggcaggaaccatgattgtccggggaaagcaaacccctacccaaaggatgctgtcccccaggttccctggaaacctggcccgatttgctttttaaaaaccggtggcaaaaa

SEQ ID NO: 79970 - protein, 205 aa, Zea mays
  misc_feature: Ceres CLONE 1565142
  misc_feature (1)..(125): Pfam Name: Phosphoesterase Pfam Description: Phosphoesterase family
  misc_feature: SWISSPROT Homolog: EC 3.1.4.3 Phospholipase C
  misc_feature (178)..(178): Xaa is any aa, unknown, or other
MFPANDDHPSHDVARGQRFVKEVYETLRASPQWNETALIITYDEHGGFYDHVPTPVVGVPQPDGIVGPDPYYFKFERLGVRVPTFLISPWIEKGTVIHEPNGPQDTSQYEHSSIPATVKKLFNLHSNFLTKRDAWAGTFESYFKIRKTPRTDCPEKLPEVTKSLRPFWSKEDSSLSEXPVELIQLASQLHGDHVLNTYPRFWQEP

SEQ ID NO: 79971 - DNA, 834 bp, Zea mays
  misc_feature: Ceres CLONE 1565144
  misc_feature: Encodes the peptide sequence at SEQ ID NO. 79972
  misc_feature (408)..(408): n is a, c, t, g, unknown, or other
  misc_feature (409)..(409): n is a, c, t, g, unknown, or other
  misc_feature (425)..(425): n is a, c, t, g, unknown, or other
  misc_feature (460)..(460): n is a, c, t, g, unknown, or other
  misc_feature (461)..(461): n is a, c, t, g, unknown, or other
  misc_feature (506)..(506): n is a, c, t, g, unknown, or other
  misc_feature (507)..(507): n is a, c, t, g, unknown, or other
  misc_feature (533)..(533): n is a, c, t, g, unknown, or other
  misc_feature (588)..(588): n is a, c, t, g, unknown, or other
  misc_feature (589)..(589): n is a, c, t, g, unknown, or other
  misc_feature (606)..(606): n is a, c, t, g, unknown, or other
  misc_feature (644)..(644): n is a, c, t, g, unknown, or other
ctccccgcggtggcggccgctctagaactagtggatcccccgggctgcaggaattcgtctcacccctagaaaaaactggcgtgcggccgagccaagcgggagtagcgcgtcaggcaatggctccggcaccggtggccgctcccgtggcttcggtctcccgcccggcagctgcgctcgcccccgccggcgccgtccgctccgccagggtagcctccctgcaccctctccactcttccaccaaaatcgtgctgctgccaccacggaccggcctgctcagatccgccaggcagaggcggcgcttggcggcacggagcagcacctcggagagcagcacggatgactcccaatccccgaaacaagagaaggcgccgttcgggtacacgaaggaaagaacgtgctgctgatcgnngcctcggcgtcaccgnccttcggcgtcgggcctcaagtacggggctcagcnntcctgggagttgacccccttgcaggccgggcaacgtcgtgcagcnntgctggtggtgctcgggagacagttnggggggtgggatttctccacctacaatgtttcggggtgggcaaacaaaggacatnngacctacgcgcaccagnctcagggaactacgagaaagcaagtcatgggagaaacngctgggagagcttgtcgggaggctgaagctgcaagctctgctcgagcaagtggaaagaagagaagcagcgcgtgcctcaagtccccggaagagctaacgctattacttcagaagaaatgatgatccgtctatatctgccaaatggacacgactagcttgttatagcatagctcactcatagctactcatc

SEQ ID NO: 79972 - protein, 95 aa, Zea mays
  misc_feature: Ceres CLONE 1565144
MAPAPVAAPVASVSRPAAALAPAGAVRSARVASLHPLHSSTKIVLLPPRTGLLRSARQRRRLAARSSTSESSTDDSQSPKQEKAPFGYTKERTCC

SEQ ID NO: 79973 - DNA, 800 bp, Zea mays
  misc_feature: Ceres CLONE 1565146
  misc_feature: SWISSPROT Homolog: EC 1.2.4.2 Oxoglutarate dehydrogenase (succinyl-transferring)
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (781)..(781): n is a, c, t, g, unknown, or other
ggggggggcggnnnagggnnnnnnnnnnnnnnnnnnnnnnnnnnnnnnnnnnnnnnnnnnnnnnntttnnnnnnnaaaactggagctcacgcggtggcggccgctctagaactagtggatcccccgggctgcaggattcgtctcacccctagaaaatatgggaagctcagtttggtgatttttcaaatggagctcaagtgatatttgatcagttcctgagtagtggggagtcaaaatggctccgccagactggccttgtcgtttgcccttcctcatggatatgatgggtcagggggccttgaaacatttctagtgcaagattggaacgcttttcttcaaatgaattgatgacaaccccttatgtttattcccccaaaaatggatccaacccttggcggaaaaccaaatccccccccatggccaaatttggggagggggcccttttaaattgttaaaaaaaccccccccggccaaaaattttttttttcccccaaggttttttttgggggggggtcccccccccccaaaaaaaaaaaaccccccgcggggggggaataccttttcccggggaggaaaaaccccccccctttataaaaataggggggagaaaaaaatcccccccccccccacacaaaaaaaaaaaaaaaaccctcctttttttttttgtgcggcnnnnaaaaaaaaaaaaaaacaccctctccaacaaaaatttttcaaaaaaaaaacaacccactttttttggaaaaaaaaattatttttttggaaagagaaaattctaaancgggcgggggggggggggc

SEQ ID NO: 79974 - DNA, 918 bp, Zea mays
  misc_feature: Ceres CLONE 1565147
  misc_feature (849)..(849): n is a, c, t, g, unknown, or other
ctccccgcggtggcggccgctctagaactagtggatcccccgggctgcaggaattcgtctcaccccagcaccataaccaccgccgccgccagagccagcaccaccaccgtagcctccaccagcgcctccgccgtagccaccaccggcaccaccaccagctcctccgcctgtaggcgcctccggctccggcgccacctcctgcacctccaccgtatccaccaccagctcctccaccatagccgcctcctgcaccggcacctccgccatagccgcctccagcgccacctcctgcgacagcgcctccgccagttgcgccacccggacctggctcaccaccagctacttcttcggcaacaaaaacaccgccttccacggggaccaccaccaaagcccccttcctccggcttttaccaacgggcgaaagacttcccccgggaacccccccccaagggccccccccctcccccccgcaaaaaacttaccttaaaggtttataatttaaaggggccccccctctgaatatcggggaaggggagggtaactttgggcgttttcatgtcatgtgtcacctcggggaaaaaaacaggccaacaaagggggtttaaatgggtttttcccccgcggggaaagaggagcctccggggggagaataccccggggcgccaagggttttctcccaaaaataaaaactgggggttttttccccccccagggaaaattttttcccccggcgcccggaaaaaaaaaattaggggggttttttatttttttggaaacaccccccgaaaaagagaggggacccccttcttggggggcctccctaaataaaaagtgggggggggggatctncagaaaaaaaaaataaaaaaccagtggggccccctttgcgggataaccaatttatactccccctaaaag

SEQ ID NO: 79975 - DNA, 841 bp, Zea mays
  misc_feature: Ceres CLONE 1565148
  misc_feature: Encodes the peptide sequence at SEQ ID NO. 79976
  misc_feature (822)..(822): n is a, c, t, g, unknown, or other
  misc_feature (837)..(837): n is a, c, t, g, unknown, or other
  misc_feature (841)..(841): n is a, c, t, g, unknown, or other
ctccccgcggtggcggccgctctagaactagtggatcccccgggctgcaggaattcgtctcacccctagaaaaatatacagagcactgacggtcgtcgtacacagatcatgatgctgctccaacgctcttcgtcagcctctgcaactgctaccactcgtgggctaatcactatcatcagcatcaccgccgccgcgtcctaccgctcgccccaggcgcgcaagcctcctgcatacacaacatcgcgggccaagacacatgctacaggcgttggcaccaaccgcgcgggcgatgcgcttctctcagaccaggctgcgccgtgagtcactgccacgacacgtcgcggtggcgtatggaccgaaactcgcggtgggccacgcgaacagagggctgactcccgcggacggtcacaatgtccggggacacaacctgtaacgagtcgttgcactgtctcacgcatggggcatccgcgcactcacggccttcctctgctcacgcaaaaacttgagacgcccccaaggagatgtccaatacatgaggggcttgtcctactggctgatatgcgacaacatcaactagatctcgatgcacgggatccgactgcaggttatatgcgacgccgagaagatgccaccctctctgcagagcgcaccggcgcatgccgacgatgccacgagacattactcgcacctgcacgtgatgctagccagctgatacagcgggctatgggacatgggtcatgctctgcaaggagcttgtccgggacgttctagcaaacctgctcattccagagacatcgaacgagtcgatcatggtcagcaagntcgtgacgacgcctnctgn

SEQ ID NO: 79976 - protein, 47 aa, Zea mays
  misc_feature: Ceres CLONE 1565148
MRFSQTRLRRESLPRHVAVAYGPKLAVGHANRGLTPADGHNVRGHNL

SEQ ID NO: 79977 - DNA, 965 bp, Zea mays
  misc_feature: Ceres CLONE 1565150
  misc_feature: Encodes the peptide sequence at SEQ ID NO. 79978
  misc_feature (865)..(865): n is a, c, t, g, unknown, or other
acccgcggtggcggccgctctagaactagtggatcccccgggctgcaggaattcgtctcacccctagaaaaaactctgctgctccagtccgtacatttctgtgccgactgccgagcgatagcgattatgacttgaggacgccaaaaggagaaccgaatgcgggaggcagccgatggcaatggctctgcttccgctattgctctgacacctcatcgtctcctgcgtcgcgcactcgccggcctcgtcaccgtccgcctcgaatgctactccggtcagcgcctctgctgccgggggctctgtatggccaccgaccacggcggactcggcgcaccaggcctctgtctcggcacctacaacggcaaccacgcgctcgtacgtgatctgcagagttgccccaccactacggcggtctccagcgccaagcggtctctgttgctgcagaaggaaggtctctgtcgcagaccggcacttggaaggttatcccattgcccgaccgcccggagtctgggcgccgtctgtgaataaaaaaacaaccctagcaggcgcctttgagatatttggcctgcgccgtggcgattgtaaacaggaaggcccttttgccggtcttaaattgcataggggcccctccagaagcccttcccagggcaagcggggtcgccctgggtttccaaacccaaaaaggggaaacccctttatcctcccccagaaagacctcttttaaaatacacccctggcgaaaggtatatatttagccttcccgggggccactctcaagaccgggtgtccctaacgggagaggggttcttaaccgggtcttcccgggcgtgctacaaggggaaattggtggggagtgggttatatcacnctcctttgccctgggccggggtaagtgattgtctggagcctcctcgggcgggcaaatttgggaaagaaccacgcatctctttttctctaaggaaacaaat

SEQ ID NO: 79978 - protein, 122 aa, Zea mays
  misc_feature: Ceres CLONE 1565150
MREAADGNGSASAIALTPHRLLRRALAGLVTVRLECYSGQRLCCRGLCMATDHGGLGAPGLCLGTYNGNHALVRDLQSCPTTTAVSSAKRSLLLQKEGLCRRPALGRLSHCPTARSLGAVCE

SEQ ID NO: 79979 - DNA, 794 bp, Zea mays
  misc_feature: Ceres CLONE 1565154
  misc_feature: Encodes the peptide sequence at SEQ ID NO. 79980
  misc_feature (512)..(512): n is a, c, t, g, unknown, or other
  misc_feature (548)..(548): n is a, c, t, g, unknown, or other
  misc_feature (549)..(549): n is a, c, t, g, unknown, or other
  misc_feature (552)..(552): n is a, c, t, g, unknown, or other
  misc_feature (614)..(614): n is a, c, t, g, unknown, or other
ctggagctccccgcggtggcggccgctctagaactagtggatcccccgggctgcaggaattcgtctcacccctagaaaaagaatgaagcgaaagccgaaatcccattccccttccccctcttcgtctccgtcggcggcgtcggaccgaacccgagcccggagccctaactaaccctaggaggcaggcggcggcggggatggtgtactacgcgctgttggtgggcgcggagctggatggcctcaccaacctgcagccccgccacggctgcgacgaccccaacttcccctactacctcaagctcaagtgcgagaactgcggggaggtcaccgccaagtccacctacgtcaccctcagcgagcaagtcgacctgcccaaaggacacggcgccgctcacctcgtccagaagtgcaagctttgtgggagagatggaacaattgtgatgattcctggtcaggggacaccacttactattgagcagagccagaaagaggagaagacttgtttgatggtngttgactgcagaggctatgaacctgttgagtttccnnttngcactggctggaaggctgaatctgtgcatgggactcccttttgaaattggactgctctgaanggtgaatttttcttgagtttgattaagaaagggaaaaatgccccccttttgagcctaggcaaagctgccattcaaaatttcaaaagtgggtggaaaaaacccttaaaagggggggggggaaaaaacaaaaatttttgcccaaaaacccgggggggccctggggaaaattccgaacaaaat

SEQ ID NO: 79980 - protein, 132 aa, Zea mays
  misc_feature: Ceres CLONE 1565154
  misc_feature (1)..(132): Pfam Name: DUF866 Pfam Description: Eukaryotic protein of unknown function (DUF866)
  misc_feature (118)..(118): Xaa is any aa, unknown, or other
  misc_feature (119)..(119): Xaa is any aa, unknown, or other
MVYYALLVGAELDGLTNLQPRHGCDDPNFPYYLKLKCENCGEVTAKSTYVTLSEQVDLPKGHGAAHLVQKCKLCGRDGTIVMIPGQGTPLTIEQSQKEEKTCLMVVDCRGYEPVEFPXXTGWKAESVHGTPF

SEQ ID NO: 79981 - DNA, 874 bp, Zea mays
  misc_feature: Ceres CLONE 1565158
  misc_feature: Encodes the peptide sequence at SEQ ID NO. 79982
ctccccgcggtggcggccgctctagaactagtggatcccccgggctgcaggaattcgtctcacccctagaaaaactccctcagaccctcaccaaccaggcaaccaaaccttctccgatggccgcgcccgtgtcgcagccgccggtgtccgccagggcgtccacacggtttctcccccgcgggataggcgcgctcccggagtccgcccccacgtccctccggttatccgtcggccgccgtcgccgcgcctccagcctagaggtgaaggcatcaggaaatgtgttcgggaactacttccaggttgcaacctatggcgaatcccatggagggggtgttggttgcgttatcagtggctgcccacccagaattcctctcactgaggcagacatgcaagtagaactcgatagaagacgtccgggtcaaagtagaattacaaccccaagaaaggagactgatacatgcaaaattctatcagggacacatgatgggatgactactggtacaccaattcacgtctttgtcccaaacacagatcaaaggggtggtgattacagtgaaatgtctaaggcgtacagaccatcccatgcagatgcaacctatgacttcaagtatggagttagagctgtgcagggaggttggaaggtcatccagccagagaaaccatttgccggggtggcttgccggagcttcttggcaagaaaattcttaaacttcaaatcagggagtgggagatctttggcattttgtttctaaagtggaaccaagttcgtaccttcccagaaaatgccggttggattatggaaacgttaaacctttgggaaccttttggaggagcaaccacccggttggatggtccttgattcccaaaaattgtg

SEQ ID NO: 79982 - protein, 211 aa, Zea mays
  misc_feature: Ceres CLONE 1565158
  misc_feature (60)..(210): Pfam Name: Chorismate_synt Pfam Description: Chorismate synthase
  misc_feature: SWISSPROT Homolog: EC 4.2.3.5 Chorismate synthase
MAAPVSQPPVSARASTRFLPRGIGALPESAPTSLRLSVGRRRRASSLEVKASGNVFGNYFQVATYGESHGGGVGCVISGCPPRIPLTEADMQVELDRRRPGQSRITTPRKETDTCKILSGTHDGMTTGTPIHVFVPNTDQRGGDYSEMSKAYRPSHADATYDFKYGVRAVQGGWKVIQPEKPFAGVACRSFLARKFLNFKSGSGRSLAFCF

SEQ ID NO: 79983 - DNA, 844 bp, Zea mays
  misc_feature: Ceres CLONE 1565160
  misc_feature: Encodes the peptide sequence at SEQ ID NO. 79984
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (417)..(417): n is a, c, t, g, unknown, or other
  misc_feature (424)..(424): n is a, c, t, g, unknown, or other
  misc_feature (425)..(425): n is a, c, t, g, unknown, or other
  misc_feature (442)..(442): n is a, c, t, g, unknown, or other
  misc_feature (443)..(443): n is a, c, t, g, unknown, or other
  misc_feature (642)..(642): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnncaaaactggaactccccgcggtggcggccgctctagaactagtggatcccccgggctgcaggaattcgtctcacccctagaaaaaaccagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatgggctggtccctngaaaccnnctccctgagggaaggtnngcttggaaaagatggggcgcaacccccctaaagcccctgacggtgccccagtcaatccacggcccgcaaagaaaacttccccaaaaaagggccccaacgggaaaatcccccctttttccggggggtttccccccaaaccaaaaggggttttccggaaaaaaaaaaatatggggcccccccccccccaaaaaaaaaaaanaaaaaaaaagagggggggtttttctttttaaaaacaccccccccggggggggggccctctccgggggggggaggaaaaaaaaacattttttttgcgggaaaaaaaaccccgccccggcgggggggttttttttttttttttttttggggggggggagccccccccccaggggggggggggggggggccccaaaaaaaaaaaa

SEQ ID NO: 79984 - protein, 46 aa, Zea mays
  misc_feature: Ceres CLONE 1565160
  misc_feature (42)..(42): Xaa is any aa, unknown, or other
  misc_feature (45)..(45): Xaa is any aa, unknown, or other
MAVKVYVVYYSMYGHVGKLAEEIQKGASSVEGVEAKTWAGPXKPXP

SEQ ID NO: 79985 - DNA, 841 bp, Zea mays
  misc_feature: Ceres CLONE 1565161
  misc_feature: Encodes the peptide sequence at SEQ ID NO. 79986
  misc_feature (666)..(666): n is a, c, t, g, unknown, or other
  misc_feature (682)..(682): n is a, c, t, g, unknown, or other
  misc_feature (700)..(700): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (737)..(737): n is a, c, t, g, unknown, or other
  misc_feature (752)..(752): n is a, c, t, g, unknown, or other
  misc_feature (759)..(759): n is a, c, t, g, unknown, or other
  misc_feature (761)..(761): n is a, c, t, g, unknown, or other
  misc_feature (778)..(778): n is a, c, t, g, unknown, or other
  misc_feature (783)..(783): n is a, c, t, g, unknown, or other
  misc_feature (787)..(787): n is a, c, t, g, unknown, or other
acccgcggtggcggccgctctagaactagtggatcccccgggctgcaggaattcgtctcacccctagaaaaagagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggagacaagaccattgggggaggtgatgatgctttcaacaccttcttcagtgagactggagctgggaagcacgtcccccgtgctgtttttgttgaccttgagcccactgtcatcgatgaggggaggactggcacctaccgccagctcttccatcctgagcagctcatcagtggcaaggaggatgcagccaacaacttcgctcggggacactacaccatgggaaggaagattgtgcacctgggccgtggccgcagcaagaaaggagcagaaaaatggacggggctgcaagggattagcacaacctcaaacccgaggaggggaaaaaacaggcctagaggcgagggaatttcaccaacaaaagagngctagaggcggcggancaaagagaaaagacagancaagagctagaaaatatnnnggagaagccacttcccncccaaaaatggagancaaaatncnaaaggggaggaagaccnagaanagancatagtaggtccgagggttcccaaccccacgatttttctctccattggagagaa

SEQ ID NO: 79986 - protein, 158 aa, Zea mays
  misc_feature: Ceres CLONE 1565161
  misc_feature (49)..(156): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEGRTGTYRQLFHPEQLISGKEDAANNFARGHYTMGRKIVHLGRGRSKKGAEKWTGLQGISTTSNPRRGKNRPRGEGISPTKE

SEQ ID NO: 79987 - DNA, 840 bp, Zea mays
  misc_feature: Ceres CLONE 1565162
  misc_feature: Encodes the peptide sequence at SEQ ID NO. 79988
gcggtggcggccgctctagaactagtggatcccccgggctgcaggaattcgtctcacccctagaaaaaaagctgagcccgctcctagactcccagtcccctccgcagtccgcaccgccgcctcgccatggaggcagctgccgccgccttcttgtcccctccccgcgtcgccctcgacgtccgcacactcttctccccgccccgttgcctccccgtctcgccctcatcccagctccgcctcgctgcccgcccccgcgcgctcgccggcgccaagccgcggttcctgagcccccatcgagaacccgccgtcgacggcggtcgcggcgccagggatgtcgtcgcgatggtggtgccgttcctgaggggggccgcgtgggagcagccaccgccggacttggcctcgttcctgtacaagaaccggatcgtgtacttggggatgtgcctcgttccgtcggtcacggagctcatgctcgccgagtttctctacctccagtatgacgacgccgagaagccaatctacatgtacatcaattccactggcaccaccaagaatggcgagaagttaggctatgagacagaagctcttgcagtatatgatgctatgaggtatgttaaagttcctattttcactctgtgtgtcggtaatgcatggggagaagctgctttactcttagctgctggccgctaaggtaaccgtgccgcacttccatcatcgacaataatgataaaacagcccattgggtcgcttttcaaggtcagggcaacagacgtttgacattgccaggaaaagaagattcaaaatgtccaagatagaaatggtttaagctgcttggcaagaaca

SEQ ID NO: 79988 - protein, 186 aa, Zea mays
  misc_feature: Ceres CLONE 1565162
  misc_feature (84)..(187): Pfam Name: CLP_protease Pfam Description: Clp protease
  misc_feature: SWISSPROT Homolog: EC 3.4.21.92 Endopeptidase Clp
MEAAAAAFLSPPRVALDVRTLFSPPRCLPVSPSSQLRLAARPRALAGAKPRFLSPHREPAVDGGRGARDVVAMVVPFLRGAAWEQPPPDLASFLYKNRIVYLGMCLVPSVTELMLAEFLYLQYDDAEKPIYMYINSTGTTKNGEKLGYETEALAVYDAMRYVKVPIFTLCVGNAWGEAALLLAAGR

SEQ ID NO: 79989 - DNA, 816 bp, Zea mays
  misc_feature: Ceres CLONE 1565167
  misc_feature: Encodes the peptide sequence at SEQ ID NO. 79990
ctccccgcggtggcggccgctctagaactagtggatcccccgggctgcaggaattcgtctcaccccctagaaaaaaaacgaaatccagcagaccgacgcgaaccgagaaaaatcccacgaaatctcgtggccgcggcgaccggaagaagaggacgacgacggacggagcggcgatggcgtgccgcgcacttgccctccgctccctgctcctccccgacccgctacaccgcctcccggccgcggcgccacctgtttggagagcgtcccgcggtggccgccgtccgcacctccgctgctgctccggcggcgggggcggggagcccgggcagccgccgcaagaagctgtgctcgaggccatatccaagatagcaaggtctaaaggaagggttgcactcacaacaaatatggtcatgggtggtactgtgactgacgatgcaagtgatgaatggcttgttctggatcagaaggtaaattcctaccccacagatagaggatttacagcaattggcactggaggtgatgattttgtccagtcaatggtagttgctgttgaatctgttcttcaagaatcaattcccaagggccgggtatctcagaaattatcttcaagagggaaatatgtttctgtaaacattgggccaattcgtgttgtttctagtgagcaggtccaagctgtgtatcgtgccatgagaagagataacagatgaaatacttcttatgaagtgcaatttcatgtccgtggatgttccctagttcatttccatgtggtatcctacgatgcatttttcgccatatttaatgcaggctgggacctcc

SEQ ID NO: 79990 - protein, 177 aa, Zea mays
  misc_feature: Ceres CLONE 1565167
  misc_feature (91)..(177): Pfam Name: DUF493 Pfam Description: Protein of unknown function (DUF493)
MACRALALRSLLLPDPLHRLPAAAPPVWRASRGGRRPHLRCCSGGGGGEPGQPPQEAVLEAISKIARSKGRVALTTNMVMGGTVTDDASDEWLVLDQKVNSYPTDRGFTAIGTGGDDFVQSMVVAVESVLQESIPKGRVSQKLSSRGKYVSVNIGPIRVVSSEQVQAVYRAMRRDNR

SEQ ID NO: 79991 - DNA, 869 bp, Zea mays
  misc_feature: Ceres CLONE 1565168
  misc_feature: Encodes the peptide sequence at SEQ ID NO. 79992
  misc_feature (423)..(423): n is a, c, t, g, unknown, or other
  misc_feature (439)..(439): n is a, c, t, g, unknown, or other
  misc_feature (444)..(444): n is a, c, t, g, unknown, or other
ctccccgcggtggcggccgctctagaactagtggatcccccgggctgcaggaattcgtctcacccctagaaaaaaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaaggggaagaaagtagcngaagaagaggacgacnagaanggtgcagcgacgccgcagccggtcgcaaaagctcaggtggtgggatggccaccaatccgaaactaccgcaagaacacgatgtctaccacccaactgaagggcaccaaggaggatgctgaggccaaccagggacagggggttcttgtacctcaaagtccacatggatggcccccccttaccttcaggaagaatggcctccaagatttacagaaaacttcagggacctttccaactgcctttgaaaaaaattttcagggggttcaaaaacggggaaaggatggttttttctaaaaccccaagggaggggaaaaatttttttcggctttccaggaaaggaatgggaaatttggttcttttttggggatatacccccggggagaaattttcttatatacttttccgcgggtttagaaaaataaaaaaaa

SEQ ID NO: 79992 - protein, 187 aa, Zea mays
  misc_feature: Ceres CLONE 1565168
  misc_feature (24)..(188): Pfam Name: AUX_IAA Pfam Description: AUX/IAA family
  misc_feature (90)..(90): Xaa is any aa, unknown, or other
  misc_feature (91)..(91): Xaa is any aa, unknown, or other
MSPPLDLDYIGLSPAAAAAAAHDDLKGTELRLGLPGSGSPDRRVVAATATTLDLLPAKGAKRGFSDEAPTPSPGAASGKGKKVAEEEDDXXGAATPQPVAKAQVVGWPPIRNYRKNTMSTTQLKGTKEDAEANQGQGVLVPQSPHGWPPLTFRKNGLQDLQKTSGTFPTAFEKNFQGVQKRGKDGFF

SEQ ID NO: 79993 - DNA, 851 bp, Zea mays
  misc_feature: Ceres CLONE 1565174
  misc_feature: Encodes the peptide sequence at SEQ ID NO. 79994
  misc_feature (815)..(815): n is a, c, t, g, unknown, or other
  misc_feature (824)..(824): n is a, c, t, g, unknown, or other
ctccccgcggtggcggccgctctagaactagtggatcccccgggctgcaggaattcgtctcacccctagaaaaaaacactcgtcgatctacacacatacatagtttcttctactacacgacgacaaacatggggaagcctgcgaagatcggagagtggggtggatacgccggcgatcgtcgggatctgagggctactccggaccggctgaccgaggtgaaggtcacggcggacaacagcagctgcatccgctccatctccttcatctacatcggagccgatggcaagccgtacgaggaggggccatggggtttcggccatgctggcacggagtacaagattgatctgtgcaggttcgacgagagcttgacggagatctccgggaccacgggcccagcctacaacattgacaatctggtcaagtctctcaaatttgtcaccaacaaacgtacttacggaccgtacggcagggacgagggcaccccgttccgtgtcaaggtgatgaacaacggccacgtcgctggcttctttggccgctctggagattgcctggacgcgatcgggctctacgtcaaccccaactaataactaaaacgatggatcggatcatctgcatgcatgcatatgcagtatgctgcttgcctagctgcctgtaacgaatatgaatgcataaaataacgcccctgctgctcccatatgcatcagcagtgtgtaccactatatatgttatatactgtatttcgctaccgaataaaacaaaaaactgacccagagcgatcggagctgacgacgatggccgggaaggcggcggccgcnacggctgcnaagtgggcggaggggtacccgtggtag

SEQ ID NO: 79994 - protein, 151 aa, Zea mays; identical to SEQ ID NO: 57670
  misc_feature: Ceres CLONE 1565174
  misc_feature (15)..(150): Pfam Name: Jacalin Pfam Description: Jacalin-like lectin domain

SEQ ID NO: 79995 - DNA, 814 bp, Zea mays
  misc_feature: Ceres CLONE 1565175
  misc_feature: Encodes the peptide sequence at SEQ ID NO. 79996
  misc_feature (710)..(710): n is a, c, t, g, unknown, or other
  misc_feature (711)..(711): n is a, c, t, g, unknown, or other
ctccccgcggtggcggccgctctagaactagtggatcccccgggctgcaggaattcgtctcacccctagaaaaaagcactagcagtaagaaacttgtcgaagtcgtcgtagttttacgtgctccgcccgtcccgtgcgccatgtcacgcagcaacgccttgctgtggttgttgcttctcgcgctctcgtgctggtcgtggtgcggcgccgtcacggcgcggccgaccccgagcgccagcaccagcaccaccacggccggcggcggcttcatcaggtcgtggtgcgcggggacggactacccggccctgtgcaacgcgacgctggccccgtacgcggcggaggtcggggccagcccggcgcgcctgtcgctggcggcgctgacggtcacgctggacggcgcgcggagggcgacggccgcgatgaaggcgatggcggcgggcggcgcgagcagccaccacctcgtgcccgtggcggccgaggcggcggcggactgcgtgggcatgctcgaggacgccgtggacctgctgcggcagtcggtggaggcaatggagcgcctcggcaaggagccggccagcgccagcgccagcgccagcgggcaggccgggcggagcgtcatgttccaggtgaacagcgtgcagacgtgggcgagcgccgcgctgacgaacgacggatgttgcatgggaggggttcaagggccagccccgccgtcnntgagggaggccctgtcggaagaaacgtcgcctgcgccatgcacctcacggccatcgcgctcgctatcatcaacgccatggccaagcattgtagtaagggtacc

SEQ ID NO: 79996 - protein, 224 aa, Zea mays
  misc_feature: Ceres CLONE 1565175
  misc_feature (38)..(214): Pfam Name: PMEI Pfam Description: Plant invertase/pectin methylesterase inhibitor
  misc_feature (191)..(191): Xaa is any aa, unknown, or other
MSRSNALLWLLLLALSCWSWCGAVTARPTPSASTSTTTAGGGFIRSWCAGTDYPALCNATLAPYAAEVGASPARLSLAALTVTLDGARRATAAMKAMAAGGASSHHLVPVAAEAAADCVGMLEDAVDLLRQSVEAMERLGKEPASASASASGQAGRSVMFQVNSVQTWASAALTNDGCCMGGVQGPAPPSXREALSEETSPAPCTSRPSRSLSSTPWPSIVVRV

SEQ ID NO: 79997 - DNA, 648 bp, Zea mays
  misc_feature: Ceres CLONE 1565179
  misc_feature: Encodes the peptide sequence at SEQ ID NO. 79998
  misc_feature (333)..(333): n is a, c, t, g, unknown, or other
  misc_feature (439)..(439): n is a, c, t, g, unknown, or other
  misc_feature (440)..(440): n is a, c, t, g, unknown, or other
ctccccgcggtggcggccgctctagaactagtggatcccccgggctgcaggaattcgtctcacccctagaaaaagtcagggtcctccgagtcggacttcctcacggccgccgcgccaaatcccgtctcgttgctccggtccgctgcgcatcctcaggaatggaacttggcgccaccactgccctctaccctctgcaccgctgcaaaaccatttacctggtcaggcatgcccagggcattcacaatgtcgcgggggagaaggactttggtgcatacatgtcacatgatctgttcgatgctcagctcactcctttgggttggaaccaagtcgatnggtctgcgggaagcatgtgaagaaaagtgggggcttgcagaaaagatttgaattaagtatttcttccccttttaactgaggactatgcaaaactgccagttggggnngggtccctttgggggggggaaaagataattgatggggggaattgcacccccccctaaagggcaaaaaatgccgaaacaaggggtccctcccggggaatttcaaagttttgaaacgcccccccccttttttttggggggcgaaaaacccgcaaaaaaaaccccttgggggggggcccccacccccgggaaaaaaaaaaagaaggaaaaa

SEQ ID NO: 79998 - protein, 64 aa, Zea mays
  misc_feature: Ceres CLONE 1565179
  misc_feature (59)..(59): Xaa is any aa, unknown, or other
MELGATTALYPLHRCKTIYLVRHAQGIHNVAGEKDFGAYMSHDLFDAQLTPLGWNQVDXSAGSM

SEQ ID NO: 79999 - DNA, 796 bp, Zea mays
  misc_feature: Ceres CLONE 1565183
  misc_feature: Encodes the peptide sequence at SEQ ID NO. 80000
  misc_feature (366)..(366): n is a, c, t, g, unknown, or other
  misc_feature (367)..(367): n is a, c, t, g, unknown, or other
  misc_feature (706)..(706): n is a, c, t, g, unknown, or other
ctccccgcggtggcggccgctctagaactagtggatcccccgggctgcaggaattcgtctcacccctagaaaaagtgaccatcacaacaaaaataaaatcaataatagagagagaagaggtagcaacaccggctgcttaatctcttcttttccctcctctttatctccagcgcatcgtaaagggaggagcggagcggcgaattcttgtggtttcccaagatgtcttctccaagcaagcgccgggagatggacctcatgaagctgatgatgagcgactacaaggtggatatggtgaacgatgggatgcaggagttctttgttgaatttcgtgggcctaacgaaagcatttatcaaggaggtatatgnngagggttagagtagaactgccagatgcgtatccttacaaaatccccatcgattggtttcatcaataagatatatcacccaaatgtcgatgaaatgtctggttcagtctgtttggatgtcatcaaccagacatggagcccaatgtttgatcttgtcaatgtgttcgaggtcttccttccacaacttctgttatatcctaatccttctgatccattaaatggagatgcagctgcgttgatgatgcgtgatcgccctgctatgaacaaaaggtgaaaagtactgtcaaaaatacgcaaaccagagaatgctggtgtcagcccagaagacgagtccagtgacnaagagctgagtgaagaggaaaatgactcgggtgatgaggagataatgggcaaacagacccatagtcgagtgggaacctagactgtactct

SEQ ID NO: 80000 - protein, 53 aa, Zea mays
  misc_feature: Ceres CLONE 1565183
  misc_feature: SWISSPROT Homolog: EC 6.3.2.19 Ubiquitin--protein ligase
  misc_feature (49)..(49): Xaa is any aa, unknown, or other
  misc_feature (50)..(50): Xaa is any aa, unknown, or other
MSSPSKRREMDLMKLMMSDYKVDMVNDGMQEFFVEFRGPNESIYQGGIXXGLE

SEQ ID NO: 80001 - DNA, 745 bp, Zea mays
  misc_feature: Ceres CLONE 1565185
  misc_feature (179)..(179): n is a, c, t, g, unknown, or other
  misc_feature (181)..(181): n is a, c, t, g, unknown, or other
  misc_feature (182)..(182): n is a, c, t, g, unknown, or other
  misc_feature (193)..(193): n is a, c, t, g, unknown, or other
  misc_feature (201)..(201): n is a, c, t, g, unknown, or other
  misc_feature (215)..(215): n is a, c, t, g, unknown, or other
ctcacccgcggtggcggccgctctagaactagtggatcccccgggctgcaggaattcgtctcacccctagaaaaactctcccaaaccctcgcgccgccgctccccagcacatcgctcccagcgcgccaaatcggcggcaacctcggacccttcactcacccagctatggggcggagcgnannggcggcgaagncgttgggncgggaaaaaaacancggggcggggccaaaaagcttggggggggttttttggggcccccccgggggtttttcgggttccccccgggggggggggggcccggggggggaaaaacccgggggggtgggggggccccccccccctggggggggggggcccccggggaggacccacgaagggtcccccccccccccccccgccgggggggggggggggggggggggaaaaaaaaagggggggggggggggggggcgccccccctttttaaaaaaaaaaaaaaaaaatttttggggggggggggggggcgcccccccccctctgttggtgggggaggggggggggagagaaaaaaaccccccgcgggcggggtttatctctcccaaaaaaaatataaattttttttttttggggggggggagaaagaagaagaaaaatattttttttttctgtggcggggggggggggggagcggtcccctcccctttcttttgtttgtgtgggtggggggggggggggggggtggagggaaaaaaagaaagaggaaaaa

SEQ ID NO: 80002 - DNA, 952 bp, Zea mays
  misc_feature: Ceres CLONE 1565186
  misc_feature: Translation starting site: 173
  misc_feature (952)..(952): n is a, c, t, g, unknown, or other
ctcaccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgtgcgcgctgttcgtggcggccccccgtgggcgcgaacatctccggcgggcacgtgaaccctgccgtgaccttcggcgccttcgtgggcggcaacatcaccctgttccgggggctcctgtactgggtggcgcagctgcctggggtccaacgtggggtgctatcttgctccgctttattcgaccggcggggcaaggccccagggcaccttacgggctgaacagggcttgtatggttgatgggaggcaccttggtgcctggataatcgtgaatgaacccctcccggcctggtagtccaacaggtgtatcgcccaagggcgggtgtgacctcagaaaaaagagggcaggctatgggcgaccattccatcccctaattgagccatacgggcttttcatcctggtgggggaccaacaaatcccggagggggtggggtcgcccttagcagcagggcagccgtcccatgaagacccccgtccagtgatccctttcgggactccccccccaccggtcagaccgggtgaattgggtggactaccccagtgggcggggataacaggaggtccggggcacctcttttatggagn

SEQ ID NO: 80003 - DNA, 829 bp, Zea mays
  misc_feature: Ceres CLONE 1565189
  misc_feature: Encodes the peptide sequence at SEQ ID NO. 80004
  misc_feature (752)..(752): n is a, c, t, g, unknown, or other
ctccccgcggtggcggccgctctagaactagtggatcccccgggctgcaggaattcgtctcacccctagaaaaaacctcaccttcctttcctcctcccgtcctccatcaaaagaaggcagggaaagatctgatctggggggtgagagagcaggaggagaaagccaagccattgccctcccctcttgaaggcttggagcttggttctacatcctcttctcttcccctccgtctctctctctctctctatttggtttgcttgcttgcctctactagactctagtcgtcgggtccggccatggccaccatcctggagaacatccagaaggcgaggttcctgccgaccaggccgctcaaggacgagctgcccaccttccagggcggcggcaagagcaaggaggagagccacctcatgggcctgaggaagcggctgtccagcttctccggcaagatccagcccatctcctccgcgtcggccgccgagtgggcgttccgccgctccaagtcggcgccctccctcggcgccgccttcgccgcggggggcggctccctgaggcagtggtggcagtggggcgtcggctggctcctgtccaagaagcccgggttcgcggggcgacctcgagatgaacgaggaggaggtcgccgcgctgggccgccagagcaggggcacctgtgcccacatcctgttcaagatgcggtcccgcgtccgccggcttcgttgcgtccgcgcactcggtccccaccacgcacaagngagaagtccctgtccttcttcttcggccgccggggcgccacagcgtccaagtgcaagcccggcgggctttctttccc

SEQ ID NO: 80004 - protein, 177 aa, Zea mays
  misc_feature: Ceres CLONE 1565189
  misc_feature (152)..(152): Xaa is any aa, unknown, or other
MATILENIQKARFLPTRPLKDELPTFQGGGKSKEESHLMGLRKRLSSFSGKIQPISSASAAEWAFRRSKSAPSLGAAFAAGGGSLRQWWQWGVGWLLSKKPGFAGRPRDERGGGRRAGPPEQGHLCPHPVQDAVPRPPASLRPRTRSPPRTXEKSLSFFFGRRGATASKCKPGGLSF

SEQ ID NO: 80005 - DNA, 846 bp, Zea mays
  misc_feature: Ceres CLONE 1565192
  misc_feature: Encodes the peptide sequence at SEQ ID NO. 80006
  misc_feature (622)..(622): n is a, c, t, g, unknown, or other
  misc_feature (629)..(629): n is a, c, t, g, unknown, or other
  misc_feature (792)..(792): n is a, c, t, g, unknown, or other
ctcaccgcggtggcggccgctctagaactagtggatcccccgggctgcaggaattcgtctcacccctagaaaaatctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttataggactacgactggggacccgtgtcttggtgcccntcagggnagcttggatggtggcctggatattcctcacgcgagaagaagtttgctggttttcagaaggatgaccagcagctggatgctgatatccatcgcagtacatctatggtgggcatgttgctgactacatggaggacctccctgaagaggaccccaaaaagttccangcctccctttcggggggaacattaagaaaggaattgggggctaacaacttggaa

SEQ ID NO: 80006 - protein, 185 aa, Zea mays
  misc_feature: Ceres CLONE 1565192
  misc_feature (27)..(160): Pfam Name: Ribosomal_L18p Pfam Description: Ribosomal L18p/L5e family
  misc_feature (163)..(163): Xaa is any aa, unknown, or other
  misc_feature (165)..(165): Xaa is any aa, unknown, or other
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIGLRLGTRVLVPXRXAWMVAWIFLTREEVCWFSEG

SEQ ID NO: 80007 - DNA, 943 bp, Zea mays
  misc_feature: Ceres CLONE 1565194
  misc_feature: Encodes the peptide sequence at SEQ ID NO. 80008
ctccccgcggtggcggccgctctagaactagtggatcccccgggctgcaggaattcgtctcacccctagaaaaagcgcggcacaagacgccaccgagccaagaatttgcatcctcatcctgcggctgtcagtgtcaagcagccaggctcaggggtaaggtttcagcaattcagctccctcgcctccgccgcggcaccggcactacgagtgcttcgctaccagccagccagcacactctacgagtcgccatcttccactccaccgaggcagctccaagccatggccatggagaaggccgcctccttcctctcctccctcttaggcggcggcggcggggagccggcggcgactgtgaaatctatcttcatataccctatcaagtcctgcacgggtcttgccgtgtcacaggcgcccatcacctccactggggttccggtgggaatcggcagtgggttggtggtgaacgccaaaaggcgagcatacacccaaaagggtggagcccaagccttgctctggtccaggtgggatttgccccccggaagccttcgcccaaaaaatggaaagccccaccccccaacaaccaccctggttattcaaagcaacccgggaatgggacacaacctgaagaaaaccccctagtaaccgggaaaacgcccacacaattgaatgaaggtctccttgtttggggaaagggggtctggggctcctgccatataaaaaaaagggggcttttaaaacctcttgaaaaggggttctccccactttactctttggggaaagcccaaaggtcgaacataaggggggccttttaaagaaaagaatctcggaaaaataaagggcccaccccgaattctctaattttagcccccccaaggttatatataaaaatacttgttttcacaccacatgtggttttcccaaattttcttgaaaagacgtttct

SEQ ID NO: 80008 - protein, 117 aa, Zea mays
  misc_feature: Ceres CLONE 1565194
MEKAASFLSSLLGGGGGEPAATVKSIFIYPIKSCTGLAVSQAPITSTGVPVGIGSGLVVNAKRRAYTQKGGAQALLWSRWDLPPGSLRPKNGKPHPPTTTLVIQSNPGMGHNLKKTP

SEQ ID NO: 80009 - DNA, 802 bp, Zea mays
  misc_feature: Ceres CLONE 1565195
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaaatccacttttaaaaattaaaagatctcgaaaacaatgaattgaaggatttgattactcaatatttgattggaatagattcacaataattctaaaaaaaaattatgaattttctatttcataatcattcctaatttcattctaaaaataaaataaagaacctatattataatatgggttctgtgaaagcaggagagatgacttagagtctcttggttatgtgctgatgtacttcttaagaggaagccttccttggcaaggcctgaaagctggaacgaaaaaacaaaagtatgacaaaattagtgagaagaaaatgctaacctcaattgaggccctgtgtaaatcttatccatcagaattcgttacatatttccattattgccgctctttgcaatttgaagataagccagactacagctatttgaagaaaaattttcgggatttattcatccgtgaaggttaccagcctgattatgtatttgattggactgtatcaaggcaagctgcggacaataacagattgcgactgagtgggaagacaggtggggttggtgggacccatctgtggatcgggctgaacgagctgcagcaaaacaggatgttccacatagattcactggtccagctgatgcattggctaaagaactggctctggttctggtcattatggagaacacacaagcacagaactctgttggatttcctatgcatcccaatatgggtgttgac

SEQ ID NO: 80010 - DNA, 833 bp, Zea mays
  misc_feature: Ceres CLONE 1565196
  misc_feature: Encodes the peptide sequence at SEQ ID NO. 80011
  misc_feature (612)..(612): n is a, c, t, g, unknown, or other
ccgcggtggcggccgctctagaactagtggatcccccgggctgcaggaattcgtctcacccctagaaaaaaaaaccgcttccttcgattcattccccctctcccctctccaagacccaaaaccctaacccctacgacccccgtgaccgccgccgccgtcgatgcctgcgctctccgacgtcgcgcttcaggctgccatcgccggcaacctccgcctcctgaagctggtggcgagcaagatgaatctgcgcgaagcgaaggacgccgctgggcggaacgcgctccacctggccgcggagatgggccgtcttgaggtttgcaggttcctggtggaggaatcgggcttcgaggtgaacttcgcctgcgccgaaggcgggtcgccggtccactgcgccgcggccgggggcagcgagagcgtcttgggctaccttctcgaccacggtggcgaccctgtgatgccggactccatgggctccactccactgcatgatgcggcagaggaagggcattgtgcggctgtgaggatgctgctgtccaagggtgtcgatgtggatccacacggctgtcgtgggacgccgctgcacttggcctgctccaatgaccgggatcaggntgttaggatcctgctggaacatggcgcagatcccaacaagttgtcggtcatgtcctcccacactcatgatggcatactgtgggcgttctttgagatgcatgaagctactgaatgaggctgtgcggatgtgaaactggatgctccttcggagaattttggctcaggcgtttgtgatgggtcactggaaatggcagattttgctaaaggtggaggtgaatcta

SEQ ID NO: 80011 - protein, 188 aa, Zea mays
  misc_feature: Ceres CLONE 1565196
  misc_feature (103)..(135): Pfam Name: Ank Pfam Description: Ankyrin repeat
  misc_feature: SWISSPROT Homolog: EC 2.7.11.1 Non-specific serine/threonine protein kinase
  misc_feature (151)..(151): Xaa is any aa, unknown, or other
MPALSDVALQAAIAGNLRLLKLVASKMNLREAKDAAGRNALHLAAEMGRLEVCRFLVEESGFEVNFACAEGGSPVHCAAAGGSESVLGYLLDHGGDPVMPDSMGSTPLHDAAEEGHCAAVRMLLSKGVDVDPHGCRGTPLHLACSNDRDQXVRILLEHGADPNKLSVMSSHTHDGILWAFFEMHEATE

SEQ ID NO: 80012 - DNA, 850 bp, Zea mays
  misc_feature: Ceres CLONE 1565198
  misc_feature: Encodes the peptide sequence at SEQ ID NO. 80013
  misc_feature (748)..(748): n is a, c, t, g, unknown, or other
  misc_feature (773)..(773): n is a, c, t, g, unknown, or other
  misc_feature (774)..(774): n is a, c, t, g, unknown, or other
acccgcggtggcggccgctctagaactagtggatcccccgggctgcaggaattcgtctcacccctagaaaaaatgatggggctagcaacatgagaggtgatattaaaggattgaaaacattggtcatgcaagagtcaccttctgcttattatatccattgttttgcacatcaactccaactagttgttgttgccaagggaaataatgattgtgagtggttttttgatcaagtaactctcttattgaatatcgttggagtttcttgtaagtgtcacggtatgcttcgagatgctagacttgggaatctcatgaaatcacttgaatgtggtgaacttgatactgggagaggattgaatcaagagatggggttgcctaggcctggtgagactcgatggggctcttattacaaaactatatgcaacataattactatgtatcctgtaatccgagatgttctcatgattcttggagaggatactacaattagaagtgattggacaaggatacattctatgcttggagcatttgagtcatttgactttgtttttgatgcacacttaatgtttgttattcttggatatacaaatgatttatcagtgtgtttgcaaagaagggaacaagatattattaatgcaatttcacttgttaatgtggcaaagagaagaatgcaacaattaaggcttgaatggttgggatcaattccttcaaagaaccacttcattttgcacaaacatgatatccaagtccntgctatggatggaaatttatagccnntatggaagatcatcacgatttgttcataaccaaaccaatgatgacactttcagaagagaagtatatattgggggtc

SEQ ID NO: 80013 - protein, 226 aa, Zea mays
  misc_feature: Ceres CLONE 1565198
  misc_feature (220)..(220): Xaa is any aa, unknown, or other
MRGDIKGLKTLVMQESPSAYYIHCFAHQLQLVVVAKGNNDCEWFFDQVTLLLNIVGVSCKCHGMLRDARLGNLMKSLECGELDTGRGLNQEMGLPRPGETRWGSYYKTICNIITMYPVIRDVLMILGEDTTIRSDWTRIHSMLGAFESFDFVFDAHLMFVILGYTNDLSVCLQRREQDIINAISLVNVAKRRMQQLRLEWLGSIPSKNHFILHKHDIQVXAMDGNL

SEQ ID NO: 80014 - DNA, 1111 bp, Zea mays
  misc_feature: Ceres CLONE 1565201
  misc_feature: Encodes the peptide sequence at SEQ ID NO. 80015
  misc_feature (728)..(728): n is a, c, t, g, unknown, or other
  misc_feature (776)..(776): n is a, c, t, g, unknown, or other
  misc_feature (1021)..(1021): n is a, c, t, g, unknown, or other
  misc_feature (1029)..(1029): n is a, c, t, g, unknown, or other
  misc_feature (1032)..(1032): n is a, c, t, g, unknown, or other
  misc_feature (1058)..(1058): n is a, c, t, g, unknown, or other
ggagctccccgcggtggcggccgctctagaactagtggatcccccgggctgcaggaattcgtctcacccctagaaaaagctttgcttctcgcggccgtatactacttttgtcagctccctcaccccgcgagtagtcacagggaccttcgccctcgattccaccccaatttatccgcacgataccggaattccctccgcctagcgcggatctagaacgatgcgctccctgtcgtgccccgaatccgccatgaatggggtcaaatccaagggcgccgccaaagccgatgccaatctggcggcgaaaagtaagggggccgagaagcccgtcaagggtaggaaagggaaggccggtaaggaccccaacacgcctaagaaggctcccaagctctttcgtgggtgttcattggccccccaccccacaaggacgttttatgggagaataatcccctaaaaaacaaagacagttcacttgcgagtggggggaaaattcttgttgggagaacagggtgggaaaagaccctttaagcctgaggttctggaaataaggtgttatcatattgttaatacccaagggggtgacctataagcaacacaacgctcccaagttgaagcgaatataggtgcaccatattaatactgtgtgttaaaataatcatggtggtaggtctcagagaagaacaaccgttgacaagctccttgaaacaagaaggggcatcccccagtcgccncataatggaatagagaaaaacaagggcgtggggggaggacagatcttnaattactagtgagagatattcttggtaattatagaaataccttacagattgcggggagaaatgatgtcaaaatgtttaccatcgaacgagaatgttaggagtacctaacacaatgagggtgtgtgttgtgtattgacgaacgactctctcaacatgtaattacttccctcctcctcagaaggggtttgatgtgtggtcgattttcccatcatccgtgagcgataataatatgggtgaggaatacngagtgacncgnctgccactaacacatctacaatcggnaggaggctacgcagagtctaaatgtacatatacacaagaaggtatagggctgg

SEQ ID NO: 80015 - protein, 67 aa, Zea mays
  misc_feature: Ceres CLONE 1565201
MNGVKSKGAAKADANLAAKSKGAEKPVKGRKGKAGKDPNTPKKAPKLFRGCSLAPHPTRTFYGRIIP

SEQ ID NO: 80016 - DNA, 1092 bp, Zea mays
  misc_feature: Ceres CLONE 1565202
  misc_feature: Encodes the peptide sequence at SEQ ID NO. 80017
ctccccgcggtggcggccgctctagaactagtggatcccccgggctgcaggaattcgtctcacccctagaaaaaaccagagacgaggctggagcggcgatccattccacacaaccaccactgctcttgccacagcccgccgcaggagttgccagatctgccccggtcacaggaactcctactccgagccctctccaatggcggttaaggtctacgtcgcgtactattccatgtctggacatgctggcacattagctgacgagatccagaaaggtgcctcgtctgttgaaggtgttgaagctaaaacatggttggtcccttgaaaccctccctgaggaagtgcttggaaagatgggcggcaccccctaagcacggatgtgtctatacttccgcccccccccaaattttataagggctgagagaaacctcttttcgggtgcccaacccaagggtgcggaaaggattgtcatacgcacaagtaaggcgggtctttttcaaggcccccgggtggggtttcaaggagggggattaaaaacccctgcgcccggacataccctcccccgttattcctcgtttacacggcacttgggaaactccccacggggggggggtggtcggaggaagcacaagatcggcagcgtgttgatcgtgttacttatctctattgccctgaggaccctttaccccttgtcccctgatgcgcttttccccaccgcctccgtttgggagggctaacaaatactactaaggatcccgacccaccccctctcttctcgatttgtgtggtccacacggggcctccagggtggtgatctaagaaccgatcataagtggggcgatgtggaaacgattttctctctatagactatactttattttacacacggttcctacttacatggtagaggcagatatgtcttgaacccgcatctttcgtccataccggagagagaaatgatggatctcgactagagtcgtcgcgccatggtatcctaaccgtagacttcaactgctccgactgaacatatttatatctctgttgcgatagaaacctcaaacgctacgggagagctgtacctacgcatattttgag

SEQ ID NO: 80017 - protein, 41 aa, Zea mays
  misc_feature: Ceres CLONE 1565202
MAVKVYVAYYSMSGHAGTLADEIQKGASSVEGVEAKTWLVP

SEQ ID NO: 80018 - DNA, 868 bp, Zea mays
  misc_feature: Ceres CLONE 1565205
  misc_feature: Encodes the peptide sequence at SEQ ID NO. 80019
ctcaccgcggtggcggccgctctagaactagtggatcccccgggctgcaggaattcgtctcacccctagaaaaaaggggagtgcatcctcctcctcctcctcctcctccttcccctaccctccccgcgcgcagatcccgacgcgggacgcctgcattcccttgcgcgggacgcgacaactccacgctacacagttcacacgccaagcgagggccgcatctagatccgcgccgccgagctgacttgactattgcaagtttgcaacccaccgccacgccttcttctccccccggcccgcgatctacccggcccgggcgccgttgctgctactgctattactaatactactaccacgtcgtagcggaggcagggacttgaggagcgggtgggttgccatggccgccgcggggaggaatgcgggcgtcctcgcgctcttcgacgtcgacggcaccctcacagcgccgcgcaagggggtgacgccagagatgctagagttcatgaagcagctgcgccagcatgtaacagtgggcgtggttggcggatccgatctgggtgagattaccgagcagctcggcagtacagttattactgattatgattacgtcttctcccaaaacggctggttgcacacaaaattgcccaactattgggaacccaagttttgaatcatttatcggagagacaagctggagggaattttttaacttcctccttcatacctggctgactgggaaatccaatttaaaaggggtcccttcctagaattcccaaagggaaaggattaagggttctccctatgggaaaaaactgttgccaaaaaaaacgggatgaattttgaaaaggaccaaaaaggggataaaaatccgaac

SEQ ID NO: 80019 - protein, 89 aa, Zea mays
  misc_feature: Ceres CLONE 1565205
  misc_feature: SWISSPROT Homolog: EC 5.4.2.8 Phosphomannomutase
MAAAGRNAGVLALFDVDGTLTAPRKGVTPEMLEFMKQLRQHVTVGVVGGSDLGEITEQLGSTVITDYDYVFSQNGWLHTKLPNYWEPKF

SEQ ID NO: 80020 - DNA, 855 bp, Zea mays
  misc_feature: Ceres CLONE 1565209
  misc_feature: Encodes the peptide sequence at SEQ ID NO. 80021
gagctccccgcggtggcggccgctctagaactagtggatcccccgggctgcaggaattcgtctcacccctagaaaaactaggccgccgccgccagtcctcactcctcaccatttcccaaaccctacccgtacccccgccgccgccgccaccgccatgccgcccaagctcgacccgtcgcaggtggtggaggtcttcgtccgggtgacgggcggcgaggtcggcgcggcgtcgtccctggcgcccaagatcggcccgctcgggctctccccgaagaagatcggcgaggacatcgccaaggagacggccaaggactggaagggcctgcgcgtcaccgtcaagctcaccgtccagaaccgccaggccaaggtctccgtcgtcccctccgccgccgcgctcgtcatcaaggcgctcaaggagcccgagagggaccggaagaaggtcaagaacatcaagcacagcggcaacatcggcctcgacgacgtcgtcgagatcgccaggaccatgaggaacaggtccatggccaaggagttggccggcaccgtcaaggagatcctcggcacctgcgtcagcgtcgggtgcaccgtcgacggcaaggaccccaaggacctgcagcaggagattgatgacggagaggtcgagatcccgtccgcttgaagactagccatccaaggggacttccattggtgctgctgaagtgttgttgttctgcatgctatcgatgtacctttttcagcaacgcgagccatctattttttttgtctagctatgttagtgatatcttgtgagagacctcaatggtaccaccgtatctttgtctttggtggatggagagaatttagcacctcaccacactt

SEQ ID NO: 80021 - protein, 166 aa, Zea mays
  misc_feature: Ceres CLONE 1565209
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNIGLDDVVEIARTMRNRSMAKELAGTVKEILGTCVSVGCTVDGKDPKDLQQEIDDGEVEIPSA

SEQ ID NO: 80022 - DNA, 855 bp, Zea mays
  misc_feature: Ceres CLONE 1565214
  misc_feature: Translation starting site: 155
  misc_feature: Pfam Name: Ribosomal_S6 Pfam Description: Ribosomal protein S6
ctccccgcggtggcggccgctctagaactagtggatcccccgggctgcaggaattcgtctcacccctagaaaaaagcgcctcctcccgctctccggctcctgtcctgctcgcgctcgtcgcccccctgccgctcggctccccttggcccctccaatgccgccacccatggcactgctgccgctctcctccgcatccgcgtccgccgcgctgccgcccttccgctcctgcccgcccgctgcgatgctgcttcgcctcccctcccccgccccctcccatttcgcccgcccccgcgcggtctccaccgggtacgcggcgtccttctacggcggctcggcgatgtccgcggccggcggcgcggacgaggaggaggaggaggtcggctacgagtcggggttcggcccggggctagggctgggcggcggcggcctcgggatgtcggccgcggaagccgcgctggcgctggaggagcgcgagatgccgccctgcccacccggcctccgccagtacgagaccatggtcgtgctccgccccgacatggtccgaggaggagcgcctcgccttcatccagcgctacgaggagctgctcgtcgccggcggcgccatgtacgtggaggtcttcaaccgcggtgtcatcccgctggcatacagcatcaggaagaggaacaaccgcaccgggctgccgtccacctactacgacgggatctacctcctcatcacctacttcaccaagccggaagtccatggacgcccctgcagccttaagattcaaacgccgaacgaccaagttcatccgcccccccccaagctttaaagggtccgccccgcgcggaaaaggccgttccatggttagaaag

SEQ ID NO: 80023 - DNA, 925 bp, Zea mays
  misc_feature: Ceres CLONE 1565215
  misc_feature: Encodes the peptide sequence at SEQ ID NO. 80024
gcggtggcggccgctctagaactagtggatcccccgggctgcaggaattcgtctcacccctagaaaaagttcctgttcccctcggcgacgccagtacggcagtacgccacgccagtgcccagttgcattgactcctccccggtccccacatcttgccgccaatggatgtcgacgggcccgcccccgccgacgcctctgccaggcccgccaccaacggcgaggccccctccggcgcccgcgaggtcgacgtcggcgaggaggacacgctcgccggcgtcctccgcagcttcgtcgacggcgtctggtacccggacgagcctctgctccggcggctccgggcggcgtcctgcgacgccgcgccgcgcctgaggggggcgtcccggaactccgcgcggggacctgcttgagtggaacagggcggggcagcgggcctccgcgccatcttcgtcatctcgggtcgggacaatcacgccttaaagcattgactgggccttcgggacctccaggttccttccaaattgggtgcccactgccaaaagcgaaaactttgggcccagcccttaaggtccactgggccccttccccgaaaggatttcttggccacccctttctttgctttgcctgggggggcccgggaaaaatttggggaagagaacacaggggccattctttgggaaatttccgccaacgtggtttttcccccccagtgtttgggaaattttggggttcccccccgggggggggggggggcccttcgggggatatttcggggtccccccccagggaaaaaatattggtttctaaaaaaaaaacccccctctccggaaaaagaaaaatttcagaaaaccacaaaatatattcccccgccccccgagaaaaaaaaaaaaaacacctcctcacaaaaggggttttttgggttcctcca

SEQ ID NO: 80024 - protein, 81 aa, Zea mays
  misc_feature: Ceres CLONE 1565215
MDVDGPAPADASARPATNGEAPSGAREVDVGEEDTLAGVLRSFVDGVWYPDEPLLRRLRAASCDAAPRLRGASRNSARGPA

SEQ ID NO: 80025 - DNA, 1075 bp, Zea mays
  misc_feature: Ceres CLONE 1565218
  misc_feature: Encodes the peptide sequence at SEQ ID NO. 80026
  misc_feature (1055)..(1055): n is a, c, t, g, unknown, or other
ccccgcggtggcggccgctctagaactagtggatcccccgggctgcaggaattcgtctcacccctagaaaaagacacacacacactcgtcgacgaacgacgacgacgagcacgagcacgagcagcgcctgacgctcggctccgacccgcgcgcgtcgatggcgatgagtgacacaggctcgagcttcgcgcagtgggccgcgctctaccaccaccaccaccacgacgccgggccggtcctgctgccccccgacgacgacgccggcaccaccgctgcggccgccgccgtagcgagcccgacatcgggcgggtcccgctgaggaagcccccccaaggtcggggcccctcctctgcccccggtaaagggggcgcggatagggaaaactgtgtgtgctggggccccccccccgcgtcgggggaggcggcccgtgacccttctggaaaaggagaccggtccgactttcgtgggcgggggggaagtgcgttcatgggggatattccgcgcccccccgcgggggggggtttctgagagccccccgtggattcgaattttgaccagacacaacggagagggggtgccctttacgggctccacgtggcggcgcgggcgcggggtctcgttggcgaagaaattcatcagaggcaccagcggagacgcatcgacagcgccaccggttaccgcacctgtgccacgtgagacgggcggatctgtctcggcatgtggtcacgcgacgtatgcgatctgagtatgtaggattagccttcgcgagcggagcgctgtgtgcggaggacccgtcctagtggtctccaagtagtatacacaagtgaggttgggtgatattgtggtggcgtacgatgccgcatcggccggacgaccaggcgaaaagtgccgtaagcttcgatgctgtcgggttgacgtcatctcacggatgcctgcgtcggcggtcgcgttcggcgctaaccggtgatgaacgcgacagcggtgcgtcccgataacttcacggcgagagctgcgggaaggggttccaccccagcgcctatgcttgtatatgtaantagtactagcgctgttcaag

SEQ ID NO: 80026 - protein, 53 aa, Zea mays
  misc_feature: Ceres CLONE 1565218
MAMSDTGSSFAQWAALYHHHHHDAGPVLLPPDDDAGTTAAAAAVASPTSGGSR

SEQ ID NO: 80027 - DNA, 838 bp, Zea mays
  misc_feature: Ceres CLONE 1565220
  misc_feature: Encodes the peptide sequence at SEQ ID NO. 80028
tccccgcggtggcggccgctctagaactagtggatcccccgggctgcaggaattcgtctcacccctagaaaaaaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggtgggtggagtcaaagcggtgggtggacttcttcaacccggactcccaggccgtggagtgggccacgccatggtcccgcaccgccgagaacttcgctaacttcaccggcgagcaggtctaccccgggcggcaagtttttcgacccgcttcggactcgccggcaccgtcaaggaacggcgtctacaatcccccacgtccaacaagctcgagcggcttcagcctggcccgaaaacaagcaccgcccgcatccgccatgctttgcccatgctcgccctt

SEQ ID NO: 80028 - protein, 235 aa, Zea mays
  misc_feature: Ceres CLONE 1565220
  misc_feature (58)..(198): Pfam Name: Chloroa_b-bind Pfam Description: Chlorophyll A-B binding protein
MALAPTSAAVLKTPFLGARRALANAAAKPAPRRALVVAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGWVESKRWVDFFNPDSQAVEWATPWSRTAENFANFTGEQVYPGRQVFRPASDSPAPSRNGVYNPPRPTSSSGFSLARKQAPPASAMLCPCSP

SEQ ID NO: 80029 - DNA, 862 bp, Zea mays
  misc_feature: Ceres CLONE 1565221
  misc_feature: Encodes the peptide sequence at SEQ ID NO. 80030
  misc_feature (578)..(578): n is a, c, t, g, unknown, or other
  misc_feature (617)..(617): n is a, c, t, g, unknown, or other
ctccccgcggtggcggccgctctagaactagtggatcccccgggctgcaggaattcgtctcacccctagaaaaagatgtgcttcttaatggtatacttgcaattggcacacttggccatcacgtggactcactttgccctgtggcttgcattgaagaagatgatctctttaccatggatgatgagaaagcaattgtggaagagagagatgatgaggaacccaggaatgatcaggtgaaagaagatgttgcattggaaacagagccatgtgaaccagtatggcctattgttgagcctgctaagatgcattcattgtcaatgaaagaagacaactttacatgctttgtagcagaagaaatcctgatacgtgaggtggaagatgggggaggtgctaatatccaggaacgaccacttctgatgttagaaaaggtggagaaagtaagaactacacttgctgatttatttgcagcagaagtattctcatcaagttctcctaggggagtatagttgccaggatatcattgacgttgctgtggcatccacttcaaagcatgcatcatgcatggaaaagatgcatcnaaagaaaccaggaagccacaccaaaaccactgaaagcgnacagaaaattaagtccggtcatgaagaagatgttgggggaagaagatccacccagagcagcttcatgggcgtaccaatgcaaagggcccctttactgcatgatgtttattctggccaacaattggcttccccaattgggtcacctgggatccctaagggctcaaattcttgccaaaaaaagctccatggacactcccccaacaaatgggaaattccccttttttggtggtgggggttttcccccc

SEQ ID NO: 80030 - protein, 167 aa, Zea mays
  misc_feature: Ceres CLONE 1565221
PRGGGRSRTSGSPGLQEFVSPLEKDVLLNGILAIGTLGHHVDSLCPVACIEEDDLFTMDDEKAIVEERDDEEPRNDQVKEDVALETEPCEPVWPIVEPAKMHSLSMKEDNFTCFVAEEILIREVEDGGGANIQERPLLMLEKVEKVRTTLADLFAAEVFSSSSPRGV

SEQ ID NO: 80031 - DNA, 848 bp, Zea mays
  misc_feature: Ceres CLONE 1565222
  misc_feature: Encodes the peptide sequence at SEQ ID NO. 80032
ggcggccgctctagaactagtggatcccccgggctgcaggaattcgactcacccctagaaaaaacccacgcacactcttctccccccagtccggaccccgaaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcaccgagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgttcaagaagaccatcgccgactacggctctcccgaggagttcctctcccagggcgactacctgctcgggaggcaagccctacgggggcagaccgactccgagggcgggttcgagaccggggcccggggccacccgccaacggcctggagaggccccacccccgtgatcgacgggaagcaagacttacgccctttcccgggcctcccaagaacaggggaacgggaacaaagggggggaaagaaccgtttcattggggcccaccggtctccgaaagggggagtttctaattttgaaaagggccaagggcggggaaaa

SEQ ID NO: 80032 - protein, 245 aa, Zea mays
  misc_feature: Ceres CLONE 1565222
  misc_feature (57)..(240): Pfam Name: PsbP Pfam Description: PsbP
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTFKKTIADYGSPEEFLSQGDYLLGRQALRGQTDSEGGFETGARGHPPTAWRGPTPVIDGKQDLRPFPGLPRTGEREQRGGKNRFIGAHRSPKGGVSNFEKGQGRGK

SEQ ID NO: 80033 - DNA, 861 bp, Zea mays
  misc_feature: Ceres CLONE 1565224
  misc_feature: Encodes the peptide sequence at SEQ ID NO. 80034
ccccgcggtggcggccgctctagaactagtggatcccccgggctgcaggaattcgtctcacccctagaaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagcccttcacttcgaaggactcctggaagacctcggttctgctttttcaggttcaattgtactgctgcatgcctgtgctccaaccctactggagtagatactaccatcgaacagggggaccgaataggcagctgatgagatcaaaaatcctgcttccggttctttgaccgggcctattaaggcttttgcaggggaaagtcttgaacaaaaagctccaatcagggcggaaggtttggttgccgaag

SEQ ID NO: 80034 - protein, 207 aa, Zea mays
  misc_feature: Ceres CLONE 1565224
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSPSLRRTPGRPRFCFFRFNCTAACLCSNPTGVDTTIEQGDRIGS

SEQ ID NO: 80035 - DNA, 730 bp, Zea mays
  misc_feature: Ceres CLONE 1565225
  misc_feature: Translation starting site: 161
ctccccgcggtggcggccgctctagaactagtggatcccccgggctgcaggaattcgtctcacccctagaaaaaagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctggggcgcggtgggcgccatcgcccccggagatcttcggcaagatgggcatcatcccgccggagaccgcgctgccgtggttcaaagacggggcgtcatcccgccccgcgggcacctaccaactactggggcccgacttcctcaacgctctttcgtccttcaaatggcgcctccatggggctttcccccagccaccgcccgccctccgggaacgggggtacaacccgggggctcccagggggcaaagcagattctttccccggg

SEQ ID NO: 80036 - DNA, 977 bp, Zea mays
  misc_feature: Ceres CLONE 1565228
  misc_feature: Encodes the peptide sequence at SEQ ID NO. 80037
ctccccgcggtggcggccgctctagaactagtggatcccccgggctgcaggaattcgtctcacccctagaaaaaacggaaaatccaatcagggaaaaaatccatttccctttcttctgaagtcgtcctcttcttcccgtcgcttcgccgtgccgcacctgcgaggagaggagacttcgccgcgaagctcaccatgatctcgccggagaggagctcgtcacagagccagcggtcggcggcggcgggggcgccgttcctgtcgatctccgtcacggatcccgtaaagatgggtaccggcgtgcagtcctacatctcctaccgcgtcatcaccaagaccaacctccctgaatttgagggaccagagaaaattgtttattcggcgcttatagtgattcccccaccgccccccccacatccaaacttgctaaaaagggaccaaagggcatttttttataccccccctctttccggagaaagaaaggctggttgaagaaaaattccccggttttagcaaggggggggttccatttgtaatttggggggcggttccaaggctccgtggggttttttttttcgcttttaaccgggggggtgggctttctcccccccccccggttaacccctctcaaggtaaaaaaggtgggctcgcggtcctttgggagggggagcattttttttttgggccaggcctccctattgtgacgtgggagtttagtggggtatatggggggccacaaatattccttttctcggaggaaatggggaactttttgtttaaaaatgaaccgggggcaaaatgttttcgataaccctcaatggtttttaaagggatgtgtgggcaatttcaaaagagtcccgagtgaatggtgtgtgttccgggggggaaaaagaaacaacctctggtggtggagggaaaaccccccccccgctaagattaggagaaggcgtatcaaaatattcacattgttggggcgggag

SEQ ID NO: 80037 - protein, 98 aa, Zea mays
  misc_feature: Ceres CLONE 1565228
MISPERSSSQSQRSAAAGAPFLSISVTDPVKMGTGVQSYISYRVITKTNLPEFEGPEKIVYSALIVIPPPPPPHPNLLKRDQRAFFYTPPLSGERKAG

SEQ ID NO: 80038 - DNA, 779 bp, Zea mays
  misc_feature: Ceres CLONE 1565229
  misc_feature: Encodes the peptide sequence at SEQ ID NO. 80039
  misc_feature (650)..(650): n is a, c, t, g, unknown, or other
ggagctccccgcggtggcggccgctctagaactagtggatcccccgggctgcaggaattcgtctcacccctagaaaaaaggggagtgcatcctcctcctcctcctcctcctccttcccctaccctccccgcgcgcagatcccgacgcgggacgcctgcattcccttgcgcgggacgcgacaactccacgctacacagttcacacgccaagcgagggccgcatctagatccgcgccgccgagctgacttgactattgcaagtttgcgacccaccgccacgcctgcttctccccccggcccgcgatctacccggcccgggcgccgttgctgctactggtattactaatactactaccacgtcgtagcgaaggcagggacttgaggagcgggtgggatgcgatggccgccgcggggaggaatgcgggcgtactcgcgctcttcgacgtcgacgagcacctcacagagccgcgcaagggggtgacgccatagatgctagagttcatgaagcagctgcgtcagcatgtgatagtgggtgtgggtggcgtatccgatctcgtgaagattactgagcgctcggcagcacaggtatactgattatgataacgtcgtgctcgatgaccgcctggttgcgcacctgaatgccaactcttnggaacccaaagtttgaaatcatgtatcgcagaggactgcctgaaagaaatttatgaactttccttttgcattaccttggctgaactgggaaatcccaattgaaaaagggtcccattccaaaaagttccc

SEQ ID NO: 80039 - protein, 29 aa, Zea mays
  misc_feature: Ceres CLONE 1565229
MAAAGRNAGVLALFDVDEHLTEPRKGVTP

SEQ ID NO: 80040 - DNA, 887 bp, Zea mays
  misc_feature: Ceres CLONE 1565230
  misc_feature: Encodes the peptide sequence at SEQ ID NO. 80041
  misc_feature (521)..(521): n is a, c, t, g, unknown, or other
  misc_feature (526)..(526): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (612)..(612): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (709)..(709): n is a, c, t, g, unknown, or other
  misc_feature (710)..(710): n is a, c, t, g, unknown, or other
  misc_feature (731)..(731): n is a, c, t, g, unknown, or other
  misc_feature (734)..(734): n is a, c, t, g, unknown, or other
  misc_feature (735)..(735): n is a, c, t, g, unknown, or other
  misc_feature (766)..(766): n is a, c, t, g, unknown, or other
  misc_feature (768)..(768): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (851)..(851): n is a, c, t, g, unknown, or other
ctccccgcggtggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcgcngctangtggtgtgagaaaaaaaggggggggggggggggggnnnnnnnnnaaggggggggggggaggaaaaagggggggggggggagaaggnggggggaaaaagaggggggggaaatagggggggaaaaaggaaaaggggggggggggagggaaaaaatggaaaannnttggggggaaaaaaaaaaaanntaaagggattttaataaattnaannttttttttaaatggggaaaattggggtattnanaattttaaagggggggaaattttgtggggtttgtatgggaaaaaaaaaaaggtttttnnnnaaagagaagaaaaattttttgnaaaaaaggagggaatattttttgggaaaaaaaaaaa

SEQ ID NO: 80041 - protein, 184 aa, Zea mays
  misc_feature: Ceres CLONE 1565230
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (124)..(124): Xaa is any aa, unknown, or other
  misc_feature (136)..(136): Xaa is any aa, unknown, or other
  misc_feature (137)..(137): Xaa is any aa, unknown, or other
  misc_feature (138)..(138): Xaa is any aa, unknown, or other
  misc_feature (139)..(139): Xaa is any aa, unknown, or other
  misc_feature (153)..(153): Xaa is any aa, unknown, or other
  misc_feature (177)..(177): Xaa is any aa, unknown, or other
  misc_feature (178)..(178): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGAAXWCEKKRGGGGGXXXXGGGGRKKGGGGRRXGEKEGGEIGGEKGKGGGGREKMEXXWGEKKK

SEQ ID NO: 80042 - DNA, 820 bp, Zea mays
  misc_feature: Ceres CLONE 1565235
  misc_feature (323)..(323): n is a, c, t, g, unknown, or other
  misc_feature (329)..(329): n is a, c, t, g, unknown, or other
  misc_feature (330)..(330): n is a, c, t, g, unknown, or other
  misc_feature (413)..(413): n is a, c, t, g, unknown, or other
  misc_feature (757)..(757): n is a, c, t, g, unknown, or other
ctcaccgcggtggcggccgctctagaactagtggatcccccgggctgcaggaattcgtctcacccctagaaaaagcgcaaaacacctcgccttttgtactcttgcgtctctgccctcgcgttatcgccttcgtcacgctcgctcgcctggctggcttgtgtgccttgccttgctcggcgtacgcgaacgcagcgagagggaggagcaaggaaatagagagagacagagagagagagagagaaaaaatcaaagtcatccccccctttctctgagctcgttcatggagactcttctcacagcgggcgccggagccggcgaactcntccccnngcgctgcggaaaaggagggctcgccccaggccacccccaaaagctgcggccccaagacctgcccacattgtgaaggaaaaacngaaccggccccgggcggggaacctaagttggtatttcggaaacctggaagagggaaaacccccctttacaaggcccccaaaagccccgggccccaaaatggggttcttgtctaaaaccttaaaaaaaaaatgggggtccccccccccccctttttgggaaaaaaaagggcccgggccccccgggggccaaaaaaaacccccccccccctctcaaagagaaaaaatatgggggttttttgaaaaaagaaaaaatatttttttggggggagggggggggttttttttgggggggtttttccccccccggggaggagggggggggggggggtttttttttttccccncccccccccgggggggaaaaaaaaaaaaatttttttggcgcgcccccctcttttcttttttgc

SEQ ID NO: 80043 - DNA, 863 bp, Zea mays
  misc_feature: Ceres CLONE 1565236
  misc_feature: Encodes the peptide sequence at SEQ ID NO. 80044
ctggagctccccgcggtggcggccgctctagaactagtggatcccccgggctgcaggaattcgtctcacccctagaaaaagagcctcgtagacgaagcagaggaaaccagcgaaatcaaagagcaaggaagcaagaagcagggagccatggcgttcctccttcccaagctcacaacgccgtcctgcaagttgcccccaagtcccctcctcaagccccagctcgctcagccggtccacggcggcggcaagattcaaggctccgtcttcggctctgttgcggcgcatgtcgcggccccgggccacctcagtctcctgctcctgctcagcgcctcgcaacaagcagccgccccggcggccaaatccaccgcgaccaacaaccagggcaagggcggcggggatccgcaaaggtcggatttttacctcaacctcgggaccgcggtgcgcacgctgcaggacgacctgccccgacgtcttcgtccggggagccaactacgatatcttaccgtgaagacatcacattttgtcgacgcactaaacactttttcattgggattgacaactaccaaactatctttctgggggccttagaataccacggggggcccactatttccaagaaattggggccttgaaggtatcaccccaatttggcaaccggaccaaaaaattccataaatttttccgggggggaaacctttggggggaaccccccaatgtttcccgggggaaaaagaaaagggctcccccttacaggggaagcccccgaaaaaaaaaggtttgtaccgggaaccgggaaaattttttggaggcccccaaattcccaacaattggcggatgaggaaatttccccccaacctcttaag

SEQ ID NO: 80044 - protein, 146 aa, Zea mays
  misc_feature: Ceres CLONE 1565236
MAFLLPKLTTPSCKLPPSPLLKPQLAQPVHGGGKIQGSVFGSVAAHVAAPGHLSLLLLLSASQQAAAPAAKSTATNNQGKGGGDPQRSDFYLNLGTAVRTLQDDLPRRLRPGSQLRYLTVKTSHFVDALNTFSLGLTTTKLSFWGP

SEQ ID NO: 80045 - DNA, 848 bp, Zea mays
  misc_feature: Ceres CLONE 1565237
  misc_feature: Encodes the peptide sequence at SEQ ID NO. 80046
ctggagctccccgcggtggcggccgctctagaactagtggatcccccgggctgcaggaattcgtctcacccctagaaaaaaggggacaaggaacaggggacaggcacagccgcacagccgccgcccctccatccacctctccacaccatctgacgctgctcccaccgaggtctccaaggctcactcctcaccagcttctgctctctccctcctcatctctgctctgctctggaccgttaactctccagctccccctcgctccgttcccttccgcccaaatcactgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccaatgataagtcagtggaggtcatgcgcaagttctccgagcagtacgcccgccgctccaacactttcttctgcgccgacaagacagtcactgccgtcgtcatcaagggacttgctgatcacagggatactcttggagctcctctatgcccttgtaggcattatgatgacaaagctgcggaggtagcacaaggattttggaattgcccatgcgtccccatgcgtgagaggaaggaaatgcactgtatgcttttttctactcccgataatgactttgctgggaaggatcaggttatctccttcgaggagatcaaaagagcgacatccaaattctaagcccctgtatttgtcacggaagtgtttacttgacaggctaatttttaatatggaat

SEQ ID NO: 80046 - protein, 152 aa, Zea mays
  misc_feature: Ceres CLONE 1565237
  misc_feature (45)..(149): Pfam Name: FeThRed_B Pfam Description: Ferredoxin thioredoxin reductase catalytic beta chain
MTSTVTTTVGCGGLPVRPLSTATRGRPRRCAVRAQAAGADASNDKSVEVMRKFSEQYARRSNTFFCADKTVTAVVIKGLADHRDTLGAPLCPCRHYDDKAAEVAQGFWNCPCVPMRERKEMHCMLFSTPDNDFAGKDQVISFEEIKRATSKF

SEQ ID NO: 80047 - DNA, 856 bp, Zea mays
  misc_feature: Ceres CLONE 1565238
  misc_feature: Encodes the peptide sequence at SEQ ID NO. 80048
  misc_feature (609)..(609): n is a, c, t, g, unknown, or other
  misc_feature (829)..(829): n is a, c, t, g, unknown, or other
aagctggagctccccgcggtggcggccgctctagaactagtggatcccccgggctgcaggaattcgtctcacccctagaaaaaacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccaggacggcgtctccagggagctggcgcacgcctgaagaccctgatccatccatgtctgtccaccacgctatgtacgtatgtgtagcagatggttacatctnacgtgttagaccaactccagcagcactccgcatgcggctccggatccctattttgcggagcctagctcactattcatcagtccagcaggctccgcatccggctccgtaaaacgcacggcctgtacctgcactccccatttccacgctttctctctcctctcgcaagctctctgcgtgcgcgcgcggctgctcgcgggccccaggtgtcataactgctgcngagttggggatgtggagtgttgcttga

SEQ ID NO: 80048 - protein, 138 aa, Zea mays; identical to SEQ ID NO: 75588
  misc_feature: Ceres CLONE 1565238
  misc_feature (1)..(126): Pfam Name: Lir1 Pfam Description: Light regulated protein Lir1

SEQ ID NO: 80049 - DNA, 1011 bp, Zea mays
  misc_feature: Ceres CLONE 1565241
  misc_feature: Encodes the peptide sequence at SEQ ID NO. 80050
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
  misc_feature (980)..(980): n is a, c, t, g, unknown, or other
  misc_feature (981)..(981): n is a, c, t, g, unknown, or other
  misc_feature (982)..(982): n is a, c, t, g, unknown, or other
  misc_feature (983)..(983): n is a, c, t, g, unknown, or other
  misc_feature (984)..(984): n is a, c, t, g, unknown, or other
  misc_feature (985)..(985): n is a, c, t, g, unknown, or other
  misc_feature (986)..(986): n is a, c, t, g, unknown, or other
  misc_feature (987)..(987): n is a, c, t, g, unknown, or other
  misc_feature (988)..(988): n is a, c, t, g, unknown, or other
  misc_feature (989)..(989): n is a, c, t, g, unknown, or other
  misc_feature (990)..(990): n is a, c, t, g, unknown, or other
  misc_feature (991)..(991): n is a, c, t, g, unknown, or other
  misc_feature (992)..(992): n is a, c, t, g, unknown, or other
  misc_feature (993)..(993): n is a, c, t, g, unknown, or other
  misc_feature (994)..(994): n is a, c, t, g, unknown, or other
  misc_feature (995)..(995): n is a, c, t, g, unknown, or other
  misc_feature (996)..(996): n is a, c, t, g, unknown, or other
  misc_feature (997)..(997): n is a, c, t, g, unknown, or other
  misc_feature (998)..(998): n is a, c, t, g, unknown, or other
  misc_feature (999)..(999): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
  misc_feature (1003)..(1003): n is a, c, t, g, unknown, or other
  misc_feature (1004)..(1004): n is a, c, t, g, unknown, or other
  misc_feature (1005)..(1005): n is a, c, t, g, unknown, or other
  misc_feature (1006)..(1006): n is a, c, t, g, unknown, or other
  misc_feature (1007)..(1007): n is a, c, t, g, unknown, or other
  misc_feature (1008)..(1008): n is a, c, t, g, unknown, or other
  misc_feature (1009)..(1009): n is a, c, t, g, unknown, or other
  misc_feature (1010)..(1010): n is a, c, t, g, unknown, or other
  misc_feature (1011)..(1011): n is a, c, t, g, unknown, or other
aaagctggagctcaccgcggtggcggccgctctagaactagtggatcccccgggctgcaggaattcgtctcacccctagaaaaaaacctctcctccttcggatcgtcgctcgctcgctctcgctctcgctccactccagtccaagtcccagcccgccaggaggccggagcatcgcgcctgcaccgcacgcccacaggcccacagcaagcaccaaacaagccacacgatggcgctcctggtgctgcgcgcgcctgcagccgtccacgcggcctcccggctgctccctccgccgcggcggcggcggcggcggctcgtggccgtcgcctcggcggcgtcctccgcgccgtccggcgaggtgtcgtcccagcacggcggcggcggcggcggctaggggaatctctggggccnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 80050 - protein, 54 aa, Zea mays
  misc_feature: Ceres CLONE 1565241
MALLVLRAPAAVHAASRLLPPPRRRRRRLVAVASAASSAPSGEVSSQHGGGGGG

SEQ ID NO: 80051 - DNA, 849 bp, Zea mays
  misc_feature: Ceres CLONE 1565242
  misc_feature: Encodes the peptide sequence at SEQ ID NO. 80052
aagctggagctcaccgcggtggcggccgctctagactagtggatcccccgggctgcaggaattcgtctcacccctagaaaactcgcctcggttggtgccctctctgccgccgcggacgagagtcgccaccaccaccaccatccagccagccccttcccttccccagcagcagtctccagccgcagccatggccaagccaccgccgcccacctccacctccgaccccgcgctccccaccactgctacaaccacctcgtcggcccccaagtcgtcgtctcgcccctccccccgcccccggggcctcctcgatccgctcgcagcctccgcgcgctcccctcctcgctcggcgcgccgctccccggtcaccacgttaggcgccggctttcttctcctcgcgctcgtcatgtacggggaggacgcccgcaacatcgccgaagctctcatcgacgactacctctacccggacgccgacttttaaaggtcttcgggctggcggccctttggggtgcccccggttacttggaacttttccgggggaagagggggttttgaaaaaagtctccgtttccggggtaccgggaaaaaaaatgaccctttcctcccaaaaaggggtccttgggtctcccaaaagggcccccccaaaaaaatggggggaaatctgggagaaggggggcccccagaggggggcccccccccccccctttttaaacacccgggggaaaatttttgggggggggaaaatccccggggaaaaaccgcgccccatttttttgtgggggggggggaaatttctttataaaaaacacacaccacaggggggggggggcccccccttgggggggggctccc

SEQ ID NO: 80052 - protein, 96 aa, Zea mays
  misc_feature: Ceres CLONE 1565242
MAKPPPPTSTSDPALPTTATTTSSAPKSSSRPSPRPRGLLDPLAASARSPPRSARRSPVTTLGAGFLLLALVMYGEDARNIAEALIDDYLYPDADF

SEQ ID NO: 80053 - DNA, 857 bp, Zea mays
  misc_feature: Ceres CLONE 1565243
  misc_feature: Encodes the peptide sequence at SEQ ID NO. 80054
  misc_feature (123)..(123): n is a, c, t, g, unknown, or other
  misc_feature (320)..(320): n is a, c, t, g, unknown, or other
  misc_feature (341)..(341): n is a, c, t, g, unknown, or other
  misc_feature (383)..(383): n is a, c, t, g, unknown, or other
  misc_feature (396)..(396): n is a, c, t, g, unknown, or other
ctccccgcggtggcggccgctctagaactagtggatcccccgggctgcaggaattcgtctcacccctagaaaaattctgttactctagctgacattgtattgacatgcaacctcctaccatgngaattgcacggatcttgaccaaaagcttcacttctgatttccctcatgttgagaggtatttctggaccatggttaaccaacctaatttcaagaaggtcattggtgaggtcaagcaggcagagtctgtacctcctgttcttaaaaagggtgttcctcctaaggagtcaaaggcaaaggatgtgaagaaagaaactccnaaggaggccccccagccaaangtggttgaggtaccagcagaagaagaagcacccaaagccaangcccaagaatccntcctgaccctgctgccaccaagcaagatggtccttgatgactggaaaaggctatactcaaaaccaaaagacaacttcccgggaagtttgcaatccaagggtttcttgggaaaatgttttgacccaaaggggctacccccccggggggttctcgtggcccccaggtcccattggcccgaaaaccccctcctcccttttggaaaccctaaaaaaagggtggggtgtaatccccgcccacgaaaagaaccccttcccccaaaaaaacccccttttggaaaaaacccctccggggggggtttttaagaccccccccctaagaataaaaggggctttttgttttttttccgggggcggaaggggtttccccagttttttataagaggaaaaaggcttttaaaaagagagggttctcccacaggggggcaacgaggggctacactttttttatagagggcgccagaa

SEQ ID NO: 80054 - protein, 192 aa, Zea mays
  misc_feature: Ceres CLONE 1565243
  misc_feature (2)..(2): Xaa is any aa, unknown, or other
  misc_feature (74)..(74): Xaa is any aa, unknown, or other
  misc_feature (88)..(88): Xaa is any aa, unknown, or other
  misc_feature (93)..(93): Xaa is any aa, unknown, or other
MXIARILTKSFTSDFPHVERYFWTMVNQPNFKKVIGEVKQAESVPPVLKKGVPPKESKAKDVKKETPKEAPQPXVVEVPAEEEAPKAXAQESXLTLLPPSKMVLDDWKRLYSKPKDNFPGSLQSKGFLGKCFDPKGLPPRGVLVAPRSHWPENPLLPFGNPKKRVGCNPRPRKEPLPPKKPPFGKNPSGGGF

SEQ ID NO: 80055 - DNA, 842 bp, Zea mays
  misc_feature: Ceres CLONE 1565244
  misc_feature: Encodes the peptide sequence at SEQ ID NO. 80056
  misc_feature (776)..(776): n is a, c, t, g, unknown, or other
ctccccgcggtggcggccgctctagaactagtggatcccccgggctgcaggaattcgtctcacccctagaaaaacttttgcagatatggagcagaagggcgccggtccgggagcacggagctcccacgccatcacgctgctcgggggcacggcctactcgttcggcggcgagctcaccccgcgcgtcccggtggacagcaccatgtacgccttcgacctcaacacccagacgtggtcggcgctggacgcgacgggcgacgtgccgccgccgcgcgtgggcgtgaccatggcggccgcaggcggcacggtgttcacgttcggcgggcgcgacctggagcacaaggagctgaacgagctctacgctttcgacgcggcggcgcgggcgtggacgctgctgtcgtccggcgccgacggcccgccgcaccgcagctaccactccatgacggcggacgcgggcgcggggcgggtgtacgtgttcggcgggtgcggcgacgccggccgcctcaacgacctgtgggcgtacgacgtggcggtggggcaatgggagcagctgccgccgccgggggaggcgtgccagccgcgcggcgggcccgggctggtcgtcccggcggaaagtgttgggtggttgtacgggttctcgggcgaggagctggacgacgtgcactgctacgacccggccacccgggagtgggccgcggtcagaccacgggcgacaggccagccccccggagcgtgttctgcgccgccgggtccgggaggcacgtggtgctgtttcngcggcgaaggtgaacccagtgacctcggccacctcggcgccgggcagtcttccgccgaggcgttcc

SEQ ID NO: 80056 - protein, 252 aa, Zea mays
  misc_feature: Ceres CLONE 1565244
  misc_feature (62)..(108): Pfam Name: Kelch_1 Pfam Description: Kelch motif
  misc_feature (115)..(160): Pfam Name: Kelch_1 Pfam Description: Kelch motif
  misc_feature: SWISSPROT Homolog: EC 3.1.3.16 Phosphoprotein phosphatase
  misc_feature (231)..(231): Xaa is any aa, unknown, or other
MEQKGAGPGARSSHAITLLGGTAYSFGGELTPRVPVDSTMYAFDLNTQTWSALDATGDVPPPRVGVTMAAAGGTVFTFGGRDLEHKELNELYAFDAAARAWTLLSSGADGPPHRSYHSMTADAGAGRVYVFGGCGDAGRLNDLWAYDVAVGQWEQLPPPGEACQPRGGPGLVVPAESVGWLYGFSGEELDDVHCYDPATREWAAVRPRATGQPPGACSAPPGPGGTWCCFXGEGEPSDLGHLGAGQSSAEAF

SEQ ID NO: 80057 - DNA, 875 bp, Zea mays
  misc_feature: Ceres CLONE 1565245
  misc_feature: Encodes the peptide sequence at SEQ ID NO. 80058
  misc_feature (842)..(842): n is a, c, t, g, unknown, or other
gagctccccgcggtggcggccgctctagaactagtggatcccccgggctgcaggaattcgtctcacccctagaaaaacttttgcagatatggagcagaagggcgccggtccgggagcacggagctcccacgccatcacgctgctcgggggcacggcctactcattcggtggcgagctcaccccgcgcgtcccggtggacagcaccatgtacgccttcgacctcaacacctagacgtggtcggcgctggacgcgacgggcgacgtgccgccgccgcgcgtgggcatgaccatggcggccgcaggcggcacggggttcacgttcggcgggcgccacctgcagcacaaggagctgaacgagatctacgctttcgacgcggaggcgcgggcgtggaccctgctgtcgaccggcaccgactgtccgccgcaccgtagctaccactccatgacggcggatacgggcgcggggcgggtgtacatgttccgcgggtgcggcgacggcggccgccttcacgacatgtgggcgtacgacgttgcgggtgggcaatgggagcagctgccgccctccgggggaagcttgcaaccttctccgcgggcccggggttggtcttcgcccgaatggaaagtggtcggtgggggtaccgggttcttcgcgccgaaggagctggaacaaactttcccttgttttaaaaccccggcccccccgggggaatggggcctcgggtccccagaaaaaccggaggggaaaaggggcccaccccccccccaaaaaagatttttctttgcttctcctcccgggttttctggaagaaaacccctgtgggggatttaataggagccgcccngctaaagggggggacacccctccatgttaacac

SEQ ID NO: 80058 - protein, 179 aa, Zea mays
  misc_feature: Ceres CLONE 1565245
  misc_feature (48)..(93): Pfam Name: Kelch_1 Pfam Description: Kelch motif
MAAAGGTGFTFGGRHLQHKELNEIYAFDAEARAWTLLSTGTDCPPHRSYHSMTADTGAGRVYMFRGCGDGGRLHDMWAYDVAGGQWEQLPPSGGSLQPSPRARGWSSPEWKVVGGGTGFFAPKELEQTFPCFKTPAPPGEWGLGSPEKPEGKRGPPPPQKRFFFASPPGFSGRKPLWGI

SEQ ID NO: 80059 - DNA, 832 bp, Zea mays
  misc_feature: Ceres CLONE 1565246
  misc_feature: Translation starting site: 150
ctccccgcggtggcggccgctctagaactagtggatcccccgggctgcaggaattcgtctcacccctagaaaaaactcgacgcctcctccggcgatgcgtcgtgtggccgtcgtctcccgttcggaacgcctagcccccctctgggaaaatggtccccaagcgaggtggcagggtgcctgtgccggccaataagaacactgataaagtgaccaatcctctgtttgagaagaggccgaatcagtttggcattcgcggcgcgttgttgcccaagaatgacctgcaccggttcgtccagtggtccaaagtcgtgcgtatccagcgccagcgcatgatcttcaagcagcgcctcaaggtaccagcggggctggatcagtttacccgcacctctcgacaagaacctcactacgaacctgtttaagatgcttctcaagtaccggcctgaagacaaggctgccaagaaggagaggcttctgaagagtgctcaagctgataatgaaggaaaaactgttgagtcgaagatatcaattgttgtgaagtatggccttaagcatgtgacttacctcattgagcagaacacagctcaacttgttgacatcgctcatgacgttgatccgattgaaatgacaatgtggcttacggccctgatgcagatgtagatgtcccttactgcattgcaaaggagaagctaggcctggatcgattgttcacaagagaaagaatcgatctgctgtgtcacgatgtcagaactcagtataggcttagatcagccggatttggaagctattacggtgactttcacgacgagttctatgaggtcagcaaaattgtggt

SEQ ID NO: 80060 - DNA, 881 bp, Zea mays
  misc_feature: Ceres CLONE 1565248
  misc_feature: Encodes the peptide sequence at SEQ ID NO. 80061
gagctccccgcggtggcggccgctctagaactagtggatcccccgggctgcaggaattcgtctcacccctagaaaaagccaaccgcgaagcactacactacactagcaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctggttccccgcggcggcgcgccgcggcggcggcagcgggcggttggtcgccgtgcggtccagcgggccggccacgccgccggagatctccgacaaggtgtcggagagcatcaagcaagcggaggagacgtgcgcggacgaccagaagggcgacgcctagtgcgcggcggcgtgggacgaggtggaggagctcagcgccacgagccagcacgcccgcgacagcctcaaggagaccaacgccaacgagccgctcgagaagtactgcaaggacagctgccattgctcgtccgcatcctccttggatttccctcccagggtacccctactccatggggcacggcatcccaatgcggattacctggcaattcccgaggaaccgaattgtgaaaagattgaactgggtccatttccggaatttttttttcctaaccaggttgggtggacccgttgaatgttttattaaagggggaattcggtacttccctcgagggattgtctttgggcatttcttttcaatgctttcaagagggttgcccagtcaaaggggga

SEQ ID NO: 80061 - protein, 94 aa, Zea mays; identical to SEQ ID NO: 79061
  misc_feature: Ceres CLONE 1565248

SEQ ID NO: 80062 - DNA, 828 bp, Zea mays
  misc_feature: Ceres CLONE 1565252
  misc_feature: Translation starting site: 156
  misc_feature: SWISSPROT Homolog: EC 2.7.7.13 Mannose-1-phosphate guanylyltransferase
  misc_feature (393)..(393): n is a, c, t, g, unknown, or other
acccgcggtggcggccgctctagaactagtggatcccccgggctgcaggaattcgtctcacccctagaaaaaatcgccataaatctcgccacgcccgcgcccgcgcgtgtctcttccccacaccactccgccaccggcgccgaagcagagcagccatggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgcagccggatcccccacctggcacagatatacctcatcgggttctatgaggagcgggagttcgcgctctatgtctcgtctatctcccacnagctcaggatccctgtcaggtacctacgagaggataagcctcacgggtcagctggagggctctacagctttagagatacatcatggaagacagtccgtcacacatatttctgctgaattgcgacgtctgttctagcttcccctcttcagacatgctagaggcccataaaaagtatggaggaatgggtactttactagtccacaagtatcagcagagtcagcaaaccagttcggcgaagttgtagcttatcctgaaacaaatgaactgctgccctttacaaaaaagccaaaaatttttgtgagtgattccctaaattgcggaaaatatatatttcctccccaaatactttgcgcccattgaggattttcttaaaccgaaaaaaggccggcgcaattttgcgggcgggtttctagcattaaagccctttctttcgca

SEQ ID NO: 80063 - DNA, 872 bp, Zea mays
  misc_feature: Ceres CLONE 1565253
  misc_feature: Translation starting site: 130
  misc_feature (381)..(381): n is a, c, t, g, unknown, or other
  misc_feature (397)..(397): n is a, c, t, g, unknown, or other
  misc_feature (399)..(399): n is a, c, t, g, unknown, or other
ctccccgcggtggcggccgctctagaactagtggatcccccgggctgcaggaattcgtctcacccctagaaaaattttctatccctccactccctcttatctgctgcgccatcctccccggcctccaccatggccacagccgccgcggccaccgcctcctcctccctcctcgcgccggcggccagcagcacggcgccggcctcgtcaaacgcgctgctgttcccctcctccgtgccgtcgctgcgtgcgtacccgcggctcctcctcgcgttccgccgccccgccgcggccgccgtcgccgacccgcagggggccgtgctcgaagaggaggcggaggtcgaccagcagggccagtacgacgacgacgacgggtatgagggncggggcgcggcccccncnttcacggcccccacgcgcccgcgcaccggcaaggccgcgctactgcttaagcgcgaccgcacgaggtcgaagaggttcctcgagatacagaagctgcgggagagcaagaaggactacgacgtgcccaccgccatctcgttgatgaagcagatgtccagtgccaagtttgttgagtcagcggaggcgcacttccgcatgaaactcgaccccaagtacaatgaccagcagctccgggccacggtgaatttgcccaagggaacaggccagtcggtggagattgcgggtctcacacaggtgagaagatagatgaggctagagctgcaggagctgatatcgtaggtggaagaagatttgatgaaacaataaagggaggatttatggagtttgaacaattgattgcatcacctgaaagatgcctaagggtgcgggccttaggtaaaatccttggaccaaaaggatggatgcctaaccca

SEQ ID NO: 80064 - DNA, 1094 bp, Zea mays
  misc_feature: Ceres CLONE 1565255
  misc_feature: Encodes the peptide sequence at SEQ ID NO. 80065
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (262)..(262): n is a, c, t, g, unknown, or other
  misc_feature (269)..(269): n is a, c, t, g, unknown, or other
  misc_feature (272)..(272): n is a, c, t, g, unknown, or other
  misc_feature (273)..(273): n is a, c, t, g, unknown, or other
  misc_feature (291)..(291): n is a, c, t, g, unknown, or other
  misc_feature (296)..(296): n is a, c, t, g, unknown, or other
  misc_feature (309)..(309): n is a, c, t, g, unknown, or other
  misc_feature (333)..(333): n is a, c, t, g, unknown, or other
  misc_feature (368)..(368): n is a, c, t, g, unknown, or other
  misc_feature (376)..(376): n is a, c, t, g, unknown, or other
  misc_feature (386)..(386): n is a, c, t, g, unknown, or other
  misc_feature (564)..(564): n is a, c, t, g, unknown, or other
  misc_feature (565)..(565): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccnnnnnnnnnnnnnnnnaaaaaggcctggggactccaccgncggtggncgnngccgctctagaaactagntcggnaactcccccgggnctgcaggaaacttcgtctcacccncctagaaaaaagccgccaccacagcagctcccacngctcaccngacgccacangcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgnntcgccgtgcgcgcccgcggcggaattccgacagggcggatctggtttcccccggcagcaaccccctccccccttggggctccgaccggggaggcctttccccgggccgactttccgggctttttgaatccccctggggggccctccgggaatcttggaacccccggaaaaaaacccctgccgggtggggaaacccgttccaaaggggccggaaaaccttgggggggaacaccttgcccccggggggggggggccaaaaaatcccccccgggccccccggggggggggggtatatttttttttaatatccccggggaaggattccccctgaaaccacaaaaaaaatgtggggggtttctccctaaaaaaaaaaagccccccttttttttggggaaaaaacacccccccgggggggaggaacaacccctttttttttttttttcccccggaacacccccccccccccccccccttttttttaaaaggggggggggttcccctcccccctctcctggggggggggggggggc

SEQ ID NO: 80065 - protein, 155 aa, Zea mays
  misc_feature: Ceres CLONE 1565255
  misc_feature (55)..(55): Xaa is any aa, unknown, or other
MALVSASSSSTTAVAALPRNGQQRASSSLFSSSSSSSFLVGKTLLRQAEAARPSXRRARPRRNSDRADLVSPGSNPLPPWGSDRGGLSPGRLSGLFESPWGALRESWNPRKKTPAGWGNPFQRGRKTLGGNTLPPGGGGQKIPPGPPGGGGYIFF

SEQ ID NO: 80066 - DNA, 1139 bp, Zea mays
  misc_feature: Ceres CLONE 1565256
  misc_feature: Encodes the peptide sequence at SEQ ID NO. 80067
  misc_feature (26)..(26): n is a, c, t, g, unknown, or other
  misc_feature (57)..(57): n is a, c, t, g, unknown, or other
  misc_feature (67)..(67): n is a, c, t, g, unknown, or other
  misc_feature (68)..(68): n is a, c, t, g, unknown, or other
tgttttttggtgttgttgttgtgtanttttagtggaggacccccggagcccttactnttttgttttnntttaaaactggagctcccgcggtggcggccgctctagactagtggatcccccgggctgcaggaattcgtctcacccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaaaaaggacctgcaccggttcgtcaagtggcccaaggtcgtgcgtatccagcgccagcgccgcatcctcaagcagcggctcatagtaccaccggcgctcatactttttcccccgcaccctccgaaaaaaacccccctcccaaaccgggtttaaaaaggccttccccaagtaccccggccttaaaaacaaaggctgccacaaaagggaaaaggcttcctgaaaaaggggccccccccctgtagaaattgaagggaaaaaacctggttgtgattccgaaaaaaaaaccaattttggtttggggaaaagtttttggggccctttaaaccccatgggttgaacctttaactccctctttttgggaggacaataaaacaagatgggccctccaacgcttttggtttttgtacatagcccccgcgtctgggggaaaaccggtgggtgtaccacccccaaatatgttaaaccctactggtttttcttgtgttgggagattttccacctacccccccttggttgtgccggaggagaaattagggggaggggtcccgccgctatcaccggacggggttggggtgagagaaaagaaaaaagaggcccttcccccttgggtggaaatgtctcgttgggtctcgcccagagagtaataaatgtgctattcgtgggtctggggtgttcgctcctaccccacggggttgggggaaaagagagggtgagtgtagcgtcttgagtgttcgccggcgcagaaatcctgtttgaggggctcatctttttgcgggacatcttctactcgcaacac

SEQ ID NO: 80067 - protein, 90 aa, Zea mays
  misc_feature: Ceres CLONE 1565256
MAPKRGGRAPVPAKKKTDKVTNPLFEKRPKQFGIGGALPPKKDLHRFVKWPKVVRIQRQRRILKQRLIVPPALILFPPHPPKKTPLPNRV

SEQ ID NO: 80068 - DNA, 802 bp, Zea mays
  misc_feature: Ceres CLONE 1565258
  misc_feature: Translation starting site: 142
  misc_feature (516)..(516): n is a, c, t, g, unknown, or other
aaagctggagctccccgcggtggcggccgctctagaactagtggatcccccgggctgcaggaattcgtctcacccctagaaaaaatcgccccgcgaaccctagctcccgcaactgccgccgccactcccacgctcgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcatcaaggcgctcaaggagccagagaggaaccgcaagaaggtcaagaacatcaagcacagcggcaacatcagcctcgacgacgtcatcgagatcgccaggaccatgaggcacaggtccatggccaaggtattnggccggcaccgtcaaggagatcctcggtacctgcgtcagcgtcgggtgcaccgtcgacggcaaggacccaagggactgcagcaggagattgacaacggcgaggtggagatccccgcccgcttaagaaaggattggggtccaagaacgggggttatctttggcggcgaaaaccatttccgggccaagaattttccccattttttttgaaagggggggggggggaacctgggaccctgaaaacatttgggggattttttccccccccggaaattttttgctcttaaaa

SEQ ID NO: 80069 - DNA, 902 bp, Zea mays
  misc_feature: Ceres CLONE 1565260
  misc_feature: Encodes the peptide sequence at SEQ ID NO. 80070
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
naaaaaaagggnnnngggggggnnnggggnnnngggnnnnttnnnngnnntggggttttnggggggnnnnnnccaaactggaactccagcgcggggcggccgctccagaagggtggatcccccgggccgtcccaattcgtggcacccctagaaaaactcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccggggctccatggggcaagcagtacttcctcgggcctcggagaagttccctcgcccgactccgggcgacccggtccctacccccgggcgaggcccccttccttcaaaccccgcctccgggctttcgggcaaag

SEQ ID NO: 80070 - protein, 214 aa, Zea mays
  misc_feature: Ceres CLONE 1565260
  misc_feature (55)..(212): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPETALPWFKTGVIPPAGTYNYWADSYTLFVFNMALMGFAEHRRLQDWYNPGLHGASSTSSGLGEVPSPDSGRPGPYPRARPPSFKPRLRAFGQ

SEQ ID NO: 80071 - DNA, 816 bp, Zea mays
  misc_feature: Ceres CLONE 1565263
  misc_feature: Translation starting site: 161
  misc_feature (646)..(646): n is a, c, t, g, unknown, or other
ctggagctccccgcggtggcggccgctctagaactagtggatcccccgggctgcaggaattcgtctcacccctagaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccacctcccctccccccgcggccgccgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccaggggcactggggcgagttcgtcaccccgggcctgctnctcctctacatcgccgggtggatccgggtgggtcggcaggagctacctcatcgccgtcagcggcgagagaagcccgccatggaggggaatcatcatcgacggtgagggtggcacccggctcctccccagggggttcatctgggcccgtcgcgcctaccgcgaagctctca

SEQ ID NO: 80072 - DNA, 1044 bp, Zea mays
  misc_feature: Ceres CLONE 1565264
  misc_feature: Encodes the peptide sequence at SEQ ID NO. 80073
  misc_feature (185)..(185): n is a, c, t, g, unknown, or other
  misc_feature (189)..(189): n is a, c, t, g, unknown, or other
  misc_feature (202)..(202): n is a, c, t, g, unknown, or other
  misc_feature (205)..(205): n is a, c, t, g, unknown, or other
  misc_feature (208)..(208): n is a, c, t, g, unknown, or other
  misc_feature (371)..(371): n is a, c, t, g, unknown, or other
  misc_feature (481)..(481): n is a, c, t, g, unknown, or other
  misc_feature (522)..(522): n is a, c, t, g, unknown, or other
  misc_feature (646)..(646): n is a, c, t, g, unknown, or other
  misc_feature (954)..(954): n is a, c, t, g, unknown, or other
aaagctggagctccccgcggtggcggccgctctagactagtggatcccccgggctgcaggaattcgtctcacccctagaaaaaagcacgtacacaccacaccagcacccagcctccccaacgatgacggcggcggcggcaccggcggtcgctagcagggtgtgggagtgggaagggaaggtggcntctngttttgtgtgttntcngcncctcaaatccggtctgtccctcttccgcgcccacctcgcatcctacaaatacgcgggcgtcgctctggtttcgaggggttttgagtctcatgccgcctatcccatcgggatggagttcgtggttccataggctctttttggcggtacatgcaactgtaccggngctctgtgtactcaagatttctttttcttttgaatccccccacatttgaatcctgaaattaccacctacttttataaggttgtcagttcttgattcctcttctttttttnaatttcatattatgactttttctgtttctttaatttcgacntatttgtgcaatgtgtattatgcctgaatttgatttttcttgcaactggagtattttttaagcattgttgacctaatgcattttttctttgtgtctggtttctttgtgtgtaaacttatttgantagtgtgtttgagataattataatttaaatacattatattatgcgcgaattttattatttctgttattttctattttctataccttcactgggaaactattaacgactgtgattattatgttaatggtatttatttagattcgttgtttctattttttttttttgattgtattgattcttgcgttgatgatgggggggatccatgaatctgtccacgtgtgggggggcgtttttctacgttattgtgtcaatatgtgggataatattatcttgggatgttctttatgatttgtatgtggtttatattnctatgtttgtctgcttgttctaatataaatacatttggttgttaatattacttgcgccgactataatacgaaggtatggttttatttttg

SEQ ID NO: 80073 - protein, 71 aa, Zea mays
  misc_feature: Ceres CLONE 1565264
  misc_feature (23)..(23): Xaa is any aa, unknown, or other
  misc_feature (27)..(27): Xaa is any aa, unknown, or other
  misc_feature (28)..(28): Xaa is any aa, unknown, or other
  misc_feature (29)..(29): Xaa is any aa, unknown, or other
MTAAAAPAVASRVWEWEGKVASXFVCXXXLKSGLSLFRAHLASYKYAGVALVSRGFESHAAYPIGMEFVVP

SEQ ID NO: 80074 - DNA, 682 bp, Zea mays
  misc_feature: Ceres CLONE 1565265
  misc_feature: Encodes the peptide sequence at SEQ ID NO. 80075
ctggagctccccgcggtggcggccgctctagaactagtggatcccccgggctgcaggaattcgtctcacccctagaaaaaaaaaggctctcgcctcggcttggcagtgggcactccctctccaccgcgctgcaggggcgacgcaaggccgagcgctcctcgatccagatccaaggtaggagatggctctcacgagaattggcctcgccggcctcgcggtcatgggacagaaccttgccctcaacatcgcggagaaagggttccccatctcggtctacaacagggacgtaacctccaaggttgatgagaccgtgcagcgtgccaaaggtcgaaaggaaaacctcccccgtggttttggtttttccaagaaccccccgtccttctgaactccttcagaagccccggggcggcatcatggccccttaaaaggttgggggccccccggggacaaaaaaattgcaccttggggggaaccttttttggggggacattttcccccccaagggggggggccaaaaggggggtgggggaccccccaaaagggggggaaaaccccttttggttgtcccccccccccccccttattttggggggggggggggtttctccccgaaaaaaaaaaaaaaaaggggggccccccccaaaaaggggcccccccccccccttttatttaaaaagaaggt

SEQ ID NO: 80075 - protein, 67 aa, Zea mays
  misc_feature: Ceres CLONE 1565265
  misc_feature: SWISSPROT Homolog: EC 1.1.1.44 Phosphogluconate dehydrogenase (decarboxylating)
MALTRIGLAGLAVMGQNLALNIAEKGFPISVYNRDVTSKVDETVQRAKGRKENLPRGFGFSKNPPSF

SEQ ID NO: 80076 - DNA, 1158 bp, Zea mays
  misc_feature: Ceres CLONE 1565269
  misc_feature: Encodes the peptide sequence at SEQ ID NO. 80077
  misc_feature (17)..(17): n is a, c, t, g, unknown, or other
ttttttttttgattttntaattattttcttactttgggtttttcgcttctgttccccacccgagatggtgataaaatatagagctccccgcggtggcggccgctctagaactagtggatcccccgggctgcaggaattcgtctcacccctagaaaaaacatctcaagccaccatcgaccttcttgtctcgctacctagcagtgcggtaaaaaaagcagccgcaatggcgagcagcaccatggtccctctcctccacggccttcgccggaaaggccgtgaacgtgccgtcttcgtccaccttctgcgaggcccgcgtgacgatgcgcaagacctcggggaaggccaagccggcggcggcgtccgggagcccatggtacagccccgaccgcgtgatgtacctgaggacactgtccggcgaagcttttagctacctgacgggcaaattcccaggcgactacagtggggacaccgcaggggtctctccgcggacccgggagacgtttggccaagaaacaaggaagctgggatggtgaatccaactcccgactgggggaaaagacttgggggccaccaccctcaggcttgacatatacttcacaggtaaacaaggcttcaaccacagcaaacactgtcttcaatactttcgggactatagggaccaatagagggctaaaaaaaggggagagaggaatatccctaaaaagactttattccgggcgaaagttggttaaggaaaatcgggagtcacagacgccataagagaaggaaaaatgcgcgataaacggcctattcctataatctgctgtggtaatccagaaagaccaggtggccaattacgacccaaatccaagaggggtacatgggtacactggcagataattagaatttagaaatgagagacaagccatgctctgtataagtacataaaattgtaaattaccaaaaaataccagtgcggcgttatcacggaaagaggggggtgcgttatggttcctccgagcgccatatcccaggtgggggggtagccttgagcaaattcgctgttgtgatcagcgacccggatcaaaacccccggaagccctgtgtaggtgtggaacctctaaggagtcaaaggggtggtacaagaataggagggccgccagtcaacactttctaaaa

SEQ ID NO: 80077 - protein, 70 aa, Zea mays
  misc_feature: Ceres CLONE 1565269
MRKTSGKAKPAAASGSPWYSPDRVMYLRTLSGEAFSYLTGKFPGDYSGDTAGVSPRTRETFGQETRKLGW

SEQ ID NO: 80078 - DNA, 846 bp, Zea mays
  misc_feature: Ceres CLONE 1565270
  misc_feature: Encodes the peptide sequence at SEQ ID NO. 80079
ctgcggtggctgccgccctcgaactagtggatcccccgggctgcatgaattcgtctcacccctagaaaaaagataaagctgcaagctgcttatcttctcccgtcccataggttgctaggctcggccgtgtagagcagcaagagcacgccgcgccaagcaacaaagagggaccccgcatccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgaccgcgaaaatcatgctcgccgccaaggacaacttcctcgggaaggacattctcaaggacacgcgcgccaggaaactcgccgccgtcatttacaaagacgaggacttgatcttagaccacagcgaaagaagattcccgggtggtcaagaacgaaaaatccgtttccggtttgggcttcaaaagttgggggaaaaaagggaaaaataagggccttgcccttgaacaaaaagacatgtgggatagaaaactttccaaaaagagggacgaaagctccaaaacgcggggggttgtaaaaaagggggtaaagaaacgttctttttgggggaaaagtgtgaactggccgggggggcgagaaag

SEQ ID NO: 80079 - protein, 171 aa, Zea mays
  misc_feature: Ceres CLONE 1565270
MEVVGGVSLRPSPAPARIRTTLPPVDVGGRFLLRRVAGRQPARRALVVEARGGRGWSERQMQQQRRAPLLPKIEDDGNPRFVIFIRTANVYFWYPLNIITGGTTAKIMLAAKDNFLGKDILKDTRARKLAAVIYKDEDLILDHSERRFPGGQERKIRFRFGLQKLGEKREK

SEQ ID NO: 80080 - DNA, 850 bp, Zea mays
  misc_feature: Ceres CLONE 1565272
  misc_feature: Encodes the peptide sequence at SEQ ID NO. 80081
  misc_feature (471)..(471): n is a, c, t, g, unknown, or other
  misc_feature (542)..(542): n is a, c, t, g, unknown, or other
  misc_feature (554)..(554): n is a, c, t, g, unknown, or other
ctggagctccccgcggtggcggccgctctagaactagtggatcccccgggctgcaggaattcgtctcacccctagaaaaagtagtcgtagccgactggtcgccgcgtccccctttccccgcgcagcagcagagcaccatccggtgaccgagcatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggctcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatggggtctggaaaaagactgngggggaagatcatgtctgaagtcttgggttattcgtcccttgatagtgaccaatttagtggagcaagctgntggaaatgcctncagttgctcaaatttcaaaggttcaccagtgaagccttctttccgggttaatgaaaatagcgtcttggaagggatctgtcccccatggcaacgaaatagtggttgcccccggaggggggtgcctggcatcccaacggggttaccgggaaatttttgaaaagagggccccttcccgttgggtttaaatgggccccctggagaaccctttgccaggggttttttgcaaaaaagggaaaacccctttctccccccctttttgggaaacaaccggcgcgggggggaccaaaaacaaaagg

SEQ ID NO: 80081 - protein, 150 aa, Zea mays
  misc_feature: Ceres CLONE 1565272
  misc_feature: SWISSPROT Homolog: EC 2.7.1.71 Shikimate kinase
  misc_feature (107)..(107): Xaa is any aa, unknown, or other
  misc_feature (130)..(130): Xaa is any aa, unknown, or other
MEAGGVGLALQTRAAAFGSGQRRGGLQSPIGRLRVAEPAGAAVAVRARGSKPVVPLRAKKSSGGHENLHNSVDEALLLKRKSEEVLFYLNGRCIYLVGMMGSGKRLXGKIMSEVLGYSSLDSDQFSGASXWKCLQLLKFQRFTSEAFFPG

SEQ ID NO: 80082 - DNA, 863 bp, Zea mays
  misc_feature: Ceres CLONE 1565274
  misc_feature: Encodes the peptide sequence at SEQ ID NO. 80083
tggagctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagagggccctggagactatggctacgacccttttggcctgggcaagaagccagaagacttcgccaagtaccaggcctacgagctgatccatgccagatggggcatgctcggtgccgctggcgctgtcatcccagaggcctgcaacaagttcggcgctaactgtggcccctgaggctgtctgggttcaggacgggggcgcctgctccgggacggcaacaccctcaactacttcggaaacaagcatcccccatcaacctggtggtgggccggggatccgcggaggtcaatcctccttcgggcgggcgcgcaattactaccgggattcaccaaaggggactgggaaccttaaagggaaaagcctggcccccccggtgggggcccctttcgaacccccctggggggcctggggccaagggaaacccccaaaacaggggccccccatttttcccaggagggggaaag

SEQ ID NO: 80083 - protein, 146 aa, Zea mays
  misc_feature: Ceres CLONE 1565274
  misc_feature (83)..(147): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEGPGDYGYDPFGLGKKPEDFAKYQAYELIHARWGMLGAAGAVIPEACNKFGANCGP

SEQ ID NO: 80084 - DNA, 1210 bp, Zea mays
  misc_feature: Ceres CLONE 1565275
ggttttttgtgtgggaaaggagtgtgaaattattgtcttaagtcatatcttcttctttaaaagaggtaataaaagtgggactccccgcggtggcggccgctctagactagtggatcccccgggctgcaggaattcgtctcacccctagaaaaatcagccatccccttttgctgcaaatctttctctgaattgtgggtctccgacaatggcggcgctagctccatccaagattctgggcacccgggtcaacttcgggagctccttcggttacgccaccgcaacgcccaccgcgtggggctccgaaaaatttgatcctttttaacaagaatccttccctaagactcaagcccgctggcggatcgtcctcctgttcagaacattagtaaacaagttgctcagctggatggggcctaaattgttttttctccctgccatacagtcccactagaaagtatcggaaaggacccgtaattattacgcccacacgccccgttgaaaaatataggggtcaaaacacttttgggcactgcggcaggagagactggaggatttccgccgaaatatcaagggcctggcgtagctataattcttatacccgaaagaggagccacgtttattgattgggcggcgtagggtgttgtcgaatagtgccagaaggggcgagtgtcgagagcggcgtttcaggtcgggctgcggctatgtgaggcacgcccgggaggagggagcggccgggtggcgaaaaagattataggggaggagaactgtcgacggtctgggcaagaacggggagatagcggcgcgcgcgcgtccaggaagtgcggacggctcgcgttatctacaacacatatttctccctcccactggggatgacacaagtgctatatcgtattctcttcgctttccataacttcttatcttatattttacttaattgcacaatgtttgtcgccgggagaggtacccgcctctaaactcccctgctggagggatattagacggacgagggaagtgggatgaatggcgtctctgtgtgtgcgagagcaagtacgcttgaaagcgaaagtagaggcgggtgagttagtttgataaagaaccgcggtgggtagattggccatggcggcagggtgtcagccccctcacaactgctaaggccccgtccctttttcatgttcggacgacattataatgtatactcatcagtcgatctgac

SEQ ID NO: 80085 - DNA, 891 bp, Zea mays
  misc_feature: Ceres CLONE 1565276
  misc_feature: Encodes the peptide sequence at SEQ ID NO. 80086
  misc_feature (185)..(185): n is a, c, t, g, unknown, or other
  misc_feature (188)..(188): n is a, c, t, g, unknown, or other
  misc_feature (453)..(453): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
ctccccgcggtggcggccgctctagaactagtggatcccccgggctgcaggaattcgtctcacccctagaaaaaaagtgtcaacactccagtccactacaatcatcgctgtaggagatggaggaggcggcggcggcggcggcggcggaggtgaggtatgggatcagtcggggtggggatgatggnccnggagcacctccacaacctcgcccacctcgccacagaggtcgagcgggagcagtccgtccgggtgcgggtcaccggcctcgccgacccccaccaggagtcactccgccttggcctccagctcgccgctgagctcggcctcccgcctccccagacctttccaggtcaccccgagctgccggacagcgggctctgttgagcccatcctcgtatcaccccccaacatgacccccctacgagatacccattgggcccccccccccccccnaaaaaccggaggaaaattctttgtttgaaaaacccccctggcccccactgtgccagggacctcaaaaaaaggcccttggaacccccccaaaacaaaaacccaaaaaaaagtttgtgccaagtttggagattaaaataccagggttttttcccccccccttggctaaaaccctaaaaaaacaccccctttaaaaaaggggtgtccccctccccccacatgttctaaaagggtgggggggaaataaccccaaaaaccccggggtttttgcgaccaggacgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 80086 - protein, 75 aa, Zea mays
  misc_feature: Ceres CLONE 1565276
  misc_feature (10)..(10): Xaa is any aa, unknown, or other
  misc_feature (11)..(11): Xaa is any aa, unknown, or other
MGSVGVGMMXXEHLHNLAHLATEVEREQSVRVRVTGLADPHQESLRLGLQLAAELGLPPPQTFPGHPELPDSGLC

SEQ ID NO: 80087 - DNA, 548 bp, Zea mays
  misc_feature: Ceres CLONE 1565277
  misc_feature (500)..(500): n is a, c, t, g, unknown, or other
aaagctggagctcccgcggtggcggccgctctagaactagtggatcccccgggctgcaggaattcgtctcacccctagaaaatagaaaaaggtggagcgatttgtctggttaattccgttaacgaacgagacctcagcctgctaactagctatggcggagccatcccctccgtaggttagcttctttagagggggactaattggccgttttagccccggaagttgaggcaatacaggcctggatgccccttaaagttcggggccccccccccctcctgttttgtttcccaggggtttttatccttgggcacaaaaggcccgggggttattttgggggaaaattttccccccggggggggggggaaaaaaacctctcccccctttgtgggggggttaaaaaaaaaattttccttggggggggggggggggcccctccaaaaaaagattttttaaaaaaaaccccgcgggttttaaaaaaaaatctttttaaaaaaaaaaangccccgggcggggtttttttttttttttttttaaaaggagaagagggg

SEQ ID NO: 80088 - DNA, 1026 bp, Zea mays
  misc_feature: Ceres CLONE 1565279
  misc_feature: Encodes the peptide sequence at SEQ ID NO. 80089
  misc_feature (21)..(21): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
gcgcggggggcgggggcgcgnagagcgcgggcgcgaggcgcggagcgggcgcggcgcaggagggggcggggnnnnnnnntnnnnnnnnccaaactggagctccccgcggtggcggccgctctagaatagtggatcccccgggctgcaggaattcgtctcacccctagaaaaagttccgtcctcctcccccctgcccctgctgccgttccccttcttcctcagttctcccgcccgctgctgccctccgtccgcgtccagatcccgccaccaaccgatccggcgccctccagcatggcgggggcgggggcgaaggcggcgggagccctggctctggcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggtaatttgaacttatctggtcatctggtgcctgaacttgggaaactggagcatcctcagtatctggaactttataagaataacattcaagggaacagtccccttctgagcttgggcaactttgaagaaatctaataaagcttccaacttgtacaaggaacaaacatttcgggggacaatacctccctgccccttgggaaaagtggaagtccccttggtattccttggcgttctcaatggggaaatctatttggactggggccccttccccaaagggaaaccccccggggaaataatctaagtccccaaaaggtttgttggaatggtttccaaggaaaaggaattttgggggcggggggaaaaattttccccacgggctgtgggacacctttttgaaacaaattttttccccctcgggaaggcaaaccttttggaaagaaaaaacaccccccccccctttggggaaagagggccaaaaaaactataccagaggggcgggtggggcccatttataat

SEQ ID NO: 80089 - protein, 117 aa, Zea mays
  misc_feature: Ceres CLONE 1565279
  misc_feature (23)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGAGAKAAGALALALVLALAGANSEGDALSALRRSLRDPGGVLQSWDPTLVNPCTWFHVTCDRDNRVTRLDLGNLNLSGHLVPELGKLEHPQYLELYKNNIQGNSPLLSLGNFEEI

SEQ ID NO: 80090 - DNA, 826 bp, Zea mays
  misc_feature: Ceres CLONE 1565281
  misc_feature: Encodes the peptide sequence at SEQ ID NO. 80091
ctggagctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaagacttcgccaagtaccaggcctacgagctgatccatgccagatgggccatgctccgtgccgctggcgctgtcatcccagaagcctgcaacaagttcggcgctaactgtggccctgaggctgtctggttcaagaacggcgcgctgctcctggacggcaacacctcaactacttcggcaacagcatccccatcaaactggtgggtggccgttgatcgcggagggtcatacctcgtcggcgggcgcccaagtactacccgatccaccaacggactggaacctaaagggacaagctgcacccccggtgggccccttcgaacccccttgtggcttggggcagcaaaccccaaccagggcggtcactcctcaaaa

SEQ ID NO: 80091 - protein, 231 aa, Zea mays
  misc_feature: Ceres CLONE 1565281
  misc_feature (83)..(222): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLRAAGAVIPEACNKFGANCGPEAVWFKNGALLLDGNTSTTSATASPSNWWVAVDRGGSYLVGGRPSTTRSTNGLEPKGTSCTPGGPLRTPLWLGAANPNQGGHSSK

SEQ ID NO: 80092 - DNA, 1259 bp, Zea mays
  misc_feature: Ceres CLONE 1565287
  misc_feature: SWISSPROT Homolog: EC 2.7.11.24 Mitogen-activated protein kinase
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
gggcatagagttttacttaaacaagaattaagtgagaaataaattattgagagtatggatttaaaaggntnnccaaactggaactccccgcggtggcggccgctctagaactagtggatcccccgggctgcaggaattcgtctcacccctagaaaaatcggtcgcgaggggagaaagataggagtcaatcaatttgcctgttctgcttgcttcctgctgaccttgtgacggagtgagccgccggtcttccccttcctcgccgaggggaaatgataagccagccacagccagtgccgccccgaggaagaagatgagcggaggaggcgtggactgagctccgatcgccgagttccggtagacagtgactcacggcagccggttcctgcaatacaacatatacggcaacctgttcgagatcactcacaagtgcctgccccccatcatgcccatcagacggggcagctacgggatcagtctcccccgggaagaacatcccaaactaagaacaatggtaggccatttaataagaatcatataacggccgttcgtacaatcatgcttggtaacgcaaaagcggcaccgctctccctaggaataattccaacgtatcttaaggggcaatcatcagtaccaacagtataaaaacaaccacatcgaagataatcaaagaggaaaacggggaaataaccccgtgcctcggttcacgtttagacgtggtcaaggagcggttttgttgaaaccgcttgacgagagggtgagaacagtcccgcgggggttgccgtggattatgtcattataactttatgcaaatactggagaatagaaaaagagcctttgagtgattgtcataaacagaagtatctaaggtagacggtgatgtgtccgtaataacccctataatgttataatgctattcacatctctggcatatgtataagcctcttcactccccagctatatataatacttttgaaagtagttggtattcgcacgggggatttctcgggcgacgacctagagagatatatgaaaaatttatattcatttccgcacaatttcactgttgggcaacaatgttgttgaataatcccccctcggtatgaacacctcctacatgagaaccctgatggctgtcctcgtatattttatttctaataataatacccaagatagggcggggtaccctccttagaggtttctgcggaatgaacattgcagaggtaattaaagataatctaagatttatcttcgagaaaaag

SEQ ID NO: 80093 - DNA, 848 bp, Zea mays
  misc_feature: Ceres CLONE 1565288
  misc_feature: Encodes the peptide sequence at SEQ ID NO. 80094
ctccccgcggtggcggccgctctagaactagtggatcccccgggctgcaggaattcgtctcacccctagaaaaaactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttcaaagaagagcccgttgtttttctcaattcataagggacttgtcaggtccaaaaagcgaccaggggtgagggctatagccgaaatatttgctgacgctggggttttcagatgtaacaaaaatttcttgggctgtccgggccgaaaaaggcaggctgaaatattttgaacccatggcggaaaaattggtggaatttgccatggaactaaggggggaaataaagggtggggcccggaacttttttttcccccccaggggggggggaaaaaaacccggggaaccctggcgggatacccttggggaaaaaaaaaatatttttgggtgaaaaaaaaatgtcccccccccccgggggggatttttttttttatttgggggaaagggggttttattttcccttgggggagggggggg

SEQ ID NO: 80094 - protein, 140 aa, Zea mays
  misc_feature: Ceres CLONE 1565288
MAAARHLRSGLPLLRAHLASSESAAVAQVSRGFASQAAKPTGKEIKVPKALFGGTGNYASALFLTAAKSNALDKVESEIKAIVEASKKSPLFFSIHKGLVRSKKRPGVRAIAEIFADAGVFRCNKNFLGCPGRKRQAEIF

SEQ ID NO: 80095 - DNA, 847 bp, Zea mays
  misc_feature: Ceres CLONE 1565290
  misc_feature: Encodes the peptide sequence at SEQ ID NO. 80096
ctggagctccccgcggtggcggccgctctagaactagtggatcccccgggctgcaggaattcgtctcacccctagaaaaaaggggagaacagccattgagctgcacgtaccgcgtcaagcgagcagagcagcaaggagcatggatgcctaagccgccgccgccgacggcctggtgcggctctggaccgcggacgtcaagggtatttccctccaggtcgtcgagcgcggcgccgccgacgagccggcggtcctgctcatctacggcttctcggagctctggctctcgtggtgccaccggatgggcgggctcgacgaccgcggcttccccgaggtggctccccacctgcgtggctacggcgactcgtctgtgaccatcgagcccgccgtctactcgatccccccccgtgccacagcgacttggtcgcgctccttggacacctccaactcacagaggtgttcgtggatgagcatcgactggggggcgatggtggagtagaacatccgcctgttcccgacagaacgggtgctcgcctctggtgtgatggggtatccctacttctgccgcaggcctcgcaggaggacgggatctgtttcgagtgcggaaatagatgtcataatcattccgtttcatcgtgccaggaaagagccgaatagggaactttgcgtcgctaccttgtttgaaaacgggtccttaaagaaacttccgacgcccttgttaattttgaccaagaagaatggcttctctccctgtgtagggggagattcctggacaccctctctgcgagggaaccctttgacctccccccaaagttccgggggagtgtaagggaaagaacaaaacctgggg

SEQ ID NO: 80096 - protein, 65 aa, Zea mays
  misc_feature: Ceres CLONE 1565290
MGGLDDRGFPEVAPHLRGYGDSSVTIEPAVYSIPPRATATWSRSLDTSNSQRCSWMSIDWGAMVE

SEQ ID NO: 80097 - DNA, 839 bp, Zea mays
  misc_feature: Ceres CLONE 1565291
  misc_feature: Translation starting site: 180
  misc_feature: SWISSPROT Homolog: EC 1.1.1.44 Phosphogluconate dehydrogenase (decarboxylating)
  misc_feature (506)..(506): n is a, c, t, g, unknown, or other
  misc_feature (508)..(508): n is a, c, t, g, unknown, or other
  misc_feature (537)..(537): n is a, c, t, g, unknown, or other
ggagctccccgcggtggcggccgctctagaactagtggatcccccgggctgcaggaattcgtctcacccctagaaaaaaaaaggctctcgcctcggcttggcagtgggcactccctctccaccgcgctgcaggggcgacgcaaggccgagcgctcctcgatccagatccaaggtaggagatggctctcacgagaattggcctcgccggcctcgcggtcatgggacagaaccttgccctcaacatcgcggagaaagggttccccatctcggtctacaacaggacgacctccaaggttgatgagaccgtgcagcgtgccaaggtcgaaggaaacctccccgtgtttggtttccacgaccccgcgtccttcgtgagctccatccagaagccccgtgtcgtcatcatgctcgtcaaggctggggcgccggtggaccagaccattgccacgctcgcggcgcaccttgatcagggggactgtatcgtcgatggtggcaacgagtggtatgangnaacacggagaggagggagaaggcgatggnaggagcgcgggctcctatatcttgcatggggttgtctccggaagaagaggagggtgcccgcaatggcccgtccttgatgccccggggctccttcgaggcatacaagtacattgaagatattcttctcaaggtggctgctcaggtacctgacagcggcccgtgcgtcacatatattggcaaaggtggatcagggtactttgtcaagatggttcacaatggaattgaatatggtgacatgcaacttatcgccgaaggctatgatgttctcaagtcggtcggtagctcacaacaggaggctgctc

SEQ ID NO: 80098 - DNA, 1262 bp, Zea mays
  misc_feature: Ceres CLONE 1565295
  misc_feature: Encodes the peptide sequence at SEQ ID NO. 80099
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
tttgttttgtggcgtttagttataaaaaaaagaaaaagaaaaaagaaaagggggggggcggggggggaaannnnnnnaaaaactggagctccccgcggtggcggccgctctagaactagtggatcccccgggctgcaggaatgcgtctcacccctagaaaaagtagaacacagagtcacttcggcacgaacaaaagcgcatcgatctcggtgtcgtcactcctcgtcacccagccacaaacagaggcaccacccagcatggccctgcaggaggagctcctcccatccaccctctcatccgtccccaagaagtgcagcctcgccgtcgcggcgaaggacacggcattccttagcgtatcccagaagaaagtgcaggcggcgtcgctgtcggtgagaacgcgggtggcgacgacggcgcctgtggacacgccggggtccaacactgccgcccaagatgggaagaagacggtgcggaagggagtgaacccccacccccggacacatcatacggggttagggccctaggcggcgggccaaggggcttggtggaagaccggcaaagtggcaacgatggagaaagggaccagcacgcggaccttacgttcaaagagccgggcccagaggtcggggccaaaggggagcagccactgggcattgggacgaagaagagggacataggataacacaacaaatgagtaagcaccaacccttggggaaacccatggggaaactactctcccgtttagagaacaatgcgatatatgggagtgggcacacaggatgtttcaatagtggggagaaaccaagttggaccttcgtcccaccggggtggtctcacgacataaccccaaaagaggatgatatagaagaccagcaccaggatatgtgataaatatcacaggacatgcatgagggtgtgggggggagtaaacatacgcgcggtgatacagagattttagattaagaggggagccctctaaataaggtcgtctaacaggggaacacgactctcccataacattatcatcttccccatgcactgcgaatatacgagggttatatccacgagaatctcctcgcgagtcatgcaccgcggggggcgatattaaaaaacacaccccaaggaggggacgatgcatctaagcacccgaacaggggagacacggcgcgcaagagtttatctcatagagattcacaaagataggatctaagaaatgacctccaccacacctaacaggaatcgggaatcagaggagaattgag

SEQ ID NO: 80099 - protein, 88 aa, Zea mays
  misc_feature: Ceres CLONE 1565295
  misc_feature: SWISSPROT Homolog: EC 1.3.1.33 Protochlorophyllide reductase
MALQEELLPSTLSSVPKKCSLAVAAKDTAFLSVSQKKVQAASLSVRTRVATTAPVDTPGSNTAAQDGKKTVRKGVNPHPRTHHTGLGP

SEQ ID NO: 80100 - DNA, 829 bp, Zea mays
  misc_feature: Ceres CLONE 1565296
  misc_feature: Encodes the peptide sequence at SEQ ID NO. 80101
  misc_feature (600)..(600): n is a, c, t, g, unknown, or other
  misc_feature (721)..(721): n is a, c, t, g, unknown, or other
ctccccgcggtggcggccgctctagaactagtggatcccccgggctgcaggaattcgtctcacccctagaaaaagctctgccttcccagtctcccatccctgaaaacctcacaaaaccctcgtttgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagcgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgataggctggntatgggtggtctgtgcattgggggggggggaaaagggttaatcttgggggggatgggtgggtatggggaatgggatgatttccaaagattgagagtggatgatgaaaaaaaaaatttgttnaaaaaccttaaggctgggggacaaagggttgtttgaagggctgaaggaaaacgggagtcccaccgggaaaaccaaggaactggagggcggggcttcaaaaaaaaaatt

SEQ ID NO: 80101 - protein, 194 aa, Zea mays
  misc_feature: Ceres CLONE 1565296
  misc_feature (5)..(79): Pfam Name: CS Pfam Description: CS domain
  misc_feature: SWISSPROT Homolog: EC 5.3.99.3 Prostaglandin-E synthase
  misc_feature (143)..(143): Xaa is any aa, unknown, or other
  misc_feature (183)..(183): Xaa is any aa, unknown, or other
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGGMGDRLXMGGLCIGGGGKGLILGGMGGYGEWDDFQRLRVDDEKKNLXKNLKAGGQRVV

SEQ ID NO: 80102 - DNA, 822 bp, Zea mays
  misc_feature: Ceres CLONE 1565298
  misc_feature: Encodes the peptide sequence at SEQ ID NO. 80103
ctccccgcggtggcggccgctctagaactagtggatcccccgggctgcaggaattcgtctcacccctagaaaaaaaaaccctcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttttgagaggcatttatgcatatggttttgagaaaccatctgcaattcagcagagaggaattgttcccttctgcaaggggcttgatgtcattcagcaagcacaatctggtacaggaaagacagcaaccttctgttctgggatcttgcagcagcttgactatggtctggttgaatgccaggccctggttcttgcttcccacccgtgagcttgcacggcaaatggagaaagtatgcgcgcacttggggaccacctgggggttaaagtccctgcatgcgtttggaggaaacatctgttcgggagggacaaaaggattcccccccagggggggtgcatggtggttggtgggaacccctggggcggggggttttaacttgctggcttaaaacggcccctccgcgccgggataaaaatccaagaaggtgtgggttcctggaagaaaaacctaata

SEQ ID NO: 80103 - protein, 119 aa, Zea mays
  misc_feature: Ceres CLONE 1565298
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLASHP

SEQ ID NO: 80104 - DNA, 839 bp, Zea mays
  misc_feature: Ceres CLONE 1565307
  misc_feature: Translation starting site: 549
  misc_feature (263)..(263): n is a, c, t, g, unknown, or other
ctggagctcaccgcggtggcggccgctctagaactagtggatcccccgggctgcaggaattcgtctcacccctagaaaaaagccgggctaaacaaacacgggcgcacaagcggaactcgctgcactgcttggaatccaacgagccaatcattcaaatcctccccggaaccgcgttgagcagggcacggtcgaccggatctagggtgagggtccgtcgccgaagaaactcccaggcggtcacgaggaggcggcgggggagggcnggaggagatggcctcggaggagatgacggcgacggaggtggctgcgctgctgggatctgaagccgcacccggagggcggcttctacaccgagaccttccgcgacggctccatcacgctcaccacctcccagctcccgccccactacaaggtaaaccgtgctgttagcaccgcaatttatttcctacttcccgcaaggagtgtttcccgtctccaccgcattccttgtgctgaaacctggcacttctacaagggagagcctctcacggtcttcgagcttcacgacgatggtcacattgaccttactgtcattggcccacaccttgaggcaaggcagcgcccccagtataccgtgcccacgaaacgtggtggtttggggtcgtcccccacactaaaacgtcaagtccttccccatctgatggcaagcgttccttgtcaagttcccgaaaaagggaccctggactgcattaccccccctgttgggcgcaccctgggcccccgggttcccataaaaaggatttttgaaaggcccaatttttggagagcgggaaacccttcgcccccaaggggtaaaactt

SEQ ID NO: 80105 - DNA, 747 bp, Zea mays
  misc_feature: Ceres CLONE 1565308
  misc_feature: Encodes the peptide sequence at SEQ ID NO. 80106
  misc_feature (115)..(115): n is a, c, t, g, unknown, or other
  misc_feature (128)..(128): n is a, c, t, g, unknown, or other
tccccgcggtggcggccgctctagaactgtggatcccccgggctgcaggaattcgtctcacccctagaaaaatatccgcatccgctgcctccgcctctcgagtctcgtccacccngtcgtcctcctangctcctttactcgccagtcgccatgggcaagattaagatcggaatcaacggcttcggaaagatcggcaggctcgtggcccaggtcgcccctccagagcgaggatgtcgagctcgttccccctcaaacaacccctttcttccccccggactcctgaacctaccttgttccaagttagaaaaccgttccccggggccccttggaaaccccaggggaacctccccccttagggactcccagaacccttcccctttcgggggaaaaaacccggggtcccccttttttttgtggccccccgggaaaccccctggggggaaaaaacccccccccctggggggtaaaaaaaacccccccccccccccccaaaaaataaattttcccccggggggagaagaacccccccccggggggggtgttttttttcccctttgtttcaaagggggaaaacagaggggggtgtgtttttgcccccccccccttcaaaagggggggggggggggcgcccacaaaaaaaagagggtttttttttttttttttctctccccccccacaaaaaaagaaaaaatgccccccccccccctttttttttttttttgtggggggggggaaaaaaaaaaaaat

SEQ ID NO: 80106 - protein, 41 aa, Zea mays
  misc_feature: Ceres CLONE 1565308
MSSSFPLKQPLSSPRTPEPTLFQVRKPFPGAPWKPQGNLPP

SEQ ID NO: 80107 - DNA, 926 bp, Zea mays
  misc_feature: Ceres CLONE 1565311
  misc_feature: Encodes the peptide sequence at SEQ ID NO. 80108
  misc_feature (843)..(843): n is a, c, t, g, unknown, or other
ctggagctcaccgcggtggcggccgctctagactagtggatcccccgggctgcaggaattcgtctcacccctagaaaaaccaccgctctgcctcgcctcgcctcacctcacctcacctcgccgactagggttttgtaccgccgtggatctcgccgtccccgccatggacgtctcgcacgcgggatcctccgtcgccggcgaggctccgacgaccggggagcaccggatggggactaccatcgtcggggtctgctacgagggcggcgtcgtcctgggcgccgattccaggaccagcactggaatgtatgtagccaaccgtgcttcagacaagattactcagctgacagacaatgtgtagtggtggcccccccggatctgctgctgatagagaagggatttcgggattatgcacgcccttttcctccctccaaaacccaatctgagcgtggacaacccccctaccggttaaagttgcaggccaatttggttaggggggccccgcctcatccaaaacacagaaacaggttgcaaacctgccccagcacctttttgcacgaaagggaccacactcccgaagggagggcgccaccgtgtttcctcagtgcccctttgcgggggggagccggatctctcgatccccaccccttcttgccaatttgggaaggcccccggggtgcccaggggtacctaattattgcgctccctcctctgaaaattctatctctgccaagaaggggaccatgaaattcccggcgctaacgccccgaggaaaattttccccgctggaaaagtgtatcttcccccccgcgcaatcgacccccgcggacgggtgatcctctgatnaaagcgttggcgcccctcccccaccatccggtataacacctggattggcacccgccccatatagaattcgtgtggccccccca

SEQ ID NO: 80108 - protein, 64 aa, Zea mays
  misc_feature: Ceres CLONE 1565311
  misc_feature: SWISSPROT Homolog: EC 3.4.25.1 Proteasome endopeptidase complex
MDVSHAGSSVAGEAPTTGEHRMGTTIVGVCYEGGVVLGADSRTSTGMYVANRASDKITQLTDNV

SEQ ID NO: 80109 - DNA, 827 bp, Zea mays
  misc_feature: Ceres CLONE 1565312
  misc_feature: Encodes the peptide sequence at SEQ ID NO. 80110
ctccccgcggtggcggccgctctagaactagtggatcccccgggctgcaggaattcgtctcacccctagaaaaagtgttcctcgtcccgagaagagtcgaggaaaaatctcgcattctcaaaccaggcaaatggaggcatgagctccgccgcctccccgtctctcgccgatctcccccaaaccctagcctcgacctgaccgccagcgggcccgcaggccggagaaggagtcggagtcgcccccacccaccctctcctctgccgcgggcggggagcgggcggcggacgagatgccgtcgcacggggatctggaccggcagatcgcgcagctgcgcgactgcaagtacctgcccgaggcggaggtcaaggcgctctgcgagcaggccaaggccatccttatggaggaatggaacgtgcagcccgtgcgctgccccgtcaccgtctgcggcgacatccacggccagttctatgacctcatcgagctcttccgcatcggcggcgactctcccgacaccaactacctcttcatgggcgactacgtcgatcgtggctactattcagttgaaacagtttctctgttagtggctttgaaagtccgttacagagatagaattacgatacttccgagaaatcatgagagcagacaattcactcaagtggacggcttctatgatgaatgcttaagaaaatatggaaatgcaaaatgtatggaagtattttacagacctggtttgattatttgcctctcccacctcttatagaaaatcaggtcttctggcttcatgggagccctctctccgtcatgggaacaatgggataacattcctc

SEQ ID NO: 80110 - protein, 156 aa, Zea mays
  misc_feature: Ceres CLONE 1565312
  misc_feature (47)..(156): Pfam Name: Metallophos Pfam Description: Calcineurin-like phosphoesterase
  misc_feature: SWISSPROT Homolog: EC 3.1.3.16 Phosphoprotein phosphatase
MPSHGDLDRQIAQLRDCKYLPEAEVKALCEQAKAILMEEWNVQPVRCPVTVCGDIHGQFYDLIELFRIGGDSPDTNYLFMGDYVDRGYYSVETVSLLVALKVRYRDRITILPRNHESRQFTQVDGFYDECLRKYGNAKCMEVFYRPGLIICLSHLL

SEQ ID NO: 80111 - DNA, 812 bp, Zea mays
  misc_feature: Ceres CLONE 1565317
  misc_feature: Encodes the peptide sequence at SEQ ID NO. 80112
ctggagctccccgcggtggcggccgctctagaactagtggatcccccgggctgcaggaattcgtctcacccctagaaaaaactgctcgagctcagctcaaggaaccacagaaaatggcgtcacttctccgccctctcgtcctcgtgctcctgatcgcctcctgcgcagcgcagcagtcaccgccggcgcaggccccgccaacgccgaacgcgccaccggccaactcgccgccccaggcgcctccagccggaaacccgccgccggcgccccaggcgccgccggcaggcaacccgccacctgcgcccaccgccactccacctccggccccgaccactccgcccccggccccgaccacacctcccctggctcccacaacgccgcccccggcgccgacaactccacctccggcccccaccacgccgcctccgtccccaccggcgtcgccaccgcccgctcccacaactccgccaccgtctcccccggcaagcccgccgcccgctcccgccaccccggcaccgtctccacccatggcggcaacctccggcaagccccctccaaccggcaccccgccgccaacgggcgcgcccaagccgggccccgaggggggccccgactcccccgccggtggcgaacacgggctgggtcccccaagaaccccgaaaaaagccgaagccccgccgcccgcgaagttccccaggggcccttggcttttcgccaacggggcaacgccaaacaaacaaaagaactcggggtgccaaaacgccccccccggttcagctttccccaaaggtggggggggcctttggggcggt

SEQ ID NO: 80112 - protein, 233 aa, Zea mays
  misc_feature: Ceres CLONE 1565317
MASLLRPLVLVLLIASCAAQQSPPAQAPPTPNAPPANSPPQAPPAGNPPPAPQAPPAGNPPPAPTATPPPAPTTPPPAPTTPPLAPTTPPPAPTTPPPAPTTPPPSPPASPPPAPTTPPPSPPASPPPAPATPAPSPPMAATSGKPPPTGTPPPTGAPKPGPEGGPDSPAGGEHGLGPPRTPKKAEAPPPAKFPRGPWLFANGATPNKQKNSGCQNAPPGSAFPKGGGGLWGG

SEQ ID NO: 80113 - DNA, 764 bp, Zea mays
  misc_feature: Ceres CLONE 1565318
  misc_feature: Encodes the peptide sequence at SEQ ID NO. 80114
  misc_feature (282)..(282): n is a, c, t, g, unknown, or other
  misc_feature (284)..(284): n is a, c, t, g, unknown, or other
ctccccgcggtggcggccgctctagaactagtggatcccccgggctgcaggaattcgtctcacccctagaaaaaacgaggagcggaacacacacacactcgggtttccgatggcggcggccgcaccaacacacgcgcccgtgtcctcctcagcgtgccgttcgggattctcctctagcgatgtatccttccccaattttcgctcggcggcggcttcggcccctgggtggcggcgcagggagccgtacccggcagtctccgtagtggtccaagctcccccggngngtctgtgcggaactttactgcgaccccaagttgaccactggtagaaagttgaaatggggaaccaaaaggttgggctgttccctttcccaaaaaggggggatactggggcccttcttctttggggggggtttttctaaataaaaaaaaacccccttggtgaaaagaattttttttccacccccggggaaagaggccccccttttttttttttataacgcgttttttcacggggggttttttttttttttgggggggaaaaaaaaaggggggggaaaaacacccccccgcaagaaactctcttttttttttggggggggggggaaaaatttttttctcccccaaaagggtgggggagacacacaaactcccttcttataaaaaaaaccccctggtgaaaaaaaacccacagggggggcccctccctccccccccccctcgggaggggggaaaaaaaaaagtttgtttattttatcctcccct

SEQ ID NO: 80114 - protein, 72 aa, Zea mays
  misc_feature: Ceres CLONE 1565318
  misc_feature (58)..(58): Xaa is any aa, unknown, or other
  misc_feature (59)..(59): Xaa is any aa, unknown, or other
MAAAAPTHAPVSSSACRSGFSSSDVSFPNFRSAAASAPGWRRREPYPAVSVVVQAPPXXLCGTLLRPQVDHW

SEQ ID NO: 80115 - DNA, 1028 bp, Zea mays
  misc_feature: Ceres CLONE 1565319
  misc_feature: Encodes the peptide sequence at SEQ ID NO. 80116
  misc_feature (47)..(47): n is a, c, t, g, unknown, or other
  misc_feature (49)..(49): n is a, c, t, g, unknown, or other
ttttattgagacacccttattgaggagacgcagaggacccagcaagntntttcgcggccggcgatcgtgggctggaatagctgggactccccccggtggcggccgctctagaactagtggatcccccgggctgcaggaattcgtctcacccctagaaaaagtgtaccccaacgagaagagcggcggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggcccaccacgcatcaaacaatgagcttgtgaggacacaaacccttgtgaagagtgccattgtggcaagttgatgctgccccatttcaaagcagtggtaccctcacctcactatgggagttgaacattgggtagggaagaaagaaaaaaccccctgcttgcaaaaggaaaggattaattgcctgaaggggaacaaaggagggtttgcaggggccagcccggcccttgaaggggaaaaccgaaaaaaaaagaaggccaaacccacttggttctacgggaagggaaagccctttggaagaaagcggccaaagggtaagggggaacggtaacccccctttaaaccccaacaccatttggaagggaagccaatttttgggccaagtggggaaacgggttggcctgggcaaaggcaattttttcttccacagcccccttggtaacaatgggtggccccaagccttgaatgggggtaacactccctttgaagggggtaaaaaaacacttgagattcctaacaagaaaaaaaagccttacacaaagaaaaaaaaggt

SEQ ID NO: 80116 - protein, 105 aa, Zea mays
  misc_feature: Ceres CLONE 1565319
  misc_feature (1)..(106): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVAHHASNNELVRTQTLVKSAIVAS

SEQ ID NO: 80117 - DNA, 859 bp, Zea mays
  misc_feature: Ceres CLONE 1565322
  misc_feature: Encodes the peptide sequence at SEQ ID NO. 80118
  misc_feature (759)..(759): n is a, c, t, g, unknown, or other
tccccgcggtggcggccgctctagaactagtggatcccccgggctgcaggaattcgtctcacccctagaaaaattgcaagccttcccggttacttgttcactagcaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcatcagcggcttccgctcccgccttcgcccccgggcaagctgcccatcatcggccacctccacctcatcggcgccgagactcacatctcgatccggggactggacgccaagcacgggcgcaacggcctggctgctcctccgcatcggcgccgtgcccacctctggttcgtgtccttcgcccagcgccgccgtacgccgttcttgcgcaccccaggacaccatctttcgcgtcgggggcccgccgtccatggtcttgcccaaaatcatcccgctaaccggcccctcgggacctttcgcgtttcgtgccccctaacggcgaattactgggccggcagggccaagaaaaactccctcaccaccgcacatggctcaagacacaaagaaaggggcaagtccctttccgccatggccgaaaaaagaaagagggggccgctcgtcactgggacaaaaatcccggggggggttgccaccggccggcgcccgnccgggggggggtgggacctttaaccgattctccctgtccggggaacccacaaacaaacttgtgtgtgcccccggcgggttcctggggccccttcccaccg

SEQ ID NO: 80118 - protein, 33 aa, Zea mays
  misc_feature: Ceres CLONE 1565322
  misc_feature (27)..(27): Xaa is any aa, unknown, or other
MAEKRKRGPLVTGTKIPGGVATGRRPXGGGWDL

SEQ ID NO: 80119 - DNA, 832 bp, Zea mays
  misc_feature: Ceres CLONE 1565324
ctggagctccccgcggtggcggccgctctagaactagtggatcccccgggctgcaggaattcgtctcacccctagaaaaagggtcgctactcgcgaccctaccacctactcccacaggggactatggagatccaactcccttgtctacgccaccgacgctgacactgctcatggacgtagatccttggcaaccgcggggtccggaacacgtccctgatgaacctcatatgtccacggaaggctcctgcaacaatacatgagctacaatccgcgcagattctctctcagaggatgctatgatcagaatacaggctagtcacgtcgtctatatggagaccccctgggcacgatacatgccacactctgggggttgcgttctacagacgtggccgattgctgtgcgctcgcctctgatcgtaactgccagatgtcatcgactaacactatagctgccaagatgaatgctcaagcaacatagcgcatagatcactacacttttcgcttcaacctactcgaaacaagattgatgttgatggtagagaaggctgagagctttcctgccacaaagaattgcaatggtgcgctccccatgcaagatgccttattttgaactggtgcacatatgactacaatgttgacaatgattacccgactgctgaccagctgactctagatgtgatcgcgtatacgacgttacttacatattgttgcagcatctgatgctgacactgaggtcaaaaacgtatgtgcatactactatttaggcatggttcttgacccctaaggatcttgattacttgatgggcggaatcttttatctgaatgacccatg

SEQ ID NO: 80120 - DNA, 817 bp, Zea mays
  misc_feature: Ceres CLONE 1565326
  misc_feature: Encodes the peptide sequence at SEQ ID NO. 80121
  misc_feature (529)..(529): n is a, c, t, g, unknown, or other
  misc_feature (575)..(575): n is a, c, t, g, unknown, or other
ctggagctccccgcggtggcggccgctctagaactagtggatcccccgggctgcaggaattcgtctcacccctagaaaaaacttcctccttccttctttccctcttcgtcttcgcttggccggtgggtggtgcggtggggatgcggcggctatggcggtggtaccagcagtgcctggccgcgcacccggtgcgcacgcaggtcgtcagctccggcatcctctggggcctcggcgacatcggcgcccagaccgtcacctactactccgctagccccgaccgtcgcggccacgacagcagccctcccgaccccgaggataaagataataaagacaataaagagtttaaagttgattggaagagggtgggcatcacaagctccttcggatttgcttttgttggtccagttgggcattactggtatgaatacctggatcgcatcatcccgcggaggtttcagcctaacacgttcaaattcgtcgcctcaaaagttgcggcggatggatccctcttcggaccactagacctccntctggtcttctcattatgtgggtctgggtcaaggaagggacctttnagcaggtgaaaggagacttgaaaaaggaacttctttccggctcttggggttagcgggaacattctgggctggctttgcaaatcccaaaaattccgtttccttcccgggggggtaccactcccgggttgtgaaatttgttcgccccccgggaaaacctgctttcctgtcgagaaattaaaccacagggggaacccccccctggaaaagcggggggtccactttttttccaaaaaaacaaaaaa

SEQ ID NO: 80121 - protein, 147 aa, Zea mays
  misc_feature: Ceres CLONE 1565326
  misc_feature (130)..(130): Xaa is any aa, unknown, or other
  misc_feature (145)..(145): Xaa is any aa, unknown, or other
MRRLWRWYQQCLAAHPVRTQVVSSGILWGLGDIGAQTVTYYSASPDRRGHDSSPPDPEDKDNKDNKEFKVDWKRVGITSSFGFAFVGPVGHYWYEYLDRIIPRRFQPNTFKFVASKVAADGSLFGPLDLXLVFSLCGSGSRKGPXSR

SEQ ID NO: 80122 - DNA, 1081 bp, Zea mays
  misc_feature: Ceres CLONE 1565333
  misc_feature: Encodes the peptide sequence at SEQ ID NO. 80123
  misc_feature (16)..(16): n is a, c, t, g, unknown, or other
  misc_feature (25)..(25): n is a, c, t, g, unknown, or other
  misc_feature (38)..(38): n is a, c, t, g, unknown, or other
  misc_feature (39)..(39): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (1070)..(1070): n is a, c, t, g, unknown, or other
gaaaaggggagacgcnaaaagcagngcatttagatatnnttcttaagtgttgaagttttnnnnnnnttattaannnnnnccaaagctggagctcaccgcggtggcggccgctctagactagtggatcccccgggctgcaggaattcgtctcacccctagaaaaaacttgtctttacaaatcgactatatgtactgcgcctctattcccgtaagaccaagaaagacctgaacctgatacaccttgcctctccccactaagcttgtttaccacgcttgtagataagacatgggtcaagcactcggcttgattcaagtggatcaatcgacagtagccatcaaggaaacttttgggaagtttgacgaggtcctagagcctggatgccacttcttgccatggtgcatagggaagcaaattgctgggtatctgtcactgcatgtgcagcagcttgatgtccgctgcgtaacaaagacaaaggataatgccccccgtcgatgttgtggcgatctgtgccaataacatggcccttgcccaataaggcagtcttgatgcattttttacgggcttagaaaacaccaagggagacaaaatccaggccataatggtttttaaaagtccagtccagggggcaaattgtttcccaaaaagaaatgaaacttttgcgaatgaaaggccctctttgaaaacccaggaaaaaaattggcaaaattccgccccagaagggggtggagaaaaaaaaaaattggaaaccctttggcaaagaaaggggcgaatatggtccctaattgctttgtgggggaaataacccacaaaattggttgggccataaacctccctgaaattttgctttggagataatataaagcgccctcgacatgaagaccactttttaaatagaaagaagccctaattaaattgaaaaattcaaatgggccggcttatccataaaggcctttaaagatttgggccctctgccccagccggataaaaacctttataggcttgaaaaataaaattcccgggcggagataaaataaaaatccccaaaaggtggattctaggaattccgcgnaaccctttggg

SEQ ID NO: 80123 - protein, 76 aa, Zea mays
  misc_feature: Ceres CLONE 1565333
MGQALGLIQVDQSTVAIKETFGKFDEVLEPGCHFLPWCIGKQIAGYLSLHVQQLDVRCVTKTKDNAPRRCCGDLCQ

SEQ ID NO: 80124 - DNA, 1005 bp, Zea mays
  misc_feature: Ceres CLONE 1565335
  misc_feature: Encodes the peptide sequence at SEQ ID NO. 80125
  misc_feature (249)..(249): n is a, c, t, g, unknown, or other
  misc_feature (343)..(343): n is a, c, t, g, unknown, or other
  misc_feature (451)..(451): n is a, c, t, g, unknown, or other
  misc_feature (490)..(490): n is a, c, t, g, unknown, or other
  misc_feature (491)..(491): n is a, c, t, g, unknown, or other
  misc_feature (535)..(535): n is a, c, t, g, unknown, or other
  misc_feature (536)..(536): n is a, c, t, g, unknown, or other
  misc_feature (624)..(624): n is a, c, t, g, unknown, or other
  misc_feature (764)..(764): n is a, c, t, g, unknown, or other
  misc_feature (797)..(797): n is a, c, t, g, unknown, or other
  misc_feature (798)..(798): n is a, c, t, g, unknown, or other
  misc_feature (800)..(800): n is a, c, t, g, unknown, or other
  misc_feature (826)..(826): n is a, c, t, g, unknown, or other
  misc_feature (874)..(874): n is a, c, t, g, unknown, or other
  misc_feature (910)..(910): n is a, c, t, g, unknown, or other
  misc_feature (912)..(912): n is a, c, t, g, unknown, or other
  misc_feature (948)..(948): n is a, c, t, g, unknown, or other
  misc_feature (951)..(951): n is a, c, t, g, unknown, or other
ctccccgcggtggcggccgctctagaactagtggatcccccgggctgcaggaattcgtctcacccctagaaaaaaaccgaatcttgacggaacgattccaccaagaaccgcgggcaacaattcacaccgcgcttctcttctccagcgatgcagacgacggcggcggcggctgtggcatgggcgcctggcccatcggcgtccacctcgtcatcgtcctcgccgtccaccttcagggtgggggttgcgtcnacggtcgtgcgggcttgttccgcgcccaggcttgtggcgtcctccgcgcccctgggctgtcgaccgctgcgaccaatgcttcaaggcggtgccnatccggacccccccaccgggcttccattgactgctgaaaaagttgagatcccccacggacgaacaaggccgtaccctacggacaaacgcgagccaaacgtgaggtggnaaccaaaccaacaagacaaacgtcgaaaaggagtaacanncccaaacacacaatgtgagtcattgccaccatacaaacttgatnnttccgacccagagacaaggggaaatagaaccgaggaccctccatagcggatacaccacaagtagaacaaaccgcatgtaccctgtttngtaagccccccaccccccccggataggcacccccgaaaacactcggagcaaatagaacagattataaatacaaaagctagcaaccactcctcatataaagagcacaccctggctcacaataacctactatcctcttatantactcctcccgctgcacccacggaaccgcaganngngaggcgttgcggcgttctccgtggcngaatgaggcatcgggaggctatcaaccgtttcaccaaaaccacgcgtntgatactcggacaacacccgcaggcaaagttagtgntngtccggtcgttctccgaaccgcgccactgtggtttnggncacacccagcctgcgggtactagatcgaccccccacatcacaatcaccctcgaa

SEQ ID NO: 80125 - protein, 144 aa, Zea mays
  misc_feature: Ceres CLONE 1565335
  misc_feature (66)..(66): Xaa is any aa, unknown, or other
  misc_feature (102)..(102): Xaa is any aa, unknown, or other
  misc_feature (115)..(115): Xaa is any aa, unknown, or other
  misc_feature (130)..(130): Xaa is any aa, unknown, or other
MQTTAAAAVAWAPGPSASTSSSSSPSTFRVGVASTVVRACSAPRLVASSAPLGCRPLRPMLQGGAXPDPPTGLPLTAEKVEIPHGRTRPYPTDKREPNVRWXPNQQDKRRKGVTXPNTQCESLPPYKLDXSDPETRGNRTEDPP

SEQ ID NO: 80126 - DNA, 616 bp, Zea mays
  misc_feature: Ceres CLONE 1565337
  misc_feature: Encodes the peptide sequence at SEQ ID NO. 80127
  misc_feature (168)..(168): n is a, c, t, g, unknown, or other
  misc_feature (178)..(178): n is a, c, t, g, unknown, or other
  misc_feature (179)..(179): n is a, c, t, g, unknown, or other
  misc_feature (319)..(319): n is a, c, t, g, unknown, or other
  misc_feature (320)..(320): n is a, c, t, g, unknown, or other
  misc_feature (405)..(405): n is a, c, t, g, unknown, or other
ctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagaattctgggcacccagnctcaacttcnngcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgnnccaagtggtatggtcctgacaggaggatctacctgccggatgggctgttgggacgggtcggaggtgccgggagtacctcaccggnaagaggtccctggggagactattgggctaccgacccctttttggccctggggcaaaaaagccccaaaggaactttcccccaagtaaccaagggccctaccaaggcttgaatcccatggccccaaaaatgggggcccaagggccttgggggggccccccctgggggggccctttttcattccccccaaaaaggagcccctttggaaaaaaaa

SEQ ID NO: 80127 - protein, 53 aa, Zea mays
  misc_feature: Ceres CLONE 1565337
  misc_feature (26)..(26): Xaa is any aa, unknown, or other
MVLTGGSTCRMGCWDGSEVPGVPHRXEVPGETIGLPTPFWPWGKKAPKELSPK

SEQ ID NO: 80128 - DNA, 749 bp, Zea mays
  misc_feature: Ceres CLONE 1565338
  misc_feature: Encodes the peptide sequence at SEQ ID NO. 80129
  misc_feature (187)..(187): n is a, c, t, g, unknown, or other
  misc_feature (194)..(194): n is a, c, t, g, unknown, or other
  misc_feature (195)..(195): n is a, c, t, g, unknown, or other
  misc_feature (283)..(283): n is a, c, t, g, unknown, or other
tccccgcggtggcggccgctctagaactagtggatcccccgggctgcaggaattcgtctcacccctagaaaaaaagccaccatcgaccttcaagtctcgctacgtagcagtgcaataaaaaaaagcagccgcaatggcgagcagcaccatggccctctcctccacggccttcgccggcaaggccgtngaacgtnngccgtcgtcgtccgcccttcggcgagcccgcgtgacgatgcgcaagacggggcgaagccaagcagcggtgcgtcgggacccgtgtacngcccgacgcgtgctgtactgggccactgtcggcgagccacgagctactgacggcgagtccccggcgactacgctggacacccggggctgtctgcggaccccgaaaacgttgccaagaaaccggaactgggagggatccacttcccgctgggccctggtgggggcgccctcggttggcgtttttcccccaaaatttgttttccccccaaaaaggggtttaaatttttcgcgaaaggcccctttggggtttaaagggcgggtccccccaaatatttttagggaggggggggggggggaaaaaacctcgggggaaaccagaagccttttttcccgcggcgaaaaaaaaaccctttttattttgggggccccaccaggggtgggttccttgggggggcccccccaaaggggaacaacaatatctccgggggggggccccccttggggagagggttttgcacacaccttct

SEQ ID NO: 80129 - protein, 205 aa, Zea mays
  misc_feature: Ceres CLONE 1565338
  misc_feature (21)..(21): Xaa is any aa, unknown, or other
MASSTMALSSTAFAGKAVERXPSSSALRRARVTMRKTGRSQAAVRRDPCTARRVLYWATVGEPRATDGESPATTLDTRGCLRTPKTLPRNRNWEGSTSRWALVGAPSVGVFPPKFVFPPKRGLNFSRKAPLGFKGRVPPNIFREGGGGEKTSGETRSLFSRGEKKTLFILGAPPGVGSLGGPPQRGTTISPGGGPPWGEGFAHTF

SEQ ID NO: 80130 - DNA, 810 bp, Zea mays
  misc_feature: Ceres CLONE 1565340
  misc_feature: Encodes the peptide sequence at SEQ ID NO. 80131
  misc_feature (220)..(220): n is a, c, t, g, unknown, or other
  misc_feature (225)..(225): n is a, c, t, g, unknown, or other
  misc_feature (269)..(269): n is a, c, t, g, unknown, or other
tccccgcggtggcggccgctctagaactagtgtgatccccctgggctgcagtgaattctgtctcatcccctagtaaaaacagaaaggttttcagggccacaaggagtggctgacagaggttgactaccttggccaacttcaccaccagaatcttgtcaaactcattggttattgcacagatggtgatcaccgacttctggtgtatgagtacatgcctaanggaangtttggaaatcatctattcagacgaagtgcggatcctttatccntggggaacaagactcaaaagttgcattgggggctggctagggtttatcatttctgcatgatgctgagaaaccaaggcctttttccggattttcagggatcaaaaatttccccctgacccggaattcaagggcaaaccttttcaaattttgggttgggaaaaaacgggcccaatcgggggaaaaggacccctttttttttccccaggtttgtgggccaaaaaagggttttccccccccccaaaatatttttcaaaaaagggggtgcccttctttagaaggggaaattttccccccttcccgggggggggggccctccagaagccctccaaaagaagggggggggggccccgccaaaattttaaaaccttttttttcccgaaaaaaaattttttggggggggggggagaacccccctttttttttaaaaaaaaaacacaccttttttaaacaccaaaaaggaaacaaacaaatggtgggggggggggggccccctcaataaagagggggggcgcccccccccccccccccagaaaataatcat

SEQ ID NO: 80131 - protein, 57 aa, Zea mays
  misc_feature: Ceres CLONE 1565340
  misc_feature (3)..(3): Xaa is any aa, unknown, or other
  misc_feature (5)..(5): Xaa is any aa, unknown, or other
  misc_feature (20)..(20): Xaa is any aa, unknown, or other
MPXGXFGNHLFRRSADPLSXGNKTQKLHWGLARVYHFCMMLRNQGLFPDFQGSKISP

SEQ ID NO: 80132 - DNA, 716 bp, Zea mays
  misc_feature: Ceres CLONE 1565341
  misc_feature: Encodes the peptide sequence at SEQ ID NO. 80133
ctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaaccgcgtcaagttcggcgaaggcgtctgggtcaaaggcggctcccagatctttcaagcgaggggcgggctggaactaccctgggcaacccccagccctgaatcaacgcgcaagaagcatccctcccccatctggggcctggccagggtcgtggctcatggggggcccgctccaaggggctacccttaatttgcccggggggggccccctttggggaaaaggtctctcccc

SEQ ID NO: 80133 - protein, 179 aa, Zea mays
  misc_feature: Ceres CLONE 1565341
  misc_feature (61)..(171): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNRVKFGEGVWVKGGSQIFQARGGLELPWATPSPESTRKKHPSPIWGLARVVAHGGPAPRGYP

SEQ ID NO: 80134 - DNA, 1053 bp, Zea mays
  misc_feature: Ceres CLONE 1565342
  misc_feature (876)..(876): n is a, c, t, g, unknown, or other
catgctggagctcaccgcggtggcggccgctctagactagtggatcccccgggctgcaggaattcgtctcacccctagaaaaagaagccaaccgaattctctgcgattcttctcccctcgcctcctcgtctccccctagggctagcacctcgctacctccgattgaatcatgagtaaggtctcttctccctttgatctgcagatatagagctttggctccaactaccgcccgcggttcgaggacgtcctcctattttcacagcttatttttgactctcttccttgcctctgaaaaaacaaagtttgtctgagagaaataaaaaaaagggcaggtctattccattttgtggtaagcagggccaacacagtaggctgggagccattaccccttaagttatgatgttggtcccccccttgaattctggccaatattatacgggcatggagcaaacaaacataaagaaactagatagaggttttttaggaaagatgatttacaagagccgaaataacagaaagaaatcatggatttaagataacccatatattaacagggcaatcttggaacgggatagcggatcctgccggtgcgatggaggttccggggcgatgcgttttgagcaacaatgataaaaagggagacataagaatgaaataggcccgaacaatatattttctttccagagaactatgggggaaggggtacgtatacagaagtgccaacctgacagatttgttcttgttaacgcccttagataggcgggtgttctccggcgcctcttatcttctcccaccggcggcgggatattcggagcctgacccagaaaatccataatggagaacacttaatttggaacgtaacaataatttgtgttnggtgcgagcaggagccctgtattcacacctcgtggatgatgtatttggaatgacatccaaataaaatagagatgcttctgacacgtgttcatgtcaaggccgaaatatattatgaagcgagaaagaagaaaccatttaactcacgaaataagattatattaaagacagacgcattaa

SEQ ID NO: 80135 - DNA, 752 bp, Zea mays
  misc_feature: Ceres CLONE 1565344
  misc_feature: Translation starting site: 144
  misc_feature (160)..(160): n is a, c, t, g, unknown, or other
  misc_feature (205)..(205): n is a, c, t, g, unknown, or other
  misc_feature (228)..(228): n is a, c, t, g, unknown, or other
  misc_feature (229)..(229): n is a, c, t, g, unknown, or other
  misc_feature (233)..(233): n is a, c, t, g, unknown, or other
  misc_feature (234)..(234): n is a, c, t, g, unknown, or other
  misc_feature (280)..(280): n is a, c, t, g, unknown, or other
  misc_feature (504)..(504): n is a, c, t, g, unknown, or other
  misc_feature (657)..(657): n is a, c, t, g, unknown, or other
  misc_feature (658)..(658): n is a, c, t, g, unknown, or other
  misc_feature (696)..(696): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (729)..(729): n is a, c, t, g, unknown, or other
ctccccgcggtggcggccgctctagaactagtggatcccccgggctgcaggaattcgtctcacccctagaaaaaagtccagtatcctcgacggtcgacgccggcgcgagcagcaaatggtcaccgcggcggcgacgatgacctatggcgacgcaccaccncccgcgcccgcgcacccctccgcgtctgcgccgcctggggacatngatacccgggggagccgccaccnngtgnngccacgccccatagcccctcccaagggccaaagggccaaagccggncggcccgccggccccggggaaccacaaaccccgggccccggccccggccttccttttggacccacaggccgaattttttttggggggggctccccagagaggggcgccaaggggggggggggtgagaaaaaaaaaccccccttttttgggggcctttttagaaaaaaagggggggggggcgcccccccccccccccggggggggaaaaaaaacccccccgcccncccccccccaaaaaaggggggggggggcccccccggggggtttttttttggggggggaaaaacccccccccacaataaaaaaaaaatttttttgggggggcgggggggagggggttttttttttgtttttttccccccccccttggggggggnnttttgggggggggggaggcccaccaaaaacaacaaacnttttnnnggggggggggtgtttttgttttttanaaagaagagggggcggccccccc

SEQ ID NO: 80136 - DNA, 809 bp, Zea mays
  misc_feature: Ceres CLONE 1565346
  misc_feature (409)..(409): n is a, c, t, g, unknown, or other
  misc_feature (450)..(450): n is a, c, t, g, unknown, or other
  misc_feature (453)..(453): n is a, c, t, g, unknown, or other
  misc_feature (461)..(461): n is a, c, t, g, unknown, or other
  misc_feature (556)..(556): n is a, c, t, g, unknown, or other
ctccccgcggtggcggccgctctagaactagtggatcccccgggctgcaggaattcgtctcacccctagaaaaaagcggcgaggaggcaggcggtagcggaatctggcaccggccatcacgtcccctcccgccgcttcctcctccctgccctacctttccccagatccgaatccattaaaccagcggatcttgcatcggggcgcgtccacggcatccgggcaagcgagtggtggagccagcagccatgagatggtatgcatcggtagcctcctgagggcgctggtgctgcgtgcggcgtcgtctgcgggcaggcgccgggggcccaggattctgtgtggccgcgcgacggatgtgcgcgtgacgccacggcacggacacggctggcgcgggttccgggcggtcacgggnaggatgatgctggactcctctgagtctgcctcttccgccgnccngcgcgccncggaagcgggagctgggggcgtggcagggcaggcgcagccgcagcggcgcgcgggtgggggccgtgccccaggcgcacgatggtggctacccaancggccgaaggggaaaaaaaaatagggaaaaccggagttgtggaaaccccaaggttttaaaggggaaaaaaagctccaagggaaggaatttcctttggagggaaaaacctaaccgggaaattgggggggaaaaagcccttttaagccccggtttcgggtggtttttttaacgggggcccgggtgggggaataacacggggcgcgggggggaaaattttttgagaggggggaaacccctttgtttttttgaaaaa

SEQ ID NO: 80137 - DNA, 866 bp, Zea mays
  misc_feature: Ceres CLONE 1565358
  misc_feature: Encodes the peptide sequence at SEQ ID NO. 80138
  misc_feature (334)..(334): n is a, c, t, g, unknown, or other
ctccccgcggtggcggccgctctagaactagtggatcccccgggctgcaggaattcgtctcacccctagaaaaagaagagctaggcgagagcacgcactgctggcggcgcggctaagaccgagagccgccgcgcacattattgttcgcgcgaggccagccgccggttgcattgcatggcgcagctgccgcccaggatcccgaccgaggtgcaccactggcccgaggggggccagcacggcgctgcggcggcgtgggcggacgacttcgccgagttcgcggcggcgcggcggggcgcgcaccgcatgtcgctcagcgactcggtcgccttcgtcnaggtggcgccggccgacggcggggccggcgagttcgaccggctcgacgacaaccagctcctgtccatgttccccacccgacaaggccggcggaagcgggtcctccgccgccggggtccgagaaacggggcaagcaacgatagcgacggcgaataagcgggggtccgcgcgggcgggcccggcggggaggggctcccctcccacctgcagtgggctggcggccaaaccaaaaacggaattcgtgggatgcccccaagccccccggcggccgaagtgggaaggacaaagcttgcccgtcggtcgcccctcccccggaacctcattccggggaacccctaagaaggggtggaaaaaggattcctttgccaaacccgggcagtccggactcaaaaaggtcccccgggggaaaggaaaccctggagttaaacttctcccaaaccttccgacggcacacgatcaaaaacccttggcaataaacaaagggggtctggcggcacgtttccccccccgccgtggggggttttctggggaac

SEQ ID NO: 80138 - protein, 104 aa, Zea mays
  misc_feature: Ceres CLONE 1565358
  misc_feature: The sequence is a functional homolog of SEQ ID NO 1362 in the 10/374,780 US patent application
  misc_feature: The sequence is a functional homolog of SEQ ID NO 1482 in the 10/412,699 US patent application
  misc_feature (54)..(54): Xaa is any aa, unknown, or other
MAQLPPRIPTEVHHWPEGGQHGAAAAWADDFAEFAAARRGAHRMSLSDSVAFVXVAPADGGAGEFDRLDDNQLLSMFPTRQGRRKRVLRRRGPRNGASNDSDGE

SEQ ID NO: 80139 - DNA, 1118 bp, Zea mays
  misc_feature: Ceres CLONE 1565361
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (16)..(16): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
nnnnntttgttttggntgtcnnaaaagnccctaacaaaaaggagatagagagggggaggtnnnngtnntnncaaagctggagctcaccgcggtggcggccgctctagaatagtggatcccccgggctgcaggaattcgtctcacccctagagaaaaaaccaccgcaccgacaccgactccgagcctcgccgcgccgcgctacctccgctgctctgttgccccctgccggcctcgaggccggaagggctggcgaggatggctttctgaccccgaccccttcgaccagggcaggccacgaggactacccccttcttaactcgaggcagcccggaggcggctagccaacggaaccggcttccggggcgaatggaccccctccgggtttcggcggcgcctatccagggggcaaccccggtgcggttgacgttcccccttgggggaccatgggggggacccctcccaaacccaggggggagggggcccctctttcttggggaatcccccccccccgggggctcagagggggggggatttttcccgagggaggggcaaaaaggcgccctaaaaaaatgtgtttggtcctgcccccttgggggggggaaaaaaaaagggggccccccattttttttcccgcaggctggcccaaccctttataaatatggtgccccatgagtaaattcccccccccacctattttgggcggaaaaaattttggggaggggggccccttgtgggttttggtaaaaacacccgcccctcttggtggaaattttcgggacggcattgttttttttgatcccaagggaaaactcgtcggtgttcctccctgttcttgagccctccctgtgtgtggttacctcaaatattagggcgccccccccccccgcatgggggggttatttgtccctctcttcaccaaacccagcgggaggagtgttttttcctcacggaagaaaagaaacccacctccctccccaggctgtgtgtgtaactgatgtgtataacgggagcgccaccactcttagtccacacttgtatactaaggagaatcgggctgcgtccactaaaattgtgggtgctcgttagcgattactttcgaggaggggagggttgttctc

SEQ ID NO: 80140 - DNA, 791 bp, Zea mays
  misc_feature: Ceres CLONE 1565362
  misc_feature: Encodes the peptide sequence at SEQ ID NO. 80141
ctccccgcggtggcggccgctctagaactagtggatcccccgggctgcaggaattcgtctcacccctagaaaaagcagaagcgagagagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaaatttcacggcaagtcgtgtgcctgaaccttcatcttaagttgttgtcgtaaaaaaaaaaaaaaaagccccctctctcagcgcatcgtcgctctcatggtcccgcctcatcgccgtctcccgcatcccgccagcccctg

SEQ ID NO: 80141 - protein, 99 aa, Zea mays; identical to SEQ ID NO: 7383
  misc_feature: Ceres CLONE 1565362

SEQ ID NO: 80142 - DNA, 1238 bp, Zea mays
  misc_feature: Ceres CLONE 1565363
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (451)..(451): n is a, c, t, g, unknown, or other
  misc_feature (888)..(888): n is a, c, t, g, unknown, or other
  misc_feature (915)..(915): n is a, c, t, g, unknown, or other
  misc_feature (995)..(995): n is a, c, t, g, unknown, or other
  misc_feature (998)..(998): n is a, c, t, g, unknown, or other
  misc_feature (1002)..(1002): n is a, c, t, g, unknown, or other
  misc_feature (1076)..(1076): n is a, c, t, g, unknown, or other
  misc_feature (1151)..(1151): n is a, c, t, g, unknown, or other
tttttttgttttttttttttgggggcgggaccaattgacaagaggtgttagaannnggnnnnnnnccaagctggagctccccgcggtggcggccgctctagaactagtggatcccccgggctgcaggaattagtctcacccctagaaaagcagaagcgagagagatccggagcagccggagtcccaccgaccccgccgccggtcgccctgaatctcctcgccgctgcctctcgtttctcttttcaatagtcaagatgagccgtggtggtagtgccggtggtggtcaaagttctgctgggttctcgctttggcagcggtgagaccccgctacccagcgggggcaccagcgtgctaatgctcgacgttgatgagaccaccctccgggtcgaaaggaacggatgcctgcccaaggaggggttgccggcacgggggtttcccttgtgaggatganactaaactcccaggggggtctgatggctcagacaaggggggcaacccccccccccccgaacagtattgtcaggctaggggcccccgctggcttcaggggggtacgggctcctccccctggggggccacccgagtcgttttggcgaaaccctcgaggccccggttgggttgggggggccgccccccccaaaagattattgggcccccccccatatccctgggctaggcgggggggattcattctcacggggtatttcgtgggaaaacccatccccgcaccgcgagagaggtcctccgcgtgccgatgaggggcatgccccacccgacgcgggtgatacacaagggtgtctgattgtgttgtgagtcgccccgaggcttggcactcactggacatataatatagagcggctccgagtgcgcaccaaaagacagatggtnatctagcgcgccctcccggagatgctngctgagggagggcgtcggtgtcactcgctggagcgactcatctctcgcggctctgaattatattgagtgcgtcacacaangangcangacgacctacgcgcgtgcacatacacgccggagagggaaaggatggtttttactcatacgacgaggggacacgntctggtggagggtgagctccataatcgtcttaaccatcactatattgctactcgacatgaagatgtactcttagncgcgctccctccctcctccatttgacatacggtcgcgcggtcatggaacccatggttgtgtatagaagcggaagtctgacttatacg

SEQ ID NO: 80143 - DNA, 846 bp, Zea mays
  misc_feature: Ceres CLONE 1565366
  misc_feature: Encodes the peptide sequence at SEQ ID NO. 80144
  misc_feature (531)..(531): n is a, c, t, g, unknown, or other
ctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtngtggtcaaggccggctcccagatcttcagcgagggtggactggactacctcgggaaaccgagcctcatccacgcgcagagcatcctcgccatctggggcctgcaggtcgtgctcatgggcgccgtcaagggctaccgcatcgccgggcggcccgctcgggaaggtcgtcaacccgctctatcccgggcggaggtttctaccccgttgggcctcgccgaacaaccccgaaggctttcgctgaagcccaggggaaaggagctcaaaacggccggcctcccccctgttctcccagggtcgggaatctctccgccaagc

SEQ ID NO: 80144 - protein, 235 aa, Zea mays
  misc_feature: Ceres CLONE 1565366
  misc_feature (65)..(220): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVVVKAGSQIFSEGGLDYLGKPSLIHAQSILAIWGLQVVLMGAVKGYRIAGRPAREGRQPALSRAEVSTPLGLAEQPRRLSLKPRGKELKTAGLPPVLPGSGISPPS

SEQ ID NO: 80145 - DNA, 1283 bp, Zea mays
  misc_feature: Ceres CLONE 1565368
  misc_feature: Encodes the peptide sequence at SEQ ID NO. 80146
  misc_feature (10)..(10): n is a, c, t, g, unknown, or other
  misc_feature (58)..(58): n is a, c, t, g, unknown, or other
  misc_feature (73)..(73): n is a, c, t, g, unknown, or other
  misc_feature (843)..(843): n is a, c, t, g, unknown, or other
  misc_feature (1017)..(1017): n is a, c, t, g, unknown, or other
  misc_feature (1075)..(1075): n is a, c, t, g, unknown, or other
  misc_feature (1076)..(1076): n is a, c, t, g, unknown, or other
  misc_feature (1079)..(1079): n is a, c, t, g, unknown, or other
  misc_feature (1080)..(1080): n is a, c, t, g, unknown, or other
  misc_feature (1106)..(1106): n is a, c, t, g, unknown, or other
  misc_feature (1139)..(1139): n is a, c, t, g, unknown, or other
  misc_feature (1176)..(1176): n is a, c, t, g, unknown, or other
cttttccttnccttctttttcttctggtctaaaacgctacccggcggggggggcgtgntgtgataaaaaaagnggaaggctggggctccccgcggtggcggccgctctagaatagtggatcccccgggctgcaagaattcgtctcacccctagaaaaaacatctcttgccatcatccgacttcaagtctcgctacgtagcagtgggatagaaaaactagccgcaatggccagcagcaccatggccctctcctccacggacttcgccggcaagggtgtgaacgtgccgtcgtcgtccgccttcggcgaggcccgcgtgacgatgctcaagacggcggggaaggccaagccggcggcggcgtcagggagcccgtggtacggccccgaccgcgtgctgtaactgggcacactgtccggggagccgcctagctacctgacgggctacttccagggcgactacggctgggacaacgaaggacccccgcccggacccagaagacgttcatcctagaacccgagaacctggtgggtgatccacatccggcgtgggacatgaccaaggtagcgccatcggcgtgccgtcatttcccgaggagccttggttcgtcccctacaaatggagtattgaaagctttccgaggactatgtgcccgtatgtggggttataagaggcggcccccggccctgtacccaaagaatgccttctacagagggcgaaagacgggttgcagtatcatgggtgcaccattcactcctctgcgcggggcgcaataacccccggagagaaagtcacacttgcgatattttctctcaaactgaactgagatcgcatgtataaaataccntgagtctatgagatgcgtgctctcactattcttctttgagggggcggggacgatatgggtgtacatttgaggcgtacaacggagatgagtccattcctaaatcaggagggagaacgtaccctcgcttcaccatataaactcgtagactatatactcccgggcgcggtattcatngtcgcgctgtgggatggggaagctctgtaaattgtctgagtatgacaagagcggatcnnctnnttcactagaacgcgaagatgattccncgagtaatgaactagaggtgccggtggcagatncttgtgtctcaaatgacactcgccggtgggggtatancgtgctagcgtcggtaacacatatcgcgccggtatacgagtgctttctacgtactatgtacgatcaccccaaatgtggggtataagagtacagctccacagagtaac

SEQ ID NO: 80146 - protein, 57 aa, Zea mays
  misc_feature: Ceres CLONE 1565368
MASSTMALSSTDFAGKGVNVPSSSAFGEARVTMLKTAGKAKPAAASGSPWYGPDRVL

SEQ ID NO: 80147 - DNA, 822 bp, Zea mays
  misc_feature: Ceres CLONE 1565369
  misc_feature: Encodes the peptide sequence at SEQ ID NO. 80148
  misc_feature (261)..(261): n is a, c, t, g, unknown, or other
  misc_feature (281)..(281): n is a, c, t, g, unknown, or other
ctggagctccccgcggtggcggccgctctagaactagtggatcccccgggctgcaggaattcgtctcacccctagaaaaactagccgcactgcgctctatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgcttccgctccctcgacttcggcgagcgcaacngggtacctcaaggggcgtcngtcaccggacgttcatcccacgaccccccggccgtggggcgcgcccgcctcggccaaaggtcactttttccgccaccccattccgggtccaaagcaccaaaaaggagctcttttgttcgcaccggagggcatgttaaacgggcccacttcgttatattgggggtggccgggccaaccctttccttttgggaaaaggtgctggcccctccccggggaatccccgaagggggggccctttttttggaaaatttaaaaaccccacttttggggaaaccccgggggtgtttttcccccgggggcccctttgggggggaataaccccccctttttggttgctcacccccaccaaacccccttgaaaacagcgggggaatttcgggagagatttaaaaggggcggcccctcttgggggcgcccaaaaaataaaaatttttttccccccacaaaaaaaattccccgcgcggcgcatatatattatttgtgcgcacaattttcttttttttgtggggtggggaggcccgggctcccttacataaaacat

SEQ ID NO: 80148 - protein, 150 aa, Zea mays
  misc_feature: Ceres CLONE 1565369
  misc_feature (39)..(39): Xaa is any aa, unknown, or other
MGRVIRAQRKGAGSVFKSHTHHRKGPARFRSLDFGERNXVPQGASVTGRSSHDPPAVGRARLGQRSLFPPPHSGSKAPKRSSFVRTGGHVKRAHFVILGVAGPTLSFWEKVLAPPRGIPEGGALFLENLKTPLLGKPRGCFSPGGPFGGE

SEQ ID NO: 80149 - DNA, 780 bp, Zea mays
  misc_feature: Ceres CLONE 1565372
  misc_feature: Translation starting site: 194
  misc_feature: SWISSPROT Homolog: EC 2.5.1.18 Glutathione transferase
  misc_feature (543)..(543): n is a, c, t, g, unknown, or other
  misc_feature (652)..(652): n is a, c, t, g, unknown, or other
  misc_feature (688)..(688): n is a, c, t, g, unknown, or other
ggagctccccgcggtggcggccgctctagaactagtggatcccccgggctgcaggaattcgtctcacccctagaaaaaacacacccatccaattccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctgggaggtggagcccaccagctgagcccgccggcgatcgccatcgtggntggagtgcgtgttcgcgccgttcctgggccgcgagcgcaaccagggcggtgggtggaccgagaacgtggagaagctcaagaaaggtgctggaggtgtacaaggcgccgnctggccacgtggcccgtacctcgccgggcgacttcntcagcctccgcgacctcagcccccttcaccatcatgcactgccctcatggcccaccgagtaacgcggctctcgtccatgcgcctcccgcacg

SEQ ID NO: 80150 - DNA, 1127 bp, Zea mays
  misc_feature: Ceres CLONE 1565373
  misc_feature: Encodes the peptide sequence at SEQ ID NO. 80151
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (28)..(28): n is a, c, t, g, unknown, or other
  misc_feature (56)..(56): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (965)..(965): n is a, c, t, g, unknown, or other
tgggtggggggntnntacaccgcgaggnttacaaacgttgtgacgccgggttattnatatatnnnnnnnnncaagctggagctccccgcggtggcggccgctctagaatagtggatcccccgggctgctggaattcgtctcacccctagaaaaaacacacccatccaattccagctgctgatcttgatcctgcaccccgagccgtacacaagagctagtcggtagaacttgcaggagcggagcataactaagtgcagagaacaggacatatggctacgcccgcggtgaaggtttacgggtgggctatctcaccgttcctatcgcgggctctactggccctggaggaagccggcgtcgactaccagctcgtcccattgaaccgcccggacggcgaccacccgccgccggagcccctcgcccaggagccctttcgggaaggggcccgggctccaagaatagcaacctaaactccccccaaacagctgcgaaacgcaagggcaggttctcccgaaaaaaacaaccccggaaccttcttggaccgccggccaggttgggaaacaaaaacgcccaatgtgtgggaaccctttgggcttgaaaagttggaaaaacccccaccccaccttgaaacccccccccgggggaaaaacccccattctatggattggagaaaaagccttttttttccccgccccccgttttctcttgggggcccccgtaagaacgcccaaaaccaaagtgggagatgtggtgtgtgggacaccaaaaaaaaaactcgggggaaaaaaacaccccccataaaaaaaaagttgcccgtgtgaagaattgtttaatacaaaagagggcgccggtttttgggtcccaccactttggccgcgccggttgctcccattcaccggggggagaaatatttctcggcaaagacccttgttggcgcaaaaaatagtttggcccctccttttttgccngattttagtgggggagggcgggctcccctatggggggcccccccagaataaaatcacccgcgcctttctatttacaccaggaggggcactcccacgccacgagatctaaaagaggactcctagtgtgtgaaaagaggcctttattactccgaggagataccc

SEQ ID NO: 80151 - protein, 65 aa, Zea mays
  misc_feature: Ceres CLONE 1565373
  misc_feature: SWISSPROT Homolog: EC 2.5.1.18 Glutathione transferase
MATPAVKVYGWAISPFLSRALLALEEAGVDYQLVPLNRPDGDHPPPEPLAQEPFREGARAPRIAT

SEQ ID NO: 80152 - DNA, 802 bp, Zea mays
  misc_feature: Ceres CLONE 1565374
  misc_feature: Translation starting site: 159
  misc_feature (614)..(614): n is a, c, t, g, unknown, or other
  misc_feature (750)..(750): n is a, c, t, g, unknown, or other
ggagctcaccgcggtggcggccgctctagaactagtggatcccccgggctgcaggaattcgtctcacccctagaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccacctcccctccccccgcggccgccgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgaacgcctgccgcacctcatcgtcagcggcgaccagcggcanctggggcgagttcgtcaccccgggccctgctcttcctctacatcgcccgggtggatcggggtgggtcggcaaggagctacctcatcgccgtcagcggcgagaaaagccccgccatgagggagatcatcatcgacgntgaagtcggcaaccgcctcctccccagggggttcatctgggccgtcgcggcc

SEQ ID NO: 80153 - DNA, 798 bp, Zea mays
  misc_feature: Ceres CLONE 1565376
  misc_feature: Encodes the peptide sequence at SEQ ID NO. 80154
ctggagctccccgcggtggcggccgctctagaactagtggatcccccgggctgcaggaattcgtctcacccctagaaaaagccacttgactcccatcccctctcgcgtggtccttctcctgctcccgctcccgctgctcctcatcttctcgcgccgcggcccccagcctttgcccgccgctacctctctctaattgggcggcggcctgccggtccgatggcgttcaactaccacgaccacgcgctggcgatggaccccgcggcggccgccgcggttggggcggccgcgaaccctagctttgtctccggaggtggcatggccggggggcccggctgggagagggagaaggcggccatcgcggcgcacccgctgtacgagcgtctactcgaggcgcacgtcgcctgcctccgcgtggccacccccgtcgaccagctcccgcgcatcgacgcgcagatagcggcgaggcccccgcccatggaggccgcggctgcggctgctgcggcgggcggagcacactcgggaggcgaggaactcgacctcttcatgacacattatgtgttgctcctctgttcattcaaggaacaactccagcagcatgtgcgtgttcatgcaatggaagcagtcatggcttggtgggagctcgaacaaaacttacaaagccttacaggtgcatcttcctggggagggcactggggcaactatggtctgacgatgaaaaaaatcagggggacagtgaaaagcacatggtttgatggaaaagagggggcaaaagggaaatgggaattgggcccattaatg

SEQ ID NO: 80154 - protein, 194 aa, Zea mays
  misc_feature: Ceres CLONE 1565376
  misc_feature (96)..(151): Pfam Name: KNOX2 Pfam Description: KNOX2 domain
  misc_feature (41)..(85): Pfam Name: KNOX1 Pfam Description: KNOX1 domain
  misc_feature: The sequence is a functional homolog of SEQ ID NO 710 in the 10/374,780 US patent application
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
MAFNYHDHALAMDPAAAAAVGAAANPSFVSGGGMAGGPGWEREKAAIAAHPLYERLLEAHVACLRVATPVDQLPRIDAQIAARPPPMEAAAAAAAAGGAHSGGEELDLFMTHYVLLLCSFKEQLQQHVRVHAMEAVMAWWELEQNLQSLTGASSWGGHWGNYGLTMKKIRGTVKSTWFDGKEGAKGKWELGPLM

SEQ ID NO: 80155 - DNA, 670 bp, Zea mays
  misc_feature: Ceres CLONE 1565381
  misc_feature (325)..(325): n is a, c, t, g, unknown, or other
ctccccgcggtggcggccgctctagaactagtggatcccccgggctgcaggaattcgtctcacccctagaaaaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccgggtccggccgcctgccgttctgcgcccacgccaccaccttccggggccgcgtcaccatgtcccgcgggagtgggatgccccggggcaagccccgncccccgcccaacctcggacgggttcctcggccaggtgaactttcgggtttcgaaccccccctggggcctgggcccaccgggtggcccgggaaaaactttcccaagccgggttttccaaagggaaaatcccgggaaaggggggtgtacccccccctgtggccccgggggttggggggcccatttgttctttgtgggcccccttttgtccccggggggggggggggtgcctttggggtgtccccccccggaaaagagggccccctctgggggggggcccttggggggcaccaaaacaagggggggggtgggaaaaaaaaaaggcgccccccccccggagaaaattgc

SEQ ID NO: 80156 - DNA, 850 bp, Zea mays
  misc_feature: Ceres CLONE 1565382
  misc_feature: Encodes the peptide sequence at SEQ ID NO. 80157
ctggagctcaccgcggtggcggccgctctagaactagtggatcccccgggctgcaggaattcgtctcacccctagaaaaaaaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcaggaacccgagcctcatccgcgcgcagagcatccttgctatctgggcctgccaggtcgtgctcatgggcgcccgtcaaaggctaccgcattcgccggggggcccggctcggcgaaggtccgtcgaccccgctccaacccccgggcggggcaactttccaaaccggcttcgggccttcacccaaacaaaccccgcaaggccccttccgccccaaaactctcaaggagtccaagaggaacctctcaagaaaaaacgggcccccgccctctt

SEQ ID NO: 80157 - protein, 236 aa, Zea mays
  misc_feature: Ceres CLONE 1565382
  misc_feature (65)..(210): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLRNPSLIRAQSILAIWACQVVLMGARQRLPHSPGGPARRRSVDPAPTPGRGNFPNRLRAFTQTNPARPLPPQNSQGVQEEPLKKKRAPAL

SEQ ID NO: 80158 - DNA, 870 bp, Zea mays
  misc_feature: Ceres CLONE 1565384
  misc_feature: Encodes the peptide sequence at SEQ ID NO. 80159
  misc_feature (438)..(438): n is a, c, t, g, unknown, or other
  misc_feature (455)..(455): n is a, c, t, g, unknown, or other
  misc_feature (482)..(482): n is a, c, t, g, unknown, or other
ctccccgcggtggcggccgctctagaactagtggatcccccgggctgcaggaattcgtctcacccctagaaaaatccactacacacaaacacacaatggcaccagaaacgatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgaacctcacgggcgccgactggcacgcgcagctccacagcgcccgcaataacgcgcctttgccctgggcaggagccgtccangatcgcgcccatgtcanggcggcaccttcgtccgcgtgcctggncagatgcactacccgtccgcgggaatgcgcggtcccggtttccttgctccccgatcaaagaacccttggttaaatcaccttccccagggacccctggccgggggcggagtatccaccgggggcctgaccacaaaaaacccgccggggcccgaaattacccccggggggccttaacaaaaaaaaccgggggcccggaattcccccctcccccccgcgggaaaacccccccccccccccccctgtgttgggggggccaaaaaaaaacccccaattttacccccccccccccaaaaaacaattttttttttttaaaaaaaaaacccccaaattttaaaaaaacgggcgcgcccccttgtttttttaattttacccaaccgcgcgccggttt

SEQ ID NO: 80159 - protein, 103 aa, Zea mays
  misc_feature: Ceres CLONE 1565384
  misc_feature (31)..(102): Pfam Name: DUF1210 Pfam Description: Protein of unknown function (DUF1210)
MAPETMLLGVCAVLMVVGVTNAAEGQVASVVVGLARCADSTRKNMKAEAGFKGLQVAIKCKNSNGEYETKAVSEIQSSGAFSVPLAAEPHGRRLARAAPQRPQ

SEQ ID NO: 80160 - DNA, 837 bp, Zea mays
  misc_feature: Ceres CLONE 1565387
  misc_feature: Translation starting site: 194
tccccgcggtggcggccgctctagaactagtggatcccccgggctgcaggaattcgtctcacccctagaaaaactctagcttcccactccgctcggccaccagctttgaccgcctcccctcccctccgctcctgttcttccataccccactcccccgcaggagcggcgcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtgggtggtggatcccatgctgatccatttgacattttctcatcattctttggaccctcttttggaggaggtggtggaagcagcaggggaagaaggcaaaggaggggagaagatgtagtccactcacttaaagtttctctggaagatctttacaatggaatctcaaagaagctctctctttcgcgcaatgtcatctgctccaagtgcaagggcaagggctcgaagtctggtgcttcaatgaggtgccctgggtgccagggctcaggtatgaaagtcaccattcgtcagctggggccttccatgatacagcagatgcagcagcctttgcacgagtgcagggggactggggagagcatcaacgagaaggaccgctgcccagggtgtaaggggtgaagaa

SEQ ID NO: 80161 - DNA, 838 bp, Zea mays
  misc_feature: Ceres CLONE 1565388
  misc_feature: Encodes the peptide sequence at SEQ ID NO. 80162
acccgcggtggcggccgctctagaactagtggatcccccgggctgcaggaattcgtctcacccctagaaaaactctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacctagttgttgcctatgaaccaatttggggctattggaaactggaaaagttgccaccccagctcaaggctcaaggaaaatgcacgccctcccctgagggaatgggctaaaagaccaatggccaggcccctggagggttgctgaaacttaactagggaaccttccttccgggaggcctcttttaaacctggctgccaaacctggcaaagaaagcctaggcagcacaaagcca

SEQ ID NO: 80162 - protein, 195 aa, Zea mays
  misc_feature: Ceres CLONE 1565388
  misc_feature (5)..(177): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNLVVAYEPIWGYWKLEKLPPQLKAQGKCTPSPEGMG

SEQ ID NO: 80163 - DNA, 901 bp, Zea mays
  misc_feature: Ceres CLONE 1565389
  misc_feature (151)..(151): n is a, c, t, g, unknown, or other
cacgaggcagaatgtatatcttaaaaaaaaaaaatacagggcttgtcgtggatgtcttccttttttttgttttttttatctgaactcacgcggtggcggccgctctagaacagtggatccccgggctgcaggaattcgtctcacccctagnaaaaaacctcgctctccgctccgttggccccatggagtccgtcgcgtccgccgcgatcgccaccacctcccgctctctcccgctccccttctcttctaccccggttccaccggccggcgccgtgccgccttcctccccgttgccgcctccaagcgtcacgacgacgacaaggaggcccgcgaaaaggggcccggcttcggaaccaccggcggcgagccctaccaagcccttcggcggccattaaacgggaatttttttcaaatttttgggcccaaaaattattatcaaaaaggggaaaaagcggggaggccaaattggtggaggggaaccactgggggagggggggaagaaaaaaatacccaccatttttggcccaccacagggagagatgtggtgataaaatagaataggagtgggaacaaggtttttttgttggagggtccactccatccatattaaacacaacgagggagtaaatattccttacgccatctcggaggggcgggaggagtactaagctaggagaggtaacgcaatataatattgatacatctcgcgcggtttttcagcatgggtagttataggataacaatacatttggcctattgagattaatgtgttattaaaaacaataataattctctcccccatatctaattaatgaagcggatgaaagatctatagaatacgttacgagaaccaatgccttggctatctagcaatagagtgggtaattaaagatacatctaa

SEQ ID NO: 80164 - DNA, 852 bp, Zea mays
  misc_feature: Ceres CLONE 1565393
  misc_feature: Encodes the peptide sequence at SEQ ID NO. 80165
  misc_feature (310)..(310): n is a, c, t, g, unknown, or other
  misc_feature (335)..(335): n is a, c, t, g, unknown, or other
  misc_feature (336)..(336): n is a, c, t, g, unknown, or other
  misc_feature (357)..(357): n is a, c, t, g, unknown, or other
  misc_feature (530)..(530): n is a, c, t, g, unknown, or other
  misc_feature (617)..(617): n is a, c, t, g, unknown, or other
  misc_feature (666)..(666): n is a, c, t, g, unknown, or other
tccccgcggtggcggccgctctagaactagtggatcccccgggctgcaggaattcgtctcacccctagaaaaaacctcttcaatcccagtcccacacaaagtttctcctcgatcctcatctcctccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctnggacgacggcaccaagaagcgaggnncctcggggaaccagcccgggnccgccagaagaacctcggaccttccggacccacgaaccaacgaaaaaccgggccggggggccccccccaaaggggggcccaaggtggggcccgggggggggggccccccccggggggaagagggggggcttccccgggggaaaaaaaaaaacaccccctctcttccggggggngggacgggggcggggggccccccccaaaaaaaaaaaggggggggccaccggccccaaaaaaacccccacaaaaaggccccccccccnccccacaacccagggggggggggggggggggccccctcttttttaaccntgttataaaaaagaggggggggggaagacaaagtgggtgtaggggagggggggggggtctccccccccctccccgtctaatattcttttttttttattcaaaagaagaaagaagaggggggtggggccccccgcccccccccccccccctcggggggtggtggttgtgttttatcaaaaggggggg

SEQ ID NO: 80165 - protein, 222 aa, Zea mays
  misc_feature: Ceres CLONE 1565393
  misc_feature (51)..(51): Xaa is any aa, unknown, or other
  misc_feature (58)..(58): Xaa is any aa, unknown, or other
  misc_feature (116)..(116): Xaa is any aa, unknown, or other
  misc_feature (145)..(145): Xaa is any aa, unknown, or other
  misc_feature (161)..(161): Xaa is any aa, unknown, or other
MELDADNLSATELRLGLPGTSSSSSDDWQKKPSPSVGAKRALGRRHQEARXLGEPARXRQKNLGPSGPTNQRKTGPGGPPQRGAQGGARGGGPPPGGRGGASPGEKKKHPLSSGGXDGGGGPPPKKKRGGPPAPKKPPQKGPPPXPQPRGGGGGGPLFFNXVIKKRGGGRQSGCRGGGGGLPPPPRLIFFFFYSKEERRGGWGPPPPPPPLGGWWLCFIKRG

SEQ ID NO: 80166 - DNA, 842 bp, Zea mays
  misc_feature: Ceres CLONE 1565394
  misc_feature: Encodes the peptide sequence at SEQ ID NO. 80167
ctccccgcggtggcggccgctctagaactagtggatcccccgggctgcaggaattcgtctcacccctagaaaaatatacagcttaataagatatatgcagagggtggatttgtaaaaaaaaaaaaaaaaaactcaccaccactcatcaccaccagctgccattgccatctactgacctgtgacctccgcatttccaaacagcccgagcgagcgagctagcagagcggcggcaggcacctccctcctcaaggaacatggcccgcacgcagcagttggcagtagtggcggcggccgtggtggccttggtgctgctggcggcggcgacgtcggaggcggccatcagctgcgggcaggtggcgtcggccatcgcgccctgcatctcctacgcgcgcggccagtgctcggggccctccgccggctgctgcagcggcgtcaggagcctcaacaacgccgcccgcaccaccgccgaccgccgcgccgcctgcaactgcctcaagaacgccgccgccggcgtcagcggcctcaacgccggtaacgccgccagcatcccctcaaagggcggcgtcagcttcccctacaccatcaggacctccaccggattgctccagggtgaaactgaaccctaaacgacgaccacgggccccggcgggccgcctgaaaacaattccttattctatcccccccttcctccggggccctgggggttcggaaccgtccatgacccatttcttcccttacccatggaatcaccaaattggaaggttccacctacctacttacgggaaaaaaaaaaacccctcccggcgaacggttcgttccctttggggcccggggggggggag

SEQ ID NO: 80167 - protein, 123 aa, Zea mays
  misc_feature: Ceres CLONE 1565394
  misc_feature (31)..(112): Pfam Name: Tryp_alpha_amyl Pfam Description: Protease inhibitor/seed storage/LTP family
MARTQQLAVVAAAVVALVLLAAATSEAAISCGQVASAIAPCISYARGQCSGPSAGCCSGVRSLNNAARTTADRRAACNCLKNAAAGVSGLNAGNAASIPSKGGVSFPYTIRTSTGLLQGETEP

SEQ ID NO: 80168 - DNA, 846 bp, Zea mays
  misc_feature: Ceres CLONE 1565395
  misc_feature: Encodes the peptide sequence at SEQ ID NO. 80169
  misc_feature (846)..(846): n is a, c, t, g, unknown, or other
acccgcggtggcggccgctctagaactagtggatcccccgggctgcaggaattcgtctcacccctagaaaaaaaacacaaggcgaccgcagagggcaggacaggacagagacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtggggcaggatccaaatggcggcggcaatagaggaactgcggctcctgggatccatccctgtactggaaggtccgggagaggtcgacggcgtggtgggtgaggaagggcgaccgcgaggcggcggcgacgacgaagagatcctgcgattcatggactcggtggacagctacctgctcctcatggactccctatcctccgctcttcgtcagggctggcttgacctggcaagtgctcgccattctatgggcacatcacgcgtttcgagtacactgtttgatcacaaggagcagtctgctgccactaagcttcaaattgttgatcatgatggcctgaaatcatcagaggcaaaaacacactttgcaaatataaaagtggtctttgcaaaaaagattgtcactccacctatgatcctcagtgagagggatttttactggacccaaaaatgagggcatccaaggatcaagttacttacccccagaaaaagggaaaacccttgaaaagtgcaaaacccccccaaccactggtcctacaagggtggcctgatggcctaagccatttcatgtgttcaaaaaaaaccggaagaacaaan

SEQ ID NO: 80169 - protein, 143 aa, Zea mays
  misc_feature: Ceres CLONE 1565395
MAAAIEELRLLGSIPVLEGPGEVDGVVGEEGRPRGGGDDEEILRFMDSVDSYLLLMDSLSSALRQGWLDLASARHSMGTSRVSSTLFDHKEQSAATKLQIVDHDGLKSSEAKTHFANIKVVFAKKIVTPPMILSERDFYWTQK

SEQ ID NO: 80170 - DNA, 836 bp, Zea mays
  misc_feature: Ceres CLONE 1565396
  misc_feature: Encodes the peptide sequence at SEQ ID NO. 80171
  misc_feature (558)..(558): n is a, c, t, g, unknown, or other
ctggagctccccgcggtggcggccgctctagaactagtggatcccccgggctgcaggaattcgtctcacccctagaaaaactccaccacggcaccaccatcactccaacaccaccgcctccctctccgttctcttcctcccaacgactcaaaccgccaccgtcgcggctccctgaaccatcagaccagcccagagcccagcccaccacaaacgctgctgctgctggagagaggggcgcgcgggcggacgggagcgatgggcaactgccaggcggcggaggcggcggcggtcatcatccagcaccccggcgggaaggtcgaccggctctactggtccaccaccgccgccgaggtcatgcggaacaacccgggacactacgttgccctcgtcatactccgtgttcctgcagataacaagcccgccgccgccggggacgccgcggcgtcctccggccccggcagtggtggtgccaagatcaccagggtcaagctgctgaagcccaaggacacgcttctccttggccaggtctaccgcctcatcaccgcgcaagaggtgacnaaggcggtgcgggcgaggaagaacgagaagatgcagcggtgcgaggccatcaggcagcagcacgagcagctccggcgcggcgacggggctcaccggagctctttcagccaggaacgggagcaggacaaggaccggccaccggggaagaggccggcactgggggccgggcgctgcaaagcatcttccgagtccgcgagccagaacagcagcagcattcgttctctgaatccgccaccagctaatgcttacggacggactgtgccaatcgggcgggtgct

SEQ ID NO: 80171 - protein, 193 aa, Zea mays
  misc_feature: Ceres CLONE 1565396
MGNCQAAEAAAVIIQHPGGKVDRLYWSTTAAEVMRNNPGHYVALVILRVPADNKPAAAGDAAASSGPGSGGAKITRVKLLKPKDTLLLGQVYRLITAQEVTKAVRARKNEKMQRCEAIRQQHEQLRRGDGAHRSSFSQEREQDKDRPPGKRPALGAGRCKASSESASQNSSSIRSLNPPPANAYGRTVPIGRV

SEQ ID NO: 80172 - DNA, 1018 bp, Zea mays
  misc_feature: Ceres CLONE 1565398
  misc_feature: Encodes the peptide sequence at SEQ ID NO. 80173
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (48)..(48): n is a, c, t, g, unknown, or other
  misc_feature (54)..(54): n is a, c, t, g, unknown, or other
  misc_feature (55)..(55): n is a, c, t, g, unknown, or other
  misc_feature (57)..(57): n is a, c, t, g, unknown, or other
  misc_feature (63)..(63): n is a, c, t, g, unknown, or other
  misc_feature (64)..(64): n is a, c, t, g, unknown, or other
  misc_feature (74)..(74): n is a, c, t, g, unknown, or other
  misc_feature (80)..(80): n is a, c, t, g, unknown, or other
  misc_feature (83)..(83): n is a, c, t, g, unknown, or other
  misc_feature (488)..(488): n is a, c, t, g, unknown, or other
ggcgttcccacgnncnnncaggcacagaggaaaaggagcacgccaganggggannanataaannaaaataccgnaacaanttntatttttaactccccgcggtggcggccgctctagactagtggatcccccgggctgcaggaattcgtctcacccctagaaaaatcggtcgcgaggggagaaagataggagtcaatcaatttgcctgttctgcttgcttcctgctgaccttgtgacggagtgagccgccggtcttccccttcctcgccgaggggaaataataagccagccacagccagggccgccccgaggaagaagatgagcggaggaggcgtggacggagctccggtcgccgagttccggcagacggtgacgcacggcggccggttcctgcagtacaacatattcggcaacctgttcgagatcacgcacaagtaccagccccccatcatgcccatcggccgcggcgcctacgggatcgtctgctnctgtgattgaactccgaggacgaagggagatggtgggccattcaagaaagatcgcccaacgcccttccaacaacccacatgggaacgccaaagcgccaccgcctcccgggggaaaaccaaagcctgcctaaaggggcaccctccggacccccccgaagaaacccttcctttccggggcaattcaaggggggaacacgtggtaatattccccgggccccggcgcccccgggtgtccccccgggggaggggcgcggtttttatacaaacgagaaacgggggggttacacacactctccggggaaacccggggatactcttttaattggggaaaaaccgcgggaactccttgggcacaccacaaactatttttttctccgggggtggccccaccccccccccgggggagaccctctttcctggagagggaggaagaaaaaaccctcctccccccgcagagaaaaattttctcctcggggggggacccccaaaagaaatcccccccccccccgcgggggtccataaaaaaataa

SEQ ID NO: 80173 - protein, 59 aa, Zea mays
  misc_feature: Ceres CLONE 1565398
  misc_feature: SWISSPROT Homolog: EC 2.7.11.24 Mitogen-activated protein kinase
  misc_feature (57)..(57): Xaa is any aa, unknown, or other
MSGGGVDGAPVAEFRQTVTHGGRFLQYNIFGNLFEITHKYQPPIMPIGRGAYGIVCXCD

SEQ ID NO: 80174 - DNA, 861 bp, Zea mays
  misc_feature: Ceres CLONE 1565399
  misc_feature: Translation starting site: 247
  misc_feature: SWISSPROT Homolog: EC 2.7.11.1 Non-specific serine/threonine protein kinase
aaagctggagctccccgcggtggcggccgctctagaactagtggatcccccgggctgcaggaattcgtctcacccctagaaaaactggcgtcactcgcgtgtcacgcgcattctgcctctttctttctccccctcccctcccctcccctgctggcttctctcacgagctccctcggcctcgccgccgccgcctgctccggcgggagggacccatctcgcaccgtctcccctgaggcgaggtacacgatggacggaacgggaagaaatgccaaccctttgagcggttacagaattggcaaaaccctgggaattgggtcgttcggcaaagtgaagatcgcggaacatatattgactggtcataaggtggcgatcaagattctacatcgcatgaagatcagaagcatggatctggaagacaaagttcatagacaatcacgatgctgagatggtgtatgcatcctcatatcatacgctttgatgaggtgatagatacacccgctgatatctgtgctgttatggagtatgttaatctggacagttgtttgattacaccgttcaaaagggaggctaaggaagaggagcctaccccttgttttccaaacattattaccgggggtaaattcttgccttaagagctgtgtccttcccgggtttttgagcccggaaaatcgttttcttggaatccaaaaggcacgtttaaaaatggccaattttgcccttaaaaacaagtggggggggtagggaccctttctaaaaaccaaattggggccacccccattttttcaagccccggggggggaatctccgggaaaacgatcgcccgggccctgaaatataaactctgggaacttcttggacatt

SEQ ID NO: 80175 - DNA, 808 bp, Zea mays
  misc_feature: Ceres CLONE 1565401
  misc_feature: Encodes the peptide sequence at SEQ ID NO. 80176
  misc_feature (396)..(396): n is a, c, t, g, unknown, or other
  misc_feature (753)..(753): n is a, c, t, g, unknown, or other
  misc_feature (754)..(754): n is a, c, t, g, unknown, or other
ctccccgcggtggcggccgctctagaactagtggatcccccgggctgcaggaattcgtctcacccctagaaaaactcatcatcgagtcatccatctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcngctgactgcgttgcacagctccacagcgctgcgggggaacccgtgccccgggtcaagaacctttccagaaatgtgcccacaatcgtccaaagggcaactttcgtccgggggccccgggaaaagaacaaactaaccccttccaaaggaaaatgggccttcccccaaaccccctggggggggggggcgaataaaaaaaaaagcccccctttctataaaaaaacctttttttcccccaaaaaaaaaaaaacaatgtgtggttggggccgtggtaaaaaaaaaaaaaaaaaataaccccgcccgacgcaagaagagaaagagatgtttttcctctccacttaaagtgaaaggatgttgggnnttgtggtggattgtatgaaaagtagtattttgtatggatagagccaacacacac

SEQ ID NO: 80176 - protein, 94 aa, Zea mays
  misc_feature: Ceres CLONE 1565401
MAADALRGLLPGVYAVLMVIAVTSAASSDASSVVVGLAKCADCTRKNLKAEAAFKGLEVAIKCKNSKGEYESKAMGKLDGFGAFSIPLSTDLHG

SEQ ID NO: 80177 - DNA, 980 bp, Zea mays
  misc_feature: Ceres CLONE 1565403
  misc_feature: Encodes the peptide sequence at SEQ ID NO. 80178
  misc_feature (789)..(789): n is a, c, t, g, unknown, or other
ctggagctccccgcggtggcggccgctctagaactagtggatcccccgggctgcaggaattcgtctcacccctagaaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcagcgaggcccgcgtgacgatgccgaagacagcggggaaggccaagccggcagcggcgtccgggagcccgtggtacggacccgaccgcgtgctgtacctggggccactgtcccgggagccccccaagctacctgaccgggcgagttcccgggccgaataacggtgggacatcccccccgccttgcggcggacccaggagaaatttcgccaagaaaccaggagcctggaagtgaatccacctccccccctgggccaatggctgggtcgcccctcgaggggggccctttcccggaaaattcctcccccccccaaaacggcttcaaattttcgggcccaaagcccctggggggggtccaaaaggcccgggctccccccaatacttttcaccccaaaaggggggggaaccggaaaattctccctccgggggaaaccccccaaaagccttcttttcccccgcggggcaaaaaaaaattccccccgccccaactctggggggcccctgcccacaggggggagaagccccaaatggggggccgcccccaccaaagagggggtttaccaccnacttccccccggcggggacacccccttttgaaaaaagaaaacatttttatacccccgcctcttatttctccgcggggggaggagattttttaacaacaagtggaggggggtctccccccaaaaaaaacaccccaaagggcctctccccggagagaactaaagggggtgaagggaaacctctccaaaaccgc

SEQ ID NO: 80178 - protein, 78 aa, Zea mays
  misc_feature: Ceres CLONE 1565403
MASSTMALSSTAFAGKAVNVPSSSAFSEARVTMPKTAGKAKPAAASGSPWYGPDRVLYLGPLSREPPKLPDRASSRAE

SEQ ID NO: 80179 - DNA, 822 bp, Zea mays
  misc_feature: Ceres CLONE 1565405
  misc_feature: Encodes the peptide sequence at SEQ ID NO. 80180
  misc_feature (432)..(432): n is a, c, t, g, unknown, or other
  misc_feature (459)..(459): n is a, c, t, g, unknown, or other
  misc_feature (791)..(791): n is a, c, t, g, unknown, or other
  misc_feature (792)..(792): n is a, c, t, g, unknown, or other
  misc_feature (822)..(822): n is a, c, t, g, unknown, or other
agctccccgcggtggcggccgctctagaactagtggatcccccgggctgcaggaattcgtctcacccctagaaaaaaatccatacagaaatggtagggttcttcggcgcctctgctgcatctgatcactgtcgtttgctgacaacaaatggatcagttcaccatgaactgattagacgacaccatggcagaccaagaagtgcgatcaggtgctgcagcagcacggcaaggggaaggaccagggactattactaccaggtgctgggcatcgcaattcaatccacacctcagcagatcaaggaggcttacaggaaactccagaagcaacaccatccagacatcgccggctacaagggccacgactacacgctgctgctgaacgaggcgtacaaggttctgatgcgggatgtttccagttccaggcacgccgatnggaaggggcaggagtagggtgggggtncaggagccggttacaccggggacggatacagttcttgggaagggcccgtgagaagccaagctctcttcgtggacgagaacaagtgcataggatgcccgggagtgcgtgcaccatgcccgctaggacgttcgccatggacgacgttctcggcagcgcgcacgtgggaggtccagttcgcgacctggagcagcagattcagctgggctgtggagtcctgccccgtggactgcatccactgggtcgagagccaccgactgccccgtgctggaagttcctgtcccggccgcagccgaagaaaggccacgcgtatttcggcggcgggtgggagcccnnccggtacgtgtttgcggcggcgaatacttn

SEQ ID NO: 80180 - protein, 119 aa, Zea mays
  misc_feature: Ceres CLONE 1565405
  misc_feature (53)..(114): Pfam Name: DnaJ Pfam Description: DnaJ domain
  misc_feature (115)..(115): Xaa is any aa, unknown, or other
MVGFFGASAASDHCRLLTTNGSVHHELIRRHHGRPRSAIRCCSSTARGRTRDYYYQVLGIAIQSTPQQIKEAYRKLQKQHHPDIAGYKGHDYTLLLNEAYKVLMRDVSSSRHADXKGQE

SEQ ID NO: 80181 - DNA, 1251 bp, Zea mays
  misc_feature: Ceres CLONE 1565406
  misc_feature: Encodes the peptide sequence at SEQ ID NO. 80182
  misc_feature (60)..(60): n is a, c, t, g, unknown, or other
ggtgggggggggtgggggtttataaaatcatcgcctttctttctttgggttctttcttcncttttttttttcaagctggagctccccgcggtggcggccgctctagactagtggatcccccgggctgcaggaattcgtctcacccctagaaaaaaagcagcgcccgccgccgcacgccccgctccgatggcggccgcggctgagaccctgccctcctcgggcgcgcccttctccgtctccacaaccgcctcttcctcatccgtccgccgctgcctgctcctgccctccgcggctccccgccgagctctccgcgtcgtggcctccgccgctaccgaggcgccgccctagcccacgcagccagcgacatcgccctccggcatcgtgctcgtcgacccatccgaagcccagaaggtgcaccggctcaaggccgtcttcgaccagatggtcgtcccacctcttcagcgaggagttcggccaccaccagggccaccaggtctcccaaactcgagaaaaatgcgggtgaaccacgggctgggccccgggacgccaggagtactcgaaaaggggctggggttgccctcccaggaaaggaacccgcgcccaatgtatacacccgtgggagcgaggggcccccgtttctgggaccattgggtccaagagaaaggtccgcggggggacccgggtgtttcaaaggaaataccggcggtaatggggaaaaacccaccccagtcgggtgtgtttaacggcaaagagtccatcccccctttgtccgttcggtgggcgagggtggatattattaaggggtatacaatacattctctggtccgccggggtatggaaaatttagtggacgcactgtgtattcttaaaactccctcttgtatgtggggtggtttccgccatctatcgggaaaacaccgctgtgaggtcagtctgtttcaccgcagggggaggatgagagggcaaatacctcgcccatactagcatgagaccattttcacagtagatggtgggcgcccctggaccccggaggtctagacgctgtgccctctggtggggcgtcataccacggtggtattctctaacagtgggtcgagtaagtgtgccccccgcgcgcgagatatctcccccctcttcaaaagaggatcgggggtgccccctggagagaataataaaaaatgatcccctctggtggattgctctctctcgctattttggattgaagcgtggctgtgccaagaacaaagagaa

SEQ ID NO: 80182 - protein, 156 aa, Zea mays
  misc_feature: Ceres CLONE 1565406
MRVNHGLGPGTPGVLEKGLGLPSQERNPRPMYTPVGARGPRFWDHWVQEKGPRGDPGVSKEIPAVMGKNPPQSGVFNGKESIPPLSVRWARVDIIKGYTIHSLVRRGMENLVDALCILKTPSCMWGGFRHLSGKHRCEVSLFHRRGRMRGQIPRPY

SEQ ID NO: 80183 - DNA, 903 bp, Zea mays
  misc_feature: Ceres CLONE 1565408
  misc_feature: Encodes the peptide sequence at SEQ ID NO. 80184
ctccccgcggtggcggccgctctagaactagtggatcccccgggctgcaggaattcgtctcacccctagaaaaaatcaatccgatcgacatgaacctcgcgtccgcggtgcgagtgttcttgtcctactacctgctggtccaacggtggatggggtccgagcagggcggaggcgtgttcgatcaggggggccatagcgtcagcctcacccgcctcgacgaagcaagggcgccgccgaggtgcgccgtgcggtcgtccccgtccagcgcggccagcctgccgccgaagccgctgctcgtcgccgcgccgcgcgagactggggagtacccggtgatcctgttcctacacggctacctcgccgtcaactccttctactcccagctgttcgagcacgccccctcccatggctttatcgtcgtcggacctcagctgtacaccatatctggggccgacaccaccgaggagatcaactcagcggcggccgtcatcaactggctagccaccgggctgccgtcaactctgccactcggcgtccgcgcgaaccttaaccaagtgtccatctccggccacaatcgccggcgggaaaggtggcgtttcgccgctggggttgggcccaccccaaggccaaggctcgctgtcccttctcccccgccgttgttcgcccttggaccccggtggaaccgcattgggccgtgggcaaaaccaaacacccgcccccccaaaccctcacgggggctagcgacgggttccgattgcacgtgggggtggccccccccccatgggtccattcggacccgggggccttctgaccaagactggcccccctggggtttaaattgcttcccgggccgggtgtggagcccccgggggggccgtcaattccatcgcgcgggccctttttaat

SEQ ID NO: 80184 - protein, 270 aa, Zea mays
  misc_feature: Ceres CLONE 1565408
  misc_feature (22)..(255): Pfam Name: Chlorophyllase Pfam Description: Chlorophyllase
  misc_feature: SWISSPROT Homolog: EC 3.1.1.14 Chlorophyllase
MNLASAVRVFLSYYLLVQRWMGSEQGGGVFDQGGHSVSLTRLDEARAPPRCAVRSSPSSAASLPPKPLLVAAPRETGEYPVILFLHGYLAVNSFYSQLFEHAPSHGFIVVGPQLYTISGADTTEEINSAAAVINWLATGLPSTLPLGVRANLNQVSISGHNRRRERWRFAAGVGPTPRPRLAVPSPPPLFALGPRWNRIGPWAKPNTRPPKPSRGLATGSDCTWGWPPPHGSIRTRGPSDQDWPPWGLNCFPGRVWSPRGGRQFHRAGPF

SEQ ID NO: 80185 - DNA, 927 bp, Zea mays
  misc_feature: Ceres CLONE 1565413
  misc_feature: Encodes the peptide sequence at SEQ ID NO. 80186
  misc_feature (419)..(419): n is a, c, t, g, unknown, or other
ctccccgcggtggcggccgctctagaactagtggatcccccgggctgcaggaattcgtctcacccctagaaaaatctcaattctcaccacacacacgcacacacactatcgtccagcaagctcgctgttgcttgccacccaccgcctcagctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgcccctgcctgtgctgcgtgtccgtcgccgccgccgacttcgcgccaccgagcagcaaaggccagttcaagagcagatggacgagggtggtggacaggaaactccctccccctactgcnggcattcgacgggaagcagaagaagaccctgggaagagatgggaccaggaattccctgccaagcccctccagggcctttctactaatgacccagtaagggccatcatggtcccaaacgaagggaatttccaaccaccctccaaggagggagcttccatggtggggaaggggggaaaccaacccgtccctccatggcctttaaaccgaaaaatttaagcccaaaagccctttttgggaaaggcctttcccgttggggccctaataccctccccgggcaaccacacaattcattgtgtccggaaaggctgaaaatttccgcggcaaaactgggaaaactttaaatataaaagaacccgaacgggggcgggtggccccttttttgaaaaggaaaagggggcccaccggggggcccgcccccaaaggaaccccccctaaaggggtggaacagggggaaactttggaaaagtgttgaacccaccccccaaaaaggggtcgcccccccccaaag

SEQ ID NO: 80186 - protein, 114 aa, Zea mays
  misc_feature: Ceres CLONE 1565413
  misc_feature (83)..(83): Xaa is any aa, unknown, or other
MASEVWLSPASRLPSLSNAPPRLRSKPATTTASLLSPCPRPARAPACAACPSPPPTSRHRAAKASSRADGRGWWTGNSLPLLXAFDGKQKKTLGRDGTRNSLPSPSRAFLLMTQ

SEQ ID NO: 80187 - DNA, 874 bp, Zea mays
  misc_feature: Ceres CLONE 1565414
  misc_feature: Encodes the peptide sequence at SEQ ID NO. 80188
ctccccgcggtggcggccgctctagaactagtggatcccccgggctgcaggaattcgtctcacccctagaaaaaaagttgagaatcaattgctagtacgatttcttctctcctccaaaccggccaagccaccaaccagcgccccccaccgccgcctttttatttcatccacgctgctcgtgctcgctgcctgcttctcgcgcgatcgtctcggcctctcgggattctagagtggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaataagctgtttggtcgtcagaagaccttgcatggagttctgggtggtggaaaacctgctgatgtgctgttatggaggaaacaaaagatatcatcgagtgttctggctcttgcacagctatttggggtttctttgagtggctcgactaccacttactgacaaatggttcatttgcccttggttcttgaatggttgtccagttttgttgggtccaacttctcaaacatgctaagcaggcgatccccggtctcaaggtgccccaaggtgaattggcctgaagagtattttgtgaaaattgccggttggaatcgggggcccaaaaaaacaaagtccccggggcttccctccagggaggtgtccttggggaaaaaaaaattaaaacatttttttaatgggggaaaaccccagaaattgggggcctcccttgcgggtaattggaaaaatggggggcaaatttctccggaagag

SEQ ID NO: 80188 - protein, 94 aa, Zea mays
  misc_feature: Ceres CLONE 1565414
MSERSESATEKIMSSIMDTIADNLPKQKSGKFDPGSVSDKVKNKLFGRQKTLHGVLGGGKPADVLLWRKQKISSSVLALAQLFGVSLSGSTTTY

SEQ ID NO: 80189 - DNA, 882 bp, Zea mays
  misc_feature: Ceres CLONE 1565417
  misc_feature: Encodes the peptide sequence at SEQ ID NO. 80190
  misc_feature (699)..(699): n is a, c, t, g, unknown, or other
ctggagctccccgcggtggcggccgctctagaactagtggatcccccgggctgcaggaattcgtctcacccctagaaaaagaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaaaaagcctacttctggggagcccttgggccgtgggcgtggccgtggtcgtgggcgcggtcgggggtcgggaacgttgagcatgctagctgcttttggaaattgcattgcgtgcatctgcaggggtatcctactttcctatcaatttggacgaagaatgccttttgaattttgcaaaccaggtattcaattgggttttttttggccgggggtttttttaaaaaacggaacatggggggtgggggtgttttcaggcagacggaagaagaggaaggaggagaaaagatgtagggantcttttgtgggggggcccctaaacccccctttttgtaaagaaaccttgtgtccccccccgggggtccccgggagggaaccacccgaaaacatattggggccgtttggggttttccaaaaaaacaaaagttttttttgggggagagccttttttcctccgcccccccgggggttattatggggg

SEQ ID NO: 80190 - protein, 248 aa, Zea mays
  misc_feature: Ceres CLONE 1565417
  misc_feature (5)..(70): Pfam Name: LSM Pfam Description: LSM domain
  misc_feature (187)..(187): Xaa is any aa, unknown, or other
MKLVRFLMKLNNETVTIELKNGTVVHGTITGVDISMNTHLKTVKLTLKGKNPVTLDHLSVRGNNIRYYILPDSLNLETLLVEETPRVKPKKPTSGEPLGRGRGRGRGRGRGSGTLSMLAAFGNCIACICRGILLSYQFGRRMPFEFCKPGIQLGFFWPGVFLKNGTWGVGVFSGRRKKRKEEKRCRXSFVGGPLNPPFCKETLCPPPGVPGREPPENILGPFGVFQKNKSFFWGRAFFPPPPRGLLWG

SEQ ID NO: 80191 - DNA, 815 bp, Zea mays
  misc_feature: Ceres CLONE 1565418
  misc_feature: Translation starting site: 308
  misc_feature (620)..(620): n is a, c, t, g, unknown, or other
ctccccgcggtggcggccgctctagaactagtggatcccccgggctgcaggaattcgtctcacccctagaaaaagcgtctcctccttccaactccacgcgcttcaatcccacaaccgcgtcgccgttccgatcccccctttctcttccatataaaaaaccctcaccaggtccatcgattgaaacccaatccagaccccatccatcgattggaacccagatccgcaggccgcagcacaagagggtgggatcggatcggatcggagcagagcaaaggggacaaccgaccagaatccgccggcgaccaccatgggctccgcgagccgtgccgtctcgtgcctgtgctgcccctgcaagtgcctggcgtgcgggctcctgagctgcctgtgcagcatcctcgtctcgctcgccgtcgtcctgggcgtcgtcgccctcatcctctacttcatcttcaagccgcacatgatcgcggccaccgtggactcggcctcgctctcccagttcgcgctgtcggcgtcctccacgctcgcctacgaactcaacgtcaccatgacggtgcgcatcccaacacgcgggtggggctctactacgacgacgtccaggcgctggccctggtcagcgnacagcgcttcggctacgccccgctcgacgccttctacagggtcaccagggcgtcacccagctcagccccgggtcccgggcacgcagctcttcaaggcgacgtcaccgccgccgagtcaggcaggaacagcccggggggactccgccgtcaagtcgactcaacgcaaactcaagtgaaaggcggggcgtcaaggct

SEQ ID NO: 80192 - DNA, 856 bp, Zea mays
  misc_feature: Ceres CLONE 1565421
  misc_feature: Encodes the peptide sequence at SEQ ID NO. 80193
ctccccgcggtggcggccgctctagaactagtggatcccccgggctgcaggaattcgtctcacccctagaaaaaagagcacgagacacccaagaaacacacagaagcgaggagcactacttgttggttggattctcttcagtctagcagctagtccagttaagtttcagacacatggggagcattggcagaggcacggccaactgcgccaccgtgccgcagccgccgccgtcgacagggaagctcatcacgatcctgagcatcgatggcggcggcatccgcggccttatcccggcgaccatcattgcgtacctcgaggccaagctccaggagctggacggcccggacgctcggatcgccgactacttcgatgtgattgccgggacgagcaccggccccctgctcgcgtcgatgctggcggcgccggacgagaacaaccggccgctgttccgcgcccaagacctcaccacgttctacctcgagaacggccccaagatcttcccacagaaaaaagctgggttgctgacgccccctaaagaacctgctgggccttggggcggggccccaagtacgacgggggtgttccctgcccgaacagatcaaaaacctggacccacgaagttcggggtggcgggacacgggggacaaaacgttatccgtgccggccttttccaaattcaaagtcccctgcaagccccatcattttttctttgaacggtgcaagggcccaaaaacccacaaccccctcaagaaaaagggggcacccttttccgagaaattttggcatttaaaaccacgtttgggggggggcccccaaccctttattttccccgggagcgcaaatttttttttaaaag

SEQ ID NO: 80193 - protein, 179 aa, Zea mays
  misc_feature: Ceres CLONE 1565421
  misc_feature (28)..(178): Pfam Name: Patatin Pfam Description: Patatin-like phospholipase
  misc_feature: SWISSPROT Homolog: EC 3.1.1.5 Lysophospholipase
MGSIGRGTANCATVPQPPPSTGKLITILSIDGGGIRGLIPATIIAYLEAKLQELDGPDARIADYFDVIAGTSTGPLLASMLAAPDENNRPLFRAQDLTTFYLENGPKIFPQKKAGLLTPPKEPAGPWGGAPSTTGVFPARTDQKPGPTKFGVAGHGGQNVIRAGLFQIQSPLQAPSFFL

SEQ ID NO: 80194 - DNA, 861 bp, Zea mays
  misc_feature: Ceres CLONE 1565425
  misc_feature: Encodes the peptide sequence at SEQ ID NO. 80195
ctccccgcggtggcggccgctctagaactagtggatcccccgggctgcaggaattcgtctcacccctagaaaaaatcatatgctcgtgtttcggttcgttccgttccttcctcccgcttgtagctagccttcctgttctgcttggcgcggatacatgggtgcctccgccacaccggtcgggacggtgagggatctgcttctgctgctgctagcgccgatctgcgctggggcagactggatgtcgatcgtcacataccgcgaggggagcgaggacgaggcgcggcggatgtacgccgagtggatggcggcacacggccggacctacaacgccatcggcaaggaggagcgcaggttcaaggtgttacgggactacctccgctacgtcgacgcccacaacgccgccgccgacgcgggcgtcacctccttccgcctatgggtcaaccgcttcgccgacctcagctacgagcgagtccgcggcaactacctcggcgtctggatgaggccgcacaagcagaggaggctcggctgacgagtacctggccggcgacgtccaagacctgcccgactccgtctagtgacgggcccatggcggccctcgctgatattaaggaccagtgcaccttaccggaaggtgctggggctttctcaacaataacggggtgtggcaagctgtctccccatattgttacgtgggaaacctgatccccctgggctgaataaggtaaccttgtttgactggggacaacttcttaacaacacgggggttggaaaaggaaaggtctagaaggaacccagggcatcttcaatttacctccaacagaccaatgggcggggaatctgggccccgggggcaaggatata

SEQ ID NO: 80195 - protein, 124 aa, Zea mays
  misc_feature: Ceres CLONE 1565425
  misc_feature (46)..(106): Pfam Name: Inhibitor_I29 Pfam Description: Cathepsin propeptide inhibitor domain (I29)
  misc_feature: SWISSPROT Homolog: EC 3.4.22.14 Actinidain
MGASATPVGTVRDLLLLLLAPICAGADWMSIVTYREGSEDEARRMYAEWMAAHGRTYNAIGKEERRFKVLRDYLRYVDAHNAAADAGVTSFRLWVNRFADLSYERVRGNYLGVWMRPHKQRRLG

SEQ ID NO: 80196 - DNA, 815 bp, Zea mays
  misc_feature: Ceres CLONE 1565432
  misc_feature: Encodes the peptide sequence at SEQ ID NO. 80197
  misc_feature (480)..(480): n is a, c, t, g, unknown, or other
  misc_feature (723)..(723): n is a, c, t, g, unknown, or other
  misc_feature (724)..(724): n is a, c, t, g, unknown, or other
  misc_feature (749)..(749): n is a, c, t, g, unknown, or other
  misc_feature (750)..(750): n is a, c, t, g, unknown, or other
  misc_feature (782)..(782): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaatcactaggctgcaaccatcgctcatcggccatctaagcccctcctcctcctctcgagtctcctccccctgccctctaggcgaacgcgcggtggcgccatggacattaggctgctggtatccgccgacgccaacctcgccgccgctctgtcgcgctcccgctcttccaagtccgcgttccagcgccaggttgtcccgggcagccgggcgtcgtcgtgcaggtccgtccgcgcgcgctccgccgcagccgccgcgccggccgcgggaggcatctccgggcatagcaattacacggttggtgacttcatgacaacaagggacaatctccatgttgtccaacctactacaccagttgaccaagccctggagctgctggtgcaacacaggatctctggcttccctgtggntgacgatgactggaacttggttggggttgtatcagattatgatctcctagctttggattcgatgtcaagaaaatgatttggccgatacaagtacaaacatgtttccctgatgtggaatgagcacatgggaagaaaattcccccgaagccttccgagagataattttaaagccaaaaaccttttttgggggagaagggggcccccccgcggcggggggtgaataaaaaaaaaaaaaaaaaaaannccccccccccccctcctctctcccnnggtgtggggggggtggggggggggggggtggngngccaaataaatataaatataattttaggttt

SEQ ID NO: 80197 - protein, 127 aa, Zea mays
  misc_feature: Ceres CLONE 1565432
  misc_feature: SWISSPROT Homolog: EC 1.1.1.205 IMP dehydrogenase
  misc_feature (103)..(103): Xaa is any aa, unknown, or other
MDIRLLVSADANLAAALSRSRSSKSAFQRQVVPGSRASSCRSVRARSAAAAAPAAGGISGHSNYTVGDFMTTRDNLHVVQPTTPVDQALELLVQHRISGFPVXDDDWNLVGVVSDYDLLALDSMSRK

SEQ ID NO: 80198 - DNA, 844 bp, Zea mays
  misc_feature: Ceres CLONE 1565433
  misc_feature: Encodes the peptide sequence at SEQ ID NO. 80199
  misc_feature (520)..(520): n is a, c, t, g, unknown, or other
ctccccgcggtggcggccgctctagaactagtggatcccccgggctgcaggaattcgtctcacccctagaaaaaaccgtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccatcggtgtcttcactgacaaggacaaggctgctgcacatctgaaggatggtgccnagaaggttgtatctctgccccagcaagatgcgcccatgtttggtgttggtgtcaatgaggacaagtacacctccgaatgtaacattgtttcaaatgctagcctgcacacaaactggccttgctccccctggctaagggcattcaagaaaaactttgggatttattgaagggcttgaggaaaactgtttctgggcctcccgggccaaccaaaaaaaaacggttagtgggcccccccaccccaaggacctggaaaaggtgggcaggggctcccccctttttaaaaattttttcccacaaaaaaccccggtgtgttcccaaggggtg

SEQ ID NO: 80199 - protein, 173 aa, Zea mays
  misc_feature: Ceres CLONE 1565433
  misc_feature (4)..(153): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (119)..(119): Xaa is any aa, unknown, or other
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESIGVFTDKDKAAAHLKDGAXKVVSLPQQDAPMFGVGVNEDKYTSECNIVSNASLHTNWPCSPWLRAFKKNFGIY

SEQ ID NO: 80200 - DNA, 892 bp, Zea mays
  misc_feature: Ceres CLONE 1565434
  misc_feature: Translation starting site: 128
  misc_feature: SWISSPROT Homolog: EC 3.2.1.14 Chitinase
  misc_feature (95)..(95): n is a, c, t, g, unknown, or other
  misc_feature (100)..(100): n is a, c, t, g, unknown, or other
  misc_feature (104)..(104): n is a, c, t, g, unknown, or other
  misc_feature (892)..(892): n is a, c, t, g, unknown, or other
atggagctccacgcggtggcggccgctctagaactagtggatcccccgggctgcaggaattcgtctcacccctagaaaaaaaacgcaccgcccanactanacancgccagcttctctaaagatcacaatgatgagagccctggcggtggtggccatgctggccaccgccttcttcgctgtgcccgctcgcgccgagcagtgcgggtcgcaggccggcggcgcgctgtgccccaactgcctgtgctgcagccagttcgggtggtgcggcagcacctccgactactgcggcagcgggtgccagagccagtgcagcggcagctgcggcagcaccccgaacccgccgagcagcggcggcgtggcgtccatcatccccgagtcgctcttcaaccagatgctgctgggcctgcacccactcggcgtgccccgccaacggcttctacacctacgcgggcttcatcgcggcggccaacgcgttcccgggcttcggcaccacgggtgcgcccaacgtgcataagcgcgagctggcgggcgttcctgagccagaagtcccacgatactaccggcgggtggggcgaacggcaaccgaacgggccctaaccccggggggctactggcttcaagggaggaaccagggcggccccttccagggcccggaatactcgctacccccagcccccagtgggaccgtgcgccctccgggaaagaaaatactacggttccgtggggccccttccaaaattttcctatagattttatattttcgggacccccaagtccagagaccatcggggaccaggaattcctcgcccaaccatggaaattatgggggcccacgaaccccccccctggttattcttcgatacccacctctctctaggtctagagcaaaacn

SEQ ID NO: 80201 - DNA, 856 bp, Zea mays
  misc_feature: Ceres CLONE 1565437
  misc_feature: Encodes the peptide sequence at SEQ ID NO. 80202
ctggagctcaccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgaaggtggactggactacctcgggaacccgagcctcatccacgcgcagagcatcctcgccatctgggcctgccagggcgtgctcctgggcgccgttcgagggctaacgcatccgcggggggcccgctcggggaaggtcgtcgaaccgcttctatcccgggggcaggctttcaacccggttcgggctccgccgaaaaacccccaaggcccttccctggaaccccaaggggaaaggaagcccaaaaaacggcccgccttgccccttggttcccccagggttcgggaaatat

SEQ ID NO: 80202 - protein, 236 aa, Zea mays
  misc_feature: Ceres CLONE 1565437
  misc_feature (65)..(197): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQGVLLGAVRGLTHPRGARSGKVVEPLLSRGQAFNPVRAPPKNPQGPSLEPQGERKPKKRPALPLGSPRVREI

SEQ ID NO: 80203 - DNA, 973 bp, Zea mays
  misc_feature: Ceres CLONE 1565439
  misc_feature: Encodes the peptide sequence at SEQ ID NO. 80204
acccgcggtggcggccgctctagaactagtggatcccccgggctgcaggaattcgtctcacccctagaaaaaacaccgatcctcccagctgcatctgcattgcattgcatgcacaggtcgcgcccaccatcagtagcggtcgccgccatgcagagactcgtgcgcgtcctcgtggtgctgggcgtggccgccgcggcgtcggcgcaaggcccgacggcggcgccaacgacgcccacgcccacgccggcaacccccgcggcgcccgcgcccacgacggcgtccagcaacatcacgggcgtgctggccaaggccgggcagttcaacaccttcatccggctgctcaagtccacgggcgtggcgtcgcagatcgacaaccaggtcgccaacggggtgcaccccccccaacggtgttcgcgcccacggaacaacgcgtttcagttcgctgccctcggggcacagctcaactccgctgtcggaacaggacaaaaaacgccgctgggtgcagtacccacgtgggtggcccgcccgcccttccccatggtcgcaaggtcagaaacccggtaggaaaaccccgttccacataggcaagggccgggaaaacgccctccgccggggggggaaattccccacaaaaaagggtaccctccccccccaaggggcccagcagagtgttaaacgtgcacccaaggggggtgttttttaccccgaccccccgtgtgaaaaaaatcccccttcttaaccccgggggagaaaaacccctcttggtttttttatcaaaggtcaaagaaggggggggtgcgctcgcaccccaataagaagaatttttctggggggccgaccaggatatattctcctctccggccctcctaaggacgagttattgggcggggcgggtttataatatagagaggcgtcgaagaaatctctcgcgggggagggatctcttcctcaaaatatttctcggccgagaggg

SEQ ID NO: 80204 - protein, 138 aa, Zea mays
  misc_feature: Ceres CLONE 1565439
MQRLVRVLVVLGVAAAASAQGPTAAPTTPTPTPATPAAPAPTTASSNITGVLAKAGQFNTFIRLLKSTGVASQIDNQVANGVHPPQRCSRPRNNAFQFAALGAQLNSAVGTGQKTPLGAVPTWVARPPFPMVARSETR

SEQ ID NO: 80205 - DNA, 820 bp, Zea mays
  misc_feature: Ceres CLONE 1565440
  misc_feature: Encodes the peptide sequence at SEQ ID NO. 80206
  misc_feature (662)..(662): n is a, c, t, g, unknown, or other
ctccccgcggtggcggccgctctagaactagtggatcccccgggctgcaggaattcgtctcacccctagaaaaaaggaagagagagagagagagagagatcagcaacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcggtgctgccacgctgccggacctcgtggccgcgctgtccctgccagcggccaagctcccgttcctcgggcgcgtgatgcggctgctggtcacgtcgggcgtcttcgcgtcgtcgtccgagtccggcgacgtctaccggctgaacccgctgtcctggctgctggtggagggcgtggagtcggaggaccacacctaccagaagtacttcgtgctgggcaccgtctcccgccactacgtggaggccggcatgtccctggccgactggtttcagaaggaggaggacgaggaccgccagctgccgtcgccgttcgaggccctgcacggggtgcccctcgtccacgagagcaccaagctgctggacgaagagctggacagggtcgtggaagaaagcgtggccgcncacgacaacctgggcatcgggaccgtcatacgggagtgcggcgccgacgtcttcagcggcctccgctcgctcacctactgctgcggcaaggcagggaacgccagcgcgggcgccatcgtcaagggcttccagaacatcagtgcaccgtgctcaacctt

SEQ ID NO: 80206 - protein, 233 aa, Zea mays
  misc_feature: Ceres CLONE 1565440
  misc_feature (30)..(78): Pfam Name: Dimerisation Pfam Description: Dimerisation domain
  misc_feature: SWISSPROT Homolog: EC 2.1.1.146 (Iso)eugenol O-methyltransferase
MATAIVPTDAELLQAQADLWRHSLYYLTSMALKCAVELHIPTAIHNLGGAATLPDLVAALSLPAAKLPFLGRVMRLLVTSGVFASSSESGDVYRLNPLSWLLVEGVESEDHTYQKYFVLGTVSRHYVEAGMSLADWFQKEEDEDRQLPSPFEALHGVPLVHESTKLLDEELDRVVEESVAAHDNLGIGTVIRECGADVFSGLRSLTYCCGKAGNASAGAIVKGFQNISAPCST

SEQ ID NO: 80207 - DNA, 845 bp, Zea mays
  misc_feature: Ceres CLONE 1565441
  misc_feature (398)..(398): n is a, c, t, g, unknown, or other
tccccgcggtggcggccgctctagaactagtggatcccccgggctgcaggaattcgtctcacccctagaaaaaacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggcacaccngcgggctggaccacagcatccccgccgccacccacgggcagttcctccccgggcgcgacgacaccctgggtgcccaaccccggcttcgaggcccccaaccctttcatgcccggggcgggcactccctggaacacgtacccccgcctggggaaggggggctccccgggcaattggattcgtaaaaccccccccccccccccggaaaaaaaaaaacctcctggctaccccacggcctggctaacaaatggcgaactttacctttaactaacccggggttgccccggctaaagtaaccaacatgtcttccgggaggagcccgtcccccggtctccccttttaagccccccgggcccttttacgccccccgggaaatttcccccaaaaggggggccccccccaaatccttaaaaaaaattttttttgggcccagtatattttttttttaaa

SEQ ID NO: 80208 - DNA, 829 bp, Zea mays
  misc_feature: Ceres CLONE 1565444
  misc_feature: Translation starting site: 108
  misc_feature (542)..(542): n is a, c, t, g, unknown, or other
  misc_feature (587)..(587): n is a, c, t, g, unknown, or other
  misc_feature (669)..(669): n is a, c, t, g, unknown, or other
  misc_feature (673)..(673): n is a, c, t, g, unknown, or other
  misc_feature (685)..(685): n is a, c, t, g, unknown, or other
  misc_feature (782)..(782): n is a, c, t, g, unknown, or other
ctccccgcggtggcggccgctctagaactagtggatcccccgggctgcaggaattcgtctcacccctagaaaaataagccgcgcccgcctccgcacgccccgctccgatggcagccgcggctgtgaccctgccctcctcgggcacgcccttcgccgtcgccacaaccgcctcttcctcatccgcccgccgctgcctgctcctgccctccgcggctccccgccgagctctccgcgtcgtggcctccgccgctaccgaggcgccgcccaagcccacgcagccgccgacatcgccctccggcatcgtgctcgtcgacccatccgaagcccagaaggtgcaccggctcaaggccgtctacgaccagaaggtcgtcccgctcatcaccgaggagttcggctacaccaatgtccaccaggttcccaagctcgagaagattgtggtgaactgcggtctgggcgcggaggcagggaactcgaaggggctggatgccgccatgaaggacctggccatgatcaccgggcagtggcccgtcaagaccaagggncagaaagtcgtggccagcttcaagatccgtgagggaaacacatcngtatcgcagtcaccctccgcggcaggataatgtacaacttcctggataggctcatcaaccttgggctccctaggaccatggnactnctgggtgtcaancccaacagcttcgacgggcaacgcaactacagccttggcctccgtgaacagggcgtggtcccggagatcccgtacaaggtgggcgggaagaagaacngcatggacgtgtccatcgtcaccagcgcaagacggacaacgagcgtt

SEQ ID NO: 80209 - DNA, 851 bp, Zea mays
  misc_feature: Ceres CLONE 1565446
  misc_feature: Encodes the peptide sequence at SEQ ID NO. 80210
ctccccgcggtggcggccgctctagaactagtggatcccccgggctgcaggaattcgtctcacccctagaaaaactctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgtcccctgggtcattcttggacactctgaaaggagagctctgctgggagaatcaaatgaatttgttggaaacaaagtggcgtatggcctgttcagggactaaggtcattgcatgtgttgtgaaaaaccttgaccaaagggaggctgggctaccagggatggtgttgctgccaaaaaaaacaattgctgaaaaaatcaaggctgggccaacttgtttgtgcctataaacctgttgggcttttggaacggaaaaattccccccccccctagggctagaaaagccccccccccgaggggattggttaaaaaaaatggccccccccgaggggtcgtaaattccaagggaacctcccggagaggcttttatacctcgggccaactcaaaaaagtccccccccccccctcggggggggggggttttctttgggggaggagcttttttgaaaagcgaagattaa

SEQ ID NO: 80210 - protein, 121 aa, Zea mays
  misc_feature: Ceres CLONE 1565446
  misc_feature (5)..(121): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGNKVAYGLFRD

SEQ ID NO: 80211 - DNA, 868 bp, Zea mays
  misc_feature: Ceres CLONE 1565449
  misc_feature: Encodes the peptide sequence at SEQ ID NO. 80212
ctggagctccccgcggtggcggccgctctagaactagtggatcccccgggctgcaggaattcgtctcacccctagaaaaagtcctcgcgctctcccggtctcctctcccccgagcatcccaaaaaatactcggccactgcgctatctcgcccaccaagccagcaccagcagcggcgcgcgatggccaccgcgccctacgcctcctccctcttcctggcttcctcccccatctccaccgcgccacgaatccgcgccgggccctgccctccgtccgcccagccatccctgcggctccggccgaggccgtccccggcagccgcggccgccgtccaggcggagcaccagcccgcgttgaccgcggcgccgaagccacccgcgctaccgttccgcgtgggccacggcttcgacctccaccgcctggagcccgacctcccgctcatcatcggcggcatcaacatcccccacgaccgcggctgcgaagctcactctgacggcgacatgctgctgcactgcgtgggggacgcgattctcggcgccgctggggtgccagacatcggccagattttcccggactccgacccccgttggaagggcgccaattcttcgggggtcatgagggaagctgttaaattgatgcattaagccaggcacacagctgggccaaccttgaagcctacgcgggattttggcaaaaaccaaaaaaatagcccatttaaaggagacccatccgaattcaaaatttgtggcaaccctacttgggggaggaattcccccctggggggccaaatcctcaagggcccaagaacgcccccaaaaaaatttggacagctcccagggggggaagaaaacgggaggccattgtcactcg

SEQ ID NO: 80212 - protein, 153 aa, Zea mays
  misc_feature: Ceres CLONE 1565449
  misc_feature (69)..(154): Pfam Name: YgbB Pfam Description: YgbB family
  misc_feature: SWISSPROT Homolog: EC 4.6.1.12 2-C-methyl-D-erythritol 2,4-cyclodiphosphate synthase
MATAPYASSLFLASSPISTAPRIRAGPCPPSAQPSLRLRPRPSPAAAAAVQAEHQPALTAAPKPPALPFRVGHGFDLHRLEPDLPLIIGGINIPHDRGCEAHSDGDMLLHCVGDAILGAAGVPDIGQIFPDSDPRWKGANSSGVMREAVKLMH

SEQ ID NO: 80213 - DNA, 742 bp, Zea mays
  misc_feature: Ceres CLONE 1565453
  misc_feature: Encodes the peptide sequence at SEQ ID NO. 80214
  misc_feature (503)..(503): n is a, c, t, g, unknown, or other
  misc_feature (532)..(532): n is a, c, t, g, unknown, or other
ctccccgcggtggcggccgctctagaactagtggatcccccgggctgcaggaattcgtctcacccctagaaaaaataggctctcgcctcggcttggcagtgggcactccctctccaccgcgctgcaggggcgacgcgaggccgagcgctcctcgatccatatcctaggttaggagatggctctcacgagaattggcctcgccggcctcgcggtcatgggacagaaccttgccctcaacatcgcggagaatgggttccccatctcggtctacaacaggacgacctccaaggttgatgagaccgtgcagcgtgcctaggtcgaacgaaacctccccgtgtttggtgtccacgacctcgcgtccttcgagagctccgtccagaagccacgtgtcgtcatcatgctcgtctacgtctggtgcgactgtggaccagatcattgccacgctcgcggcacatcttgatcaggaggactgtgtcttctatggtggcatcgtttggatgacntacccgaaaagaaggaaaagcgcaattgnagaccccctgcctcctgatctagccatgagggttcctccgttgaacaagaaagtagccccgcaattgcgccggtcattggaccccggggggcctcctttggggtaatcaagttccccgaaaattcccctttcccgggggggccgtttcagggtccccggcaaacgggaccctggggttttttttggattgggccaaaaggggaaccaggg

SEQ ID NO: 80214 - protein, 46 aa, Zea mays
  misc_feature: Ceres CLONE 1565453
  misc_feature: SWISSPROT Homolog: EC 1.1.1.44 Phosphogluconate dehydrogenase (decarboxylating)
MALTRIGLAGLAVMGQNLALNIAENGFPISVYNRTTSKVDETVQRA

SEQ ID NO: 80215 - DNA, 848 bp, Zea mays
  misc_feature: Ceres CLONE 1565455
  misc_feature: Encodes the peptide sequence at SEQ ID NO. 80216
ggagctccccgcggtggcggccgctctagaactagtggatcccccgggctgcaggaattcgtctcacccctagaaaaagtagttgctgcaaagctctcgcaaaatcctactcccaccgccgactcgaacagtcgaacctcggctcccctcctccccaatccgtcatcttccttctacacttgtttctgcgggagcgggagagaaggcaccagggaggccgcccccgtcacccatagccaaagtcacgcgccaccaaactttgttctctcacccagtcgctttcgcgttcagcgcgagccgagcccagccggtgggtcggtcgctgaaggcggagccataaaggcgtcggcgacggcaggatgatgagcggcagatcgggcggcagggacggcgaggcggccggccccgtcatcaggatcagggtttcccacggagccaccttccgcgaggtcgtcgtgccggcgcaagctaccttcggtgagttgaagaggatccttgttcagactactggcttggagcctgagaggcagaggctcttcttccgtgggaaggagaagagtgacagagagttcctccacgcggcaggtgttaaggatggcgcgaagttgcttctgcttgaaaagccttcccctgccaacatagagcagaaagttgagcctgtgattatgggatgagagcgtggtgaaagcatggtgaggctggtggctcgtgtttaaagctgaagttgataagctgttctgctaaggtgggtggacttgggaaaaaaaatgtgccttgcaggggagaaaaaagtgaggaaaaaagaaatttggtcgtccttgaccggaaccgcctttatgaatacagca

SEQ ID NO: 80216 - protein, 104 aa, Zea mays
  misc_feature: Ceres CLONE 1565455
MMSGRSGGRDGEAAGPVIRIRVSHGATFREVVVPAQATFGELKRILVQTTGLEPERQRLFFRGKEKSDREFLHAAGVKDGAKLLLLEKPSPANIEQKVEPVIMG

SEQ ID NO: 80217 - DNA, 803 bp, Zea mays
  misc_feature: Ceres CLONE 1565456
ctccccgcggtggcggccgctctagaactagtggatcccccgggctgcaggaattcgtctcacccctagaaaaagacgcaggcaccccagcagctcttgcggtcgtccctcagccgcgtcgcaccgcatcgcattctacgattcgaagctctctgctcgcaggggaccatggcgaagactaccaaccgtgagcgcgagtacagcgagccgtcgagaaggccagcgcagctccgcgccctcatcgcgagagagctgcgcaccctcatgctccgctcgcgtggactccgcggggacttccgacgtgtctcaaggaccgcggtcccctccggactatgaaggcccgggggactggttccgggggccacccggggcttggaatcccggggggggtggtccagccccttaagggaggattccccccccccttcccttggcaaatttttcccaatttttgccggaatttgggcccccccaaggggccccccggggggggccctaaaaaacccccttccccccccccgggggggggggggaaaaaaacctttttcgcgccccccccttgaggggcgggcgctttttcgttggggcccccccccgggggggtttttcaacccccccgggggaggggaattttttttttgggaaaaaaaaaaaaggggggttttttttgtttttttgagaaaaacctttttttcccccccccccccggggggggggcggcccccccccctggggggaggggggggggcccccacaaaaaaaaaggggcgggggggtttttttattaagggggggccccccct

SEQ ID NO: 80218 - DNA, 979 bp, Zea mays
  misc_feature: Ceres CLONE 1565457
  misc_feature: Encodes the peptide sequence at SEQ ID NO. 80219
aaagctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgcccagctacctgaccggcgagttccccgggcgactacggctgggacacctccccccctgtcggcggacccgggagactttcgccaaaaaccgggaagctgggaggtgatccactccccgctggggccatgctggggcgcgcttcggcctgcttcttcccccggagctggctcgccccggcaaccggcgttaaaatttccggcgaagggccgttgtgggtttcaaagggccaggctccccaaaaactttttcaaccgagagggggggaactgggaacctatccctccgcgggaaaccccccgaaggccttcacattccacgcgcagccaagaagacaatccttccgccccattctgggggccctggcccaaagggtccgggccctccatgggggggcgcccgctcccaaggggggtataaccgcattctctccggggggggccccccctttctggggaaaaggtgtgttccaaaccccccttcttattccccggggggggagggtttttcaaacccccgctttgggccttcgcaccgaaaaaaacccccggaggccctttcccccggaaacctctaaggggtgaagagaaaccccaaagaaaaggccccgccccctccccagtttttct

SEQ ID NO: 80219 - protein, 101 aa, Zea mays
  misc_feature: Ceres CLONE 1565457
MASSTMALSSTAFAGKAVNVPSSSAFGEARVTMRKTAGKAKPAAASGSPWYGPDRVLYLGPLSGEPPSYLTGEFPGRLRLGHLPPCRRTRETFAKNREAGR

SEQ ID NO: 80220 - DNA, 786 bp, Zea mays
  misc_feature: Ceres CLONE 1565459
  misc_feature: Encodes the peptide sequence at SEQ ID NO. 80221
  misc_feature (598)..(598): n is a, c, t, g, unknown, or other
  misc_feature (705)..(705): n is a, c, t, g, unknown, or other
  misc_feature (706)..(706): n is a, c, t, g, unknown, or other
ctccccgcggtggcggccgctctagaactagtggatcccccgggctgcaggaattcgtctcacccctagaaaaaacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgagcctaccagcctcgcgccgtacggactctccatctcgccactctccaaggacgcggccatggggctggtggtgagcgctgccacggggagcggctggacgacgggatcggggatggagagcccgccgacggcgagcaaagccggtggggctggcaggccggaggtgtcgacgctgccttggtccctcttcacgaaatcaccgcggcggcgcatgcgggtggccttcacctgcaacgtgtgcgggcagcgtacgaccagggccatcaatcctcatgcctacaccgatggaactgtgtttgttcagtgctgcggttgcaacgtngttccataagttgggtcgacaaccctgaaactgtttcatgagatgaagtgctatgttggcccaagatttcccctacgagggggatgctccattcaactaccttgacnngaacgagggatggcgacagtatcctcccctccctaaagcctaaagcctcccttatgttgccagacttgcagtacccaaaa

SEQ ID NO: 80221 - protein, 168 aa, Zea mays
  misc_feature: Ceres CLONE 1565459
  misc_feature (130)..(167): Pfam Name: zf-DNL Pfam Description: DNL zinc finger
MESVASAAIATTSRSLPLPFSSTPVHRRRRAAFLPVAASKRHDDDKEAAKGSGSEPRREPTSLAPYGLSISPLSKDAAMGLVVSAATGSGWTTGSGMESPPTASKAGGAGRPEVSTLPWSLFTKSPRRRMRVAFTCNVCGQRTTRAINPHAYTDGTVFVQCCGCNVVP

SEQ ID NO: 80222 - DNA, 915 bp, Zea mays
  misc_feature: Ceres CLONE 1565461
  misc_feature: Encodes the peptide sequence at SEQ ID NO. 80223
ctggagctccccgcggtggcggccgctctagaactagtggatcccccgggctgcaggaattcgtctcacccctagaaaaaactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcagcgtcgggcgccgacacggcgtgcggcggcgtgggcgtgctgggcatcgcctgggccttcggcggcatgatcttcgtcctcgtctactgcaccgccggcatctcggggggccacatcaaaccccgccgtcaccttcgggcctcttcctgggcgcgcaaggtctcccctggtggcgcgcggctgctctacaatcggggcgcaattgcctcgggcgccattctgcgggggtcgggcctcgtcaaagggggttcaatgagcgccttactttcgacaggttaccggggggcggggacaaacttcgcttggccttcgttcttattcccggcgggcaacgggccttcgggcgccaaaaattcatcgggcaccctttcggggctccaccttacaaccggtcttttcttcggcccaccggaaccccaaggcggcaagacgcccgccggaacttcccacaggttccccgggtttcatggggctccccccctcccccaattaggggttttcgcgcgcgggggtttctgagggggtgcaa

SEQ ID NO: 80223 - protein, 244 aa, Zea mays
  misc_feature: Ceres CLONE 1565461
  misc_feature (34)..(241): Pfam Name: MIP Pfam Description: Major intrinsic protein
MGKDDVIESGAGGGEFAAKDYTDPPPAPLIDAAELGSWSLYRAVIAEFIATLLFLYITVATVIGYKHQTDASASGADTACGGVGVLGIAWAFGGMIFVLVYCTAGISGGHIKPRRHLRASSWARKVSPGGARLLYNRGAIASGAILRGSGLVKGGSMSALLSTGYRGAGTNFAWPSFLFPAGNGPSGAKNSSGTLSGLHLTTGLFFGPPEPQGGKTPAGTSHRFPGFHGAPPLPQLGVFARGGF

SEQ ID NO: 80224 - DNA, 897 bp, Zea mays
  misc_feature: Ceres CLONE 1565462
  misc_feature: Encodes the peptide sequence at SEQ ID NO. 80225
  misc_feature (152)..(152): n is a, c, t, g, unknown, or other
  misc_feature (705)..(705): n is a, c, t, g, unknown, or other
tggagctccccgcggtggcggccgctctagaactagtggatcccccgggctgcaggaattcgtctcacccctagaaaaaaatccgccagaaccctctccctccctccctccctccctccctcactcatcggcgcgccgccaatggccgtgtnggtgaagcgcacccgacggaagaagcaggcaccaacagccaagccccctttgccctcgccctcgccgccgccgtccgcggaaggttgagatcccaggattcagactggtgccattcgatttgatttggcgcggggtactttcctatggccgcctccatcgcgggcctcgccctttcttttccaaggatcggcccggcgcccgggccgcctcccctaaagaaccggccctttgggggggaagcggcccccagaagaaagcccctgggaaaacgtttcccgcccggcccccttttgcccgggcccaaaaaaccccgggggaaagacccccttcccgctccctaaaaaatgggcccccctttttataaaggggggccccggggggaacaaaaaaaaaaaaagagggcgcggagggggcgccccaccacaaaaaacacgccttttgtgggccccccgggtttcctcccccccccccacaaaagggggggggggagaaaaaaaaaaggggggggggggtggggccacaaaaaaaattcttcctttcctccccacctcntattgggggggcccgcggaaataaattttttgttggggagaaacaccccccgccctagaaagacaacccaccccatataaaaaccggggtggtgggggcgccccttttttctgttatagggggggggggggccccccacaagggggaaaaaatttttttttcttctttttaaaaagaacacccgagagtgca

SEQ ID NO: 80225 - protein, 32 aa, Zea mays
  misc_feature: Ceres CLONE 1565462
  misc_feature (4)..(4): Xaa is any aa, unknown, or other
MAVXVKRTRRKKQAPTAKPPLPSPSPPPSAEG

SEQ ID NO: 80226 - DNA, 1005 bp, Zea mays
  misc_feature: Ceres CLONE 1565463
  misc_feature (416)..(416): n is a, c, t, g, unknown, or other
gagctccccgcggtggcggccgctctagaactagtggatcccccgggctgcaggaattcgtctcacccctagaaaaaaaagaactcctttcttctacgcggacggattcctctcgtctcgatcagctcgcttcgtgacttctctctcctctcgatcgattgcttcctccaccgaggcgggggaaagcgccgcccagatcgccgtaggcaagcggcgatcactccagctctgagcataagtttctgcagggaggctcgtgaagtcagtagtcgtatctggcagtggcagcacagcgcaccatggaatggctgagctggagaacggtgtgttgtttatcagtgctgtgccccgtgctgttcttgcgcccgggtcaagggaattcgcttcgtgatccccccccgtgggacgcttctcanattaacgtggagtttggaggggggataccggtccctggtttcctttcgtcctccattcaagggctgacaccccccgtggggcttttccgcgccaaaaaagggcgttggatcctttgtggggttaaagggattcccttaatgtggcggcctcacaggtccccgtgtgatttcctcgggagaataaaggagaacatctttggacaaagaggttttggagagtgttcattagggtctctcagaaaaataaggagggtggtgtcccacatctggcctgttctggtccttatgcaacgaaatataaatattccccccggttccccggcgagagacctctttatgaaacctttcccaacctgtggcctctgttttgggcccccattttagtttttataacctgttggcggagtgagcctttggcccaataagatggagagccatttgttggcccaccccttcttgttgggggcagacatgatgtccaagttttggtatagaagaggcccctttgtaaacatttaccccccgttttggacaacagcccctcggggcgtaaggggcgcccaaaattgtacgcgctacaaggagtata

SEQ ID NO: 80227 - DNA, 819 bp, Zea mays
  misc_feature: Ceres CLONE 1565464
  misc_feature: Encodes the peptide sequence at SEQ ID NO. 80228
ctccccgcggtggcggccgctctagaactagtggatcccccgggctgcaggaattcgtctcacccctagaaaaaatagaacttgcaaattcgatattgagaatttgcgatacccgataccgatctaggagaagagaaaggcgtcatgtcgtcgttcggacgcaattcatggtgtatcctcgtgctggcctccgtgctcctcctgtcctgcctcgccgagacggccgtggccaaccgaacaggcgagctcaccgtcttctggggccggaacaaggaggagggcaccctgcgtgaggcctgcgacacaggactctacaacaccgtcatcatctccttctacagcgtcttcggccacggccgctacgccctcgacctctccggccacccgctggacggcgtcggcgccgacatcaagcactgccagtcccagggcatcccggtcttcctctccatcggcggcgggggaaaccactactccatcccttcctccgcgtccgcggaggccgtcgcggacaacctgtggaacgcgttcctcggcggcggcaacagcgacgtgccccgccccttcggtgacgcggcggtcaacggcatcgacttctacatcgacgaccacagcgcaccgggcgaccactacgacgagctcgcgcgccgtctcgactacttcaacagcatgtactaccacgccacgacgaagtacgtacggctgacggccgagccgccggtgcgcgttcccgcccgacgaccccatggcgcgggcgctgcggaacggggctgttcgagcgcatccacgtccgcttctacggcgacgccaacagtgctc

SEQ ID NO: 80228 - protein, 225 aa, Zea mays
  misc_feature: Ceres CLONE 1565464
  misc_feature (33)..(206): Pfam Name: Glyco_hydro_18 Pfam Description: Glycosyl hydrolases family 18
  misc_feature: SWISSPROT Homolog: EC 3.2.1.14 Chitinase
MSSFGRNSWCILVLASVLLLSCLAETAVANRTGELTVFWGRNKEEGTLREACDTGLYNTVIISFYSVFGHGRYALDLSGHPLDGVGADIKHCQSQGIPVFLSIGGGGNHYSIPSSASAEAVADNLWNAFLGGGNSDVPRPFGDAAVNGIDFYIDDHSAPGDHYDELARRLDYFNSMYYHATTKYVRLTAEPPVRVPARRPHGAGAAERGCSSASTSASTATPTVL

SEQ ID NO: 80229 - DNA, 807 bp, Zea mays
  misc_feature: Ceres CLONE 1565466
  misc_feature (348)..(348): n is a, c, t, g, unknown, or other
  misc_feature (373)..(373): n is a, c, t, g, unknown, or other
  misc_feature (491)..(491): n is a, c, t, g, unknown, or other
  misc_feature (745)..(745): n is a, c, t, g, unknown, or other
  misc_feature (748)..(748): n is a, c, t, g, unknown, or other
  misc_feature (760)..(760): n is a, c, t, g, unknown, or other
ctccccgcggtggcggccgctctagaactagtggatcccccgggctgcaggaattcgtctcacccctagaaaaaccgtcgagcacacaacacaccctcctcgtcctccaatccaatcaacctggtagactcgcttcgcttctcccccagccgtcggacggagctcctcgcagtcgcagcagccgccgatcagcctgcgctcgggctcagcgctggaaggtgttggaagagaatagcctgaaggttcacagtaaccttcatctgtcggaagatgtatcgggctaagagggctgcattgtcaccgaaggtgaagcgccgcgtcggcaagtacgagtctcgggcgcacctnattggggaaaggggaccttcgcccnaagggtcccgggtttttgcctaaagaaacacctggaaaaaccggggggaaacccgggttggcctttatccaaaaaatccctttgggacaaggggggaaaaaggttttaaaaagaggcnccccaaattttgggtttggagacaaaaaatttataaaggcggggggggaaaaaagtttggtgtttccccccggggagaaaaaattggtgggagggggggggccccccccccaaatggggggtgtttttcgccacccaacccccgtgtttttttttttataagagtgggggtggtcggtagcgtagactccaaaacaattatctcatcctccccccctgcccggggaaagagaattttttttttgtcttttcggnttntggtgttgtgtnctcgcgggtggtctccgatggtgggattgggaggatgggcgttgcgg

SEQ ID NO: 80230 - DNA, 935 bp, Zea mays
  misc_feature: Ceres CLONE 1565467
  misc_feature: Encodes the peptide sequence at SEQ ID NO. 80231
  misc_feature (935)..(935): n is a, c, t, g, unknown, or other
ctccccgcggtggcggccgctctagaactagtggatcccccgggctgcaggaattcgtctcacccctagaaaaatatccgcatccgctgcctccgcctctcgagtctcgtccacccgtcgtcctcctagctcctttactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccacccggcgtcttcactgacaagggacaaggcttgctgcacctctcagggggggtgcccaaaaaaaaggttggttttctcctccccccaacaaaagatgcaccccatgttttggttggttggtggtcaatggagggacaaagtaccccccccggaatggttaaacattgggtttccataggtgctaggcctggcaccaaacaaaactgccccttggcctccccccttggcctaaagggcactttcatggacaaaacctccggggtatttgtgttgaaggggttttgaataaacacaccttgtttcaagggcccttacacggcccacccccaaagaaaattggtttgaacgagcccctccacccaagggaaactggaaaaaagtagcaaagggcttgcaccacttttaaacaaaaattcccaggacatacacgggtgctggccaagggtttgtttgggaaaatctcctccccgaacttgaaagggan

SEQ ID NO: 80231 - protein, 105 aa, Zea mays
  misc_feature: Ceres CLONE 1565467
  misc_feature (4)..(105): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTRRLH

SEQ ID NO: 80232 - DNA, 767 bp, Zea mays
  misc_feature: Ceres CLONE 1565476
  misc_feature: Translation starting site: 205
  misc_feature (312)..(312): n is a, c, t, g, unknown, or other
  misc_feature (337)..(337): n is a, c, t, g, unknown, or other
  misc_feature (340)..(340): n is a, c, t, g, unknown, or other
ctccccgcggtggcggccgctctagaactagtggatcccccgggctgcaggaattcgtctcaccccagaaaaaaggttaaagcgacgccgccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacaagaagctgtgcagcctgctcgatgagtacaccaagtgctcatcgccctggccgacaacgtcnggtccaagcagctccaggacatccngcngggcctcaggggcgactcggtggtgctcatgggggaagaacacgctcatcagggcgttgcatcaaagttgtacccccaagaaaaaccggaacccacaccttttgaccccgctcagtggacctccctgggccgggaaaagttaaggcccttcattctttcccccaaaggggagaaccctccaaggaaaggtgccccccaaaggaaagcttccccaaaagtaaaaagggggggggggggccccccccgcccccggggggtggggggcccgggggttggcccccccacattttaaaaaaattttttttttggggccccccccctttggagaaaaaaaaacgggggggggggggggaaaaaaactcccccccaaaaaaaaaccctttttttttttttttttttaagggggggggggggggtgtattttaat

SEQ ID NO: 80233 - DNA, 832 bp, Zea mays
  misc_feature: Ceres CLONE 1565478
  misc_feature: Translation starting site: 220
  misc_feature (554)..(554): n is a, c, t, g, unknown, or other
  misc_feature (629)..(629): n is a, c, t, g, unknown, or other
ctccccgcggtggcggccgctctagaactagtggatcccccgggctgcaggaattcgtctcacccctagaaaaaaaaaccctcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttttgagaggcatttatgcatatggttttgagaaccatctgcaattcagcagagaggaattgttcccttctgcaaggggcttgatgtcattcagcaagcacaatctggtacaggaaagacagcaaccttctggttctgggatcttgcagcagcttgactatggtctggttgaatgccaggnccctggttcttggctcccacccgtgagcttgcacagcaaattggagaagttatgggcgcacttggtgacctaccngggtgttaaagcccttgcatgcgttgggaggaaacatcggttcgtgaggaccaaagaatccccgccagtgtggtgcctgtttgttggtggtaccccccgggtcggggtgtttggaactggctgcttaaaacggtcccctcccgcctgataaacattcagaatgttgggtccctgaaggaaagcggaaggaaagggccttcctc

SEQ ID NO: 80234 - DNA, 851 bp, Zea mays
  misc_feature: Ceres CLONE 1565479
  misc_feature: Encodes the peptide sequence at SEQ ID NO. 80235
  misc_feature (626)..(626): n is a, c, t, g, unknown, or other
acccgcggtggcggccgctctagaactagtggatcccccgggctgcaggaattcgtctcacccctagaaaaataggccctcaattccactctgcccgagcaagccgaattgtcgcccgaattcgctcgcggggagcacttgctacctcgcgcccgccttctgtcgcgcggattcgttgccgcgcctggagatggacccgatggacatcgtctgcaagtccaaggaggacgtctccctccccaaatcaacaatgtttaagataattaaggagatgcttcctcctgatgtacgagtggcgagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacagacttgatactttggattctccaaagctggacaattcactgggattgagatgacagaggaaaaagctgttgctgagcaacaaaagatgtttgctgaggctcgagcaggaatgataatggaggcccccaaccgaaggagacngaacaagaaccgccccggcaccaaaggcacacccccagtttcggttggtttctgaaacccaaacaaaccgggggaatcttagagggaattggattttccaaaacaaggtttcccctccaaacccaaggggggggggcccccccgacccaaaaaagcccccaagaggggagggggcccctccaaaaaaaggtggggccccccagcccaaatagtcccagagtgttt

SEQ ID NO: 80235 - protein, 115 aa, Zea mays
  misc_feature: Ceres CLONE 1565479
  misc_feature (14)..(79): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
MDPMDIVCKSKEDVSLPKSTMFKIIKEMLPPDVRVARDAQDLLVECCVEFINLLSSESNEVCSREEKKTIAPEHVIKALSDLGFREYIEEVYAAYEQHRLDTLDSPKLDNSLGLR

SEQ ID NO: 80236 - DNA, 1030 bp, Zea mays
  misc_feature: Ceres CLONE 1565480
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (55)..(55): n is a, c, t, g, unknown, or other
  misc_feature (56)..(56): n is a, c, t, g, unknown, or other
  misc_feature (78)..(78): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (100)..(100): n is a, c, t, g, unknown, or other
  misc_feature (101)..(101): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (113)..(113): n is a, c, t, g, unknown, or other
  misc_feature (258)..(258): n is a, c, t, g, unknown, or other
  misc_feature (900)..(900): n is a, c, t, g, unknown, or other
  misc_feature (901)..(901): n is a, c, t, g, unknown, or other
tttttggttgtntnnngnntgtgtgtttaatttttacttcgtgtgtttttttccnngccgaaaataccttagtgagtnctcccctcttagaagnnnnntnngnnnnnnnnntnttaactggagctcaccgcggtggcggccgctctagaactagtggatcccccgggctgcaggaattcgtctcacccctagaaaaggcccacgcaacgcaacgccgccggccacacgcacactgccacacggagctagctagctgcnacgattctctcgccccgccgcccgtttaggcgggtgctgacagtatctagccagcgaggagccgccgttgcttccctagctgcacctccccgcgctgtctgcagggccaatcggtcttcaatcccccggccaaaaaaaaaaaacaaaccccaacaataaaaggtttcggggtgggcccctgtgtttttggggggcccttcttttgtgtttgggggggaaagaggcccttttccccccgaaaaagccccccccccccgggggggggggggggcccccaaaggggggggggccacaaaaaaaaaaacccccccgggggggggaaaaaaaaacgggggggaaaaaaaaaccccccctcccccggagggggtttaataaaaaaaaaaaaaagggggggggggaggggggggccccccccccctatttttttttcccctctttatttttttgtgcaaacaaaaaaaatttcttttttttaaacccaagggagggggagcaacaaacccccttctcaggggtttcctgtggggataccccacaaccaccccccggcgggccctcccctccgtggggggggggagaaaaaaaaaaaggggcgcccccccaacaaattaaaaataactcggggggggggggggggggtgnngttgtgttgtggataacaaaaaaaaaaaaaaaaaaacaccgcctctcctatcaaagaaaaaaaacccccccccccgccccacgaaggtagtattttttctcccaccaacacaataaacgttggggtggc

SEQ ID NO: 80237 - DNA, 816 bp, Zea mays
  misc_feature: Ceres CLONE 1565481
  misc_feature: Translation starting site: 166
  misc_feature: SWISSPROT Homolog: EC 1.2.1.12 Glyceraldehyde-3-phosphate dehydrogenase (phosphorylating)
  misc_feature (502)..(502): n is a, c, t, g, unknown, or other
  misc_feature (571)..(571): n is a, c, t, g, unknown, or other
  misc_feature (755)..(755): n is a, c, t, g, unknown, or other
  misc_feature (757)..(757): n is a, c, t, g, unknown, or other
  misc_feature (759)..(759): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaaccgtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccatcggtgtcttcactgacaaggacaaggctgctgcancatctgaagggtggtgcccaagaaggttgttatctctgccccaagcaaagatgcgcccatgttttgttngttgggtgtcatgaggacaagtacaccctcgatgttgacattgttttccatgctagctgcaccacaaactgccctgctccccttgctaaagtcattcatgacaactttgggcattattgagggcttgatgacaactgttcatgccatcactgccacccagaagactgttgatggaccctcaccnangnactggagaggtggcagggctgccanctttaacatcattcccagcagcaccggtgctg

SEQ ID NO: 80238 - DNA, 762 bp, Zea mays
  misc_feature: Ceres CLONE 1565482
  misc_feature: Encodes the peptide sequence at SEQ ID NO. 80239
  misc_feature (355)..(355): n is a, c, t, g, unknown, or other
  misc_feature (686)..(686): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
tccccgcggtggcggccgctctagaactagtggatcccccgggctgcaggaattcgtctcacccctagaaaaagtgaaacgggaacgcttgcccgtcgctgccccgactggaaccgatcgcctccactgtgcccgacgccgcgcccgattccaccggccgacaacgatgcaaagctccctcgcgcggcctctgcgacctccggtactggccggacgcggcggtagacaggacctgatatccgtgctactgtgccacatctgaggcggcgccaccggtggggacagcgtctagggcgccagcggggccgtacacgtgggagggatccttgaagtgaagaaatccccggtggctgcngcaccgcgctgcgcagagctagaaatacgctgccctgcgggagtccatcctgcgagctcaaccttcaccccccttctgcgtcgaaggcccaaggcccccataattggccaatgtttgaaacgtaagttggagggggcccgcaacccaaggggaaccgctttccccccggtcccccttattgggggcattgggagacccccctgaaacccccgggggggacccgttcccccccccttgggaaaacacccccgtcccaaggggccccccccccccccccccggaaaaccccccgggggttaccccccccataaaaccccccgggcgccttttnccccgctgttgcaaaaaaaacgctgggggggggggggggtttaatatttttaggggnnncccaacaccccacaccc

SEQ ID NO: 80239 - protein, 31 aa, Zea mays
  misc_feature: Ceres CLONE 1565482
MQSSLARPLRPPVLAGRGGRQDLISVLLCHI

SEQ ID NO: 80240 - DNA, 828 bp, Zea mays
  misc_feature: Ceres CLONE 1565484
  misc_feature: Encodes the peptide sequence at SEQ ID NO. 80241
  misc_feature (495)..(495): n is a, c, t, g, unknown, or other
  misc_feature (592)..(592): n is a, c, t, g, unknown, or other
acccgcggtggcggccgctctagaactagtggatcccccgggctgcaggaattcgtctcacccctagaaaaatcatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggnagagggagatcatattgaaggcttttggtgctgaacttgtccttactgacccactcctggggaaatgaaggagctgtcaagaaagcggaagagatancagcaaagacacccaactcgtacatccttcaacaatttgaaaaatcagctaaccccaagattcactatgagactacgggggctgaaatctgggaagctacagcaggaaaaattgctgggccttgtatctggtatcggggacaggaggtaccatcaccgggtactgggcgatacctcagagagcaaaatcctatgtcaaagctctatggtgtggagccagtggaaaagggctgttta

SEQ ID NO: 80241 - protein, 117 aa, Zea mays
  misc_feature: Ceres CLONE 1565484
  misc_feature: SWISSPROT Homolog: EC 2.5.1.47 Cysteine synthase
  misc_feature (107)..(107): Xaa is any aa, unknown, or other
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMXEGDHIEGFWC

SEQ ID NO: 80242 - DNA, 885 bp, Zea mays
  misc_feature: Ceres CLONE 1565486
  misc_feature: Encodes the peptide sequence at SEQ ID NO. 80243
  misc_feature (391)..(391): n is a, c, t, g, unknown, or other
  misc_feature (428)..(428): n is a, c, t, g, unknown, or other
ctccccgcggtggcggccgctctagaactagtggatcccccgggctgcaggaattcgtctcacccctagaaaaaccggtcttccccatcccctcttccctttctagccttccacccttcatccacccgccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcacanaaggcagttgaaaggctcgatgggagattggtagacngggagggagatcatgggtgcagtttgccaagtacggcccaaaatgctggaacgggataaataaagggagaataagtggagccagttccaagaccaggggggggcgtttcccaggagtcacagtccaagaacggaaggtaccgtggatgatttatcggagatgacccttggattgagaattattgaaaggggaaatccctaaccccggagtaaaaaatagaataccccccgtgaacagggtaccggggatagggattaatccgccattcgttagccccgaggtccaagcttacggtcccggatgattttacagaaagcgtggggaaaaaaaaaattttgtcccccttgaaccaaaaaaacccctcctccttaacccccaattcctgaatgatttacaaaaaggcgtggggcaagaaacagtggctctccccaggcaatgtaagaaccccttattcccc

SEQ ID NO: 80243 - protein, 103 aa, Zea mays
  misc_feature: Ceres CLONE 1565486
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (72)..(72): Xaa is any aa, unknown, or other
  misc_feature (85)..(85): Xaa is any aa, unknown, or other
MSRFGRSGPPPPIRDTYSLLVLNITFRTTADDLFPLFDKYGEIVDIYIPRDRRTGDSRGFAFVRYKYEDEAXKAVERLDGRLVDXEGDHGCSLPSTAQNAGTG

SEQ ID NO: 80244 - DNA, 859 bp, Zea mays
  misc_feature: Ceres CLONE 1565491
  misc_feature: Translation starting site: 163
  misc_feature: Pfam Name: Sua5_yciO_yrdC Pfam Description: yrdC domain
acccgcggtggcggccgctctagaactagtggatcccccgggctgcaggaattcgtctcacccctagaaaaagaaaccttttgccgtcttgcggcggccttctgctccgccgctcgttctcatatcttgcggcggcctggggaaaaagaggagagatcggagatgaaggcgtgtgcgaaggctgcgggggagaggctgccgctggtctgtgctccgtcaactaggcagcctctagctcggagctttgttaaggcaagaagattaccctctcaacatgagacgaagtcacaagtatcctgctcggttagggtgtcagaaaacacagctcacagaatagatgccacagcagaaaatattttcccagcaatgaaagatcatgtcttgaaagcaactgatgcaatcaacagaggagaagtgattgcggtgcctactgataccatatacgggtttgcatgtgatgcatgctctgcaggagcagttaatcgtatttatgagatcaaaggacgcatacaaacaagggcctctggcaatttgtgttggtgatgtctcagacatatcacggtttgctttaggggaccacttgccccatggcttgcttgatagtctacttcctgggcctgtcaccttttgttctaaaacgaggggaaaaccagctagtagagagaatccttaatcctggcttggatggcattgggagttcgtgtgccccgatctggattttcatactatccattggccccggggacggggaagtgccctttgccctccccaggcgccaacttaagggggaaagccccgggagtggcctggggccaaaaattttcaagggggtttttgcgcccctttgttccaattgtcg

SEQ ID NO: 80245 - DNA, 787 bp, Zea mays
  misc_feature: Ceres CLONE 1565496
  misc_feature: Encodes the peptide sequence at SEQ ID NO. 80246
ggagctccccgcggtggcggccgctctagaactagtggatcccccgggctgcaggaattcgtctcacccctagaaaaaagacgcccacacacacttcgcttctccacacgacctcgctgaaccggaagacccgcacactcacgccacttgtgcaccatggcgccccgggtggcggacaagtcgccattgccgctggccaccggactgaagctgggcgtaagcggacgcatgggcctgggtccacactacaccagtcgttgaaggaaacccgccccttggggaccttagcccccggagattcgcgacccacccaaataaactccgggtggttgggcacttacaaccggcccaaaaagcccccaggggtttaaaatttccccccccccaagtttccgtgggccccaaggggaaaaaaaaaattttccgggttcccccccttgccctttacggtttttcacttttcccgggggggggtttctttataacccccccccaaaggggtgatggccccccccccctttttgggaaaaaaaaaaccttgtgtgggggggaaaaaaaacggggggggggtgggggggggaaaaaaaaaaacccctccgttttgtttagaagggagggggcacaatgtgtcgcccatttaaaaaaaaacacgggggcggcctctggaataaataaaccaactttataatattttttttttttcccaaacacgagggggggggggggtggagcccgcccccccccctttcttttaattaggggggtggtgtttttctcaccgcccact

SEQ ID NO: 80246 - protein, 34 aa, Zea mays
  misc_feature: Ceres CLONE 1565496
MAPRVADKSPLPLATGLKLGVSGRMGLGPHYTSR

SEQ ID NO: 80247 - DNA, 840 bp, Zea mays
  misc_feature: Ceres CLONE 1565497
  misc_feature: Encodes the peptide sequence at SEQ ID NO. 80248
aaagctggagctccccgcggtggcggccgctctagaactagtggatcccccgggctgcaggaattcgtctcacccctagaaaaaactgatcaaagataccgacgagcaggccagagcgaaggaatggagtccatggccagcgacagcaaccaaggagcagcagataagccgaagccgaagccaccaccgctgccgctgtcggtgcgcctccagctggccgggctgacggcggccatcgacgccgtggagcgccgcgacgggacggtgaaccgctgcctgtacggcgtgatcgaccggctcctgagcgcgcgcgccagcccgcgcccggacgcctccggggtgcgctcctacgacgtgaccatggacgcgtcccgcggcatctgggcgcgcgtcttcgcgccggccgcggcggaccgcccgctccccgtggtcgtgtacttccacggcggcggcttcgcgctcttctccccggccatcgggcccttcaacggcgtgtgccgccgcctctgcgccgcgctcggcgccgtcgtggtgtccgtcaactaccgcctggcccgggagcaccgctggcccgccgcctacgacgacggcgtcgacgcgctgcgcttcctcgacgccccctgcggcgtcccggggctggacgacggcgtgcccgtcgaactcggcagctgcttcctggcccggggaaagccctgggaagaaaaatccgggcaccacgttaccaaacgccggggcgaggggcatggcaatccgttccgggggggaccctcccaggttcggggggcgttttccccggggcaaccccaactttagggggggcgtgtgaaccgcccccccgcc

SEQ ID NO: 80248 - protein, 229 aa, Zea mays
  misc_feature: Ceres CLONE 1565497
  misc_feature (103)..(229): Pfam Name: Abhydrolase_3 Pfam Description: alpha/beta hydrolase fold
  misc_feature: SWISSPROT Homolog: EC 3.1.1.3 Triacylglycerol lipase
MESMASDSNQGAADKPKPKPPPLPLSVRLQLAGLTAAIDAVERRDGTVNRCLYGVIDRLLSARASPRPDASGVRSYDVTMDASRGIWARVFAPAAADRPLPVVVYFHGGGFALFSPAIGPFNGVCRRLCAALGAVVVSVNYRLAREHRWPAAYDDGVDALRFLDAPCGVPGLDDGVPVELGSCFLARGKPWEEKSGHHVTKRRGEGHGNPFRGGPSQVRGAFSPGQPQL

SEQ ID NO: 80249 - DNA, 844 bp, Zea mays
  misc_feature: Ceres CLONE 1565501
  misc_feature: Encodes the peptide sequence at SEQ ID NO. 80250
tggagctccccgcggtggcggccgctctagaactagtggatcccccgggctgcaggaattcgtctcacccctagaaaaagctccacttccattcccagcgaccccgcccgcccggaggcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggtaccgtggggcggcccaacggccacgccatcgctcccgccacagacaccaagtcccaccgccgtcgagaccacccgtcgagagggtgatcttttcgactccggttcctggcactccctcgccgtcgccggggtcactcggccggctccgtcctggtggctccctcaatggctgtgtcttcatccaaaaaagcgttacaaggtttaccgggtcaaactttgttcaaggggggttcaatacgggggcaaaaggggcctcaaagccctccaaggccctacgaaggggtatttttgccgggaacacacagcgcgaaaattttgggaaggggggtcttaggggcttttttaaaaaaaaacgtcccccccgggggtttcccctcttaaaacaaaaaggggccccaaaaggggtcttttttttttttcggaaatttccccctttaaaaaaacccccccaaaggggtaataatattctctct

SEQ ID NO: 80250 - protein, 218 aa, Zea mays
  misc_feature: Ceres CLONE 1565501
MALLLLRGCAAPPAVHAAPAGSRLLPPALPRRRLVAVASSASSAPSGEVASSSQDGRGYGYRGAAQRPRHRSRHRHQVPPPSRPPVERVIFSTPVPGTPSPSPGSLGRLRPGGSLNGCVFIQKSVTRFTGSNFVQGGFNTGAKGASKPSKALRRGIFAGNTQRENFGKGGLRGFFKKKRPPRGFPLLKQKGAPKGVFFFFRKFPPLKKPPQRGNNILS

SEQ ID NO: 80251 - DNA, 891 bp, Zea mays
  misc_feature: Ceres CLONE 1565503
  misc_feature: Translation starting site: 108
ctccccgcggtggcggccgctctagaactagtggatcccccgggctgcaggaattcgtctcacccctagaaaaaactgctcgagctcagctcaaggaaccacagaaaatggcgtcacttctccgccctctcgtcctcgtgctcctgatcgcctcctgcgcagcgcagcagtcaccgccggcgcaggccccgccaacgccgaacgcgccaccggccaactcgccgccccaggcgcctccagccggaaacccgccgccggcgccccaggcgccgccggcaggcaacccgccacctgcgcccaccgccactccacctccggccccgaccactccgcccccggccccgaccacacctcccctggctcccacaacgccgcccccggcgccgacaactccacctccggcccccaccacgccgcctccgtccccaccggcgtcgccaccgcccgctcccaccactccgccaccgtctcccccggcaagcccgttggcctgctcccgccaccccgccaaccggttccaacctttggcgccacctcccgccaaggcccccttcacccgggcaacccggcggacaccgggaaggaggccaagtcaggccccacgagcgggggcccccgagctcccccccccccgtgggggaacaccaggttgcgtgtccctcaaaaaaccccgaaaaaccccgataatcccccccgtcctgtgaaattacaaaggagaacccaaccctttcttgacccaagaggggaacgggataaaaataaaaaagagattcggggggaggcaaacgggggggggggaaagagaagggattattgcaccagaagtgagtggagggttttgtcaaggagggtgaatgggaccccataacacatatacatagtgattaaaag

SEQ ID NO: 80252 - DNA, 808 bp, Zea mays
  misc_feature: Ceres CLONE 1565506
  misc_feature: Encodes the peptide sequence at SEQ ID NO. 80253
  misc_feature (339)..(339): n is a, c, t, g, unknown, or other
  misc_feature (422)..(422): n is a, c, t, g, unknown, or other
  misc_feature (553)..(553): n is a, c, t, g, unknown, or other
  misc_feature (794)..(794): n is a, c, t, g, unknown, or other
  misc_feature (800)..(800): n is a, c, t, g, unknown, or other
acccgcggtggcggccgctctagaactagtggatcccccgggctgcaggaattcgtctcacccctagaaaaaagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcctccggcagcccctggtacggtgccgaccgcgtcctgtacctgggcccgctgtccggctcacctccgagctacctnaccggcgagttccccggcgactacgggtgggacaccgcggggctgtcggcggacccggagaccttcgccaagaaccgcgagcntggaggtgatccactgccgctgggccatgctcggcgcgctcggggtgcgtgttcccggagctgctcgcccgcaacggcgtcaagttcggcgaaggcggtgtggttcaaggcgggctcccagatcttcagcngaggcgggctcgactacctcggcaacccgagccttgtccacgcgcagagcatcctggctatctgggcgttgcaggtggtgctcatgggcgccgtcagggggtaccgcgtcgccggcgcccgctccggggaggggtcgacccgctgtaccctggcgcagcttcgaccgctcggctcgccacgacccggagcgtcgcgagctcaaggtgaagagatcagaacgcgcctgccatgtctccagtncggctnctctgcag

SEQ ID NO: 80253 - protein, 224 aa, Zea mays
  misc_feature: Ceres CLONE 1565506
  misc_feature (63)..(196): Pfam Name: Chloroa_b-bind Pfam Description: Chlorophyll A-B binding protein
  misc_feature (96)..(96): Xaa is any aa, unknown, or other
  misc_feature (140)..(140): Xaa is any aa, unknown, or other
  misc_feature (220)..(220): Xaa is any aa, unknown, or other
  misc_feature (222)..(222): Xaa is any aa, unknown, or other
MAAATMAITSRALVGKPAAGTRDVFGEGRITMRKTAAKPKPAASGSPWYGADRVLYLGPLSGSPPSYLTGEFPGDYGWDTAGLSADPETFAKNREXGGDPLPLGHARRARGACSRSCSPATASSSAKAVWFKAGSQIFSXGGLDYLGNPSLVHAQSILAIWALQVVLMGAVRGYRVAGARSGEGSTRCTLAQLRPLGSPRPGASRAQGEEIRTRLPCLQXGXSA

SEQ ID NO: 80254 - DNA, 777 bp, Zea mays
  misc_feature: Ceres CLONE 1565507
  misc_feature: Encodes the peptide sequence at SEQ ID NO. 80255
  misc_feature (711)..(711): n is a, c, t, g, unknown, or other
  misc_feature (756)..(756): n is a, c, t, g, unknown, or other
ctccccgcggtggcggccgctctagaactagtggatcccccgggctgcaggaattcgtctcacccctagaaaaacccagcccagagccccagacaccactcccaaaacctcacgagcaagagcgcgcggccacgaacaccatacgcgctgctcgctccctgtccccgccgtcgccgcgcgaggcggagaaaagagagagcggagcgccgatccatgaaggaggcactcgcgctcgtgggcggcgcaaggcggctgtccgcgccggaggaggatgagctgctgggcctcctcgcgggcttccccgacgacgacggcggcggctccgaccgcgagctctccttctccgacctcgtcgaggccggcgccaggccggcgatcgcggacgcggacctcggcgccgccaaggcgccgtgcggggatcgcccttgcgcggccgtggcgctgccgtcgtcgcatgaggccgcggctgcggcgtccaagcagccggcggcgagacagagggcggcgcggcggagcggcggcggcagcaggggcagctgcggcggaagcggcgacggcgtgctgctcaacttctacgtgccggggcttctcaccaggagcatgaccgcgccgaagcccagccgcgggccgccgtcgcccggggccgtgcagggcgcgccggcgaagcctgttgccgcccgcggcaaagcagcagcatgacgcaacggcaanggccatcggttgtggcgcgcttttttgggggggaaccggggcccngggccacccaagccttgcact

SEQ ID NO: 80255 - protein, 161 aa, Zea mays
  misc_feature: Ceres CLONE 1565507
MKEALALVGGARRLSAPEEDELLGLLAGFPDDDGGGSDRELSFSDLVEAGARPAIADADLGAAKAPCGDRPCAAVALPSSHEAAAAASKQPAARQRAARRSGGGSRGSCGGSGDGVLLNFYVPGLLTRSMTAPKPSRGPPSPGAVQGAPAKPVAARGKAAA

SEQ ID NO: 80256 - DNA, 844 bp, Zea mays
  misc_feature: Ceres CLONE 1565508
  misc_feature: Translation starting site: 190
  misc_feature: SWISSPROT Homolog: EC 2.5.1.18 Glutathione transferase
ctccccgcggtggcggccgctctagaactagtggatcccccgggctgcaggaattcgtctcacccctagaaaaaacacacccatccaattccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcggacccaggcggggtggacgagaacgtggagatgctcaagatggtgctggaggtgtacaaagcgcggctgggccactgcacgtacttcggcggggaacttcctcagcctcgccgacctcaggccccttaccattatgaactggctcatgggcaccgagtacgccgctctcgtcccatgcgctcccgcactttagcgcctggggggaagggcctcgcccggcgccccggggggcaaaaaggggggcattttcatgccggtcgggcaccgat

SEQ ID NO: 80257 - DNA, 880 bp, Zea mays
  misc_feature: Ceres CLONE 1565509
  misc_feature: Encodes the peptide sequence at SEQ ID NO. 80258
  misc_feature (377)..(377): n is a, c, t, g, unknown, or other
ctccccgcggtggcggccgctctagaactagtggatcccccgggctgcaggaattcgtctcacccctagaaaaactcttcctcctccgcctcctcttcctctcttttgcttttgtgttgctgttaggttcttggatagtgtgcatcggcaccagcagcagcagtagtaattcatactagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtcccgggaggcgctggcaagccgggagagcccgaggacgccggctcagtgccntgacgcccaccgggcgcgttcgccgtcccagcttcaggatccccccgactttcgaaggaacaacgccttgcaattcgcccgggccgccaaccgggcggggggcaaggcttcctgggttgggcccttccgaaaacatccgccgccccttttaaaaaaaagggcctcaaaaggcccgtaaattatttaagggtgtggggccaaactttgggaaaatgggggcccccccccaaaaaaccccctccggggggggaaaaaaaaacccacaggaaaacaaaaagatgggtgggaaagtatgttttgcccccccccactacataaaaaaaattgggggggagggagaaaaaacctccccccttggggggggttgagaaaaaaataaagcccccccccccttttgatggggtgcggcgctgcgaagcagaacaagagggggggtgtatgaataaaaaaaatatagacccaccagccccgcggggtgggggtatgatacaataaattaaaat

SEQ ID NO: 80258 - protein, 112 aa, Zea mays
  misc_feature: Ceres CLONE 1565509
  misc_feature (54)..(54): Xaa is any aa, unknown, or other
MEVFIHEDYVNKRNELRREQRRRELQRLQVESNPDASREALASRESPRTPAQCXDAHRARSPSQLQDPPDFRRNNALQFARAANRAGGKASWVGPFRKHPPPLLKKRASKGP

SEQ ID NO: 80259 - DNA, 828 bp, Zea mays
  misc_feature: Ceres CLONE 1565514
  misc_feature: Translation starting site: 262
  misc_feature: SWISSPROT Homolog: EC 3.2.1.51 Alpha-L-fucosidase
  misc_feature (605)..(605): n is a, c, t, g, unknown, or other
  misc_feature (606)..(606): n is a, c, t, g, unknown, or other
ctccccgcggtggcggccgctctagaactagtggatcccccgggctgcaggaattcgtctcacccctagaaaaaagacgttggccgcccgccattggtccgccgatatctctttttccctctctctccttttctgcttaagttcccgtccacgagagcaggtagtagtagctactagtagctagcaagtcggccagcacgctcgctcgctcgcagcagtcgctagccagacagcattggcgccggcccgcgcgtgcgcgccatggaggaggcgaggcaaaggcggcggctgtgcctgtgcctgctggtggcggccgtgagctgggcgctgctggcggcggtggcgcggtgcgacccgcaggtgccgtgctacttcatcttcggcgactcgctggtggacaacggcaacaacaactacatcgtgtcgctggcgcgcgccaactacccgccctacggcatcgacttcgccgccggcccgtcggggcgcttcaccaacggactcaccaccgtcgatgtcatcgctcaacttctgggtttcgacaacttcatcccgccgttcgccgcaacgagcgcggaccagctcctgtgcggctgcaacttcgcctnncgcgccggcgggatccgcgccgagaccgccagcagctgggcggggcggatccgttcgcggggcaggtgcagaactaccagacggcggtgcagacgctggtgagcatcctgggcgacaaggacacggcgtcggaccacttggaccggtgcatctttcgcgtgggcatgggcagcaacgactacctcaacaactacttcatggcgggccttctacaaaacggga

SEQ ID NO: 80260 - DNA, 875 bp, Zea mays
  misc_feature: Ceres CLONE 1565516
  misc_feature: Encodes the peptide sequence at SEQ ID NO. 80261
  misc_feature (470)..(470): n is a, c, t, g, unknown, or other
ctccccgcggtggcggccgctctagaactagtggatcccccgggctgcaggaattcgtctcacccctagaaaaaaaaaccctcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttttgagaggcatttatgcatatggttttgagaaaccatctgcaattcagcagagaggaatttgttccttctgcagggggcttgatgtcattcagcnaagcacatctggtacagggaagacaggcaccttctgttctgggatcctgcagcagcttgactatggtctgggtgaaatgcaagcccctggttcttgctccccacccgtgagcttgcacagcaaatttgagaaaagtatgcccgcaccttggtgaccaacttgggggggtaaaggccctgcctggcgtggaaggaaacactcggttcggggaggacaaaaggatttcccccccgggggggggcaatgtttgtttttggaacccccgggcccggggggttttaaatggctgggaaaaacaagcccccccgccccggaaaaaaaccaaaaatgttttggtttttgtaaaaaaccgagaaaaaaaagccttcccgccgggtgtccaggggaacaaaattttttggaacc

SEQ ID NO: 80261 - protein, 134 aa, Zea mays
  misc_feature: Ceres CLONE 1565516
  misc_feature (84)..(84): Xaa is any aa, unknown, or other
MAGMAPEGSQFDAKHYDSKMQELLSTGETEEFFTSYDEVFESFDDMGLQENLLRGIYAYGFEKPSAIQQRGICSFCRGLDVIQXSTSGTGKTGTFCSGILQQLDYGLGEMQAPGSCSPPVSLHSKFEKSMPAPW

SEQ ID NO: 80262 - DNA, 967 bp, Zea mays
  misc_feature: Ceres CLONE 1565521
  misc_feature: Translation starting site: 114
ctggagctccccgcggtggcggccgctctagaactagtggatcccccgggctgcaggaattcgtctcacccctagaaaaaactgctcgagctcagctcaaggaaccacagaaaatggcgtcacttctccgccctctcgtcctcgtgctcctgatcgcctcctgcgcagcgcagcagtcaccgccggcgcaggccccgccaacgccgaacgcgccaccggccaactcgccgccccaggcgcctccagccggaaacccgccgccggcgccccaggcgccgccggcaggcaacccgccacctgcgcccaccggcactccacctccggccccgaccactcccgcccccggccccgatcacacctcccctggctcccaaaaaggcggcccccggggccgaacaattccaccttcgggccccaaccaaggccgccttcgttccccaccggggttgggcaacgggccggtttccaccaaattccgccaacggtttttcccccgggtaagacccggccggccggtttccccgccaaccccggccatcggtttttccaaccccattgggggccccccttccccgggcaaagggccccctttccataccggggcaaaccccggggcgggccaacagggggcggggggcccaaaggccgggggccccccgaaagggggggggcccccctaaatttccccccgggccccgggggggggaaaaacacaggggtgggcgttgccccccaaaaaaaaccccgataagaaaacaccgaaaagccccggcccggcccctcaatacattccccccgggggggccccttttggtttttcggccccaaagggggcacctgccaaaacaaaaaaaagggacacccggggtggaaaaaaccaccccccccgggtccggtttttttcccaaccgttgggtgtgacattttggcggggcccgagggcccctcccggacctggctgttaaaa

SEQ ID NO: 80263 - DNA, 879 bp, Zea mays
  misc_feature: Ceres CLONE 1565522
  misc_feature: Encodes the peptide sequence at SEQ ID NO. 80264
ctccccgcggtggcggccgctctagaactagtggatcccccgggctgcaggaattcgtctcacccctagaaaaagaagcccaccgaattccctgcgattcctctcccctcgcctcctcgtctccccctagggttagcacctcgctgcctccgattcaatcataatatggtctcttctccctttgatctgtagatttggggctttggctccgcctcgcgcgcccgatccgggccgtcctccttttttcccctcttatatttgatcggtttctttgcgtcgttcacgcagggatcgtcggagaggaatcgcaaagagggccgtctcatccgagttaaggaagccatggagcacaaggaggctgggtgccaggcccccgagggacccatcctctccaccaaaaactgtggcttcttcggcagcgcggcgaccatgaacatgtgctctaagtgccacaaagagatgataacgaagcaggatcaggccaagctggctgcctcctctatcgacagcatcgtgaacggcagcgacgccgtcatggagcccggttgttgctggcagcaaacacggtagtagctgttgccccagtcgagttgcaaacaatgaaccgggcgcatcccgctttatgttggccggaacccagccaagggggttggcgggcaattctccaaaaggggggaagggaagggcccaaaccgggtgcatgcgcccgcctggaagaaggggttggggctcccggggattcaaactggcccgggtgggggaaaacttgtaactggggcgcctccctccccgtttactcccgtaaaagagaccgaaatgggaaaggtttcaaaaaacccgggaacttgtctggcccagggggaacccccatttgtccct

SEQ ID NO: 80264 - protein, 75 aa, Zea mays
  misc_feature: Ceres CLONE 1565522
  misc_feature (14)..(38): Pfam Name: zf-A20 Pfam Description: A20-like zinc finger
MEHKEAGCQAPEGPILSTKNCGFFGSAATMNMCSKCHKEMITKQDQAKLAASSIDSIVNGSDAVMEPGCCWQQTR

SEQ ID NO: 80265 - DNA, 793 bp, Zea mays
  misc_feature: Ceres CLONE 1565525
  misc_feature: Translation starting site: 195
  misc_feature: SWISSPROT Homolog: EC 2.7.10.2 Non-specific protein-tyrosine kinase
tccccgcggtggcggccgctctagaactagtggatcccccgggctgcaggaattcgtctcacccctagaaaaattcggcctatcacaaccacttactctcgtgcgctctccgtgggagcgaggactcgcggccggcgcgacggcatggttctcctagatctcctgcatcatcattcacgaatggctgactgtgtatgtacattctgccccttgtttgtgacaatggaactggcatggctcaagctggttttgctggcgaccatgcgccaagggctgctttcccaagcattgtcagacgcccccgttcacactggtgtgatggtcggcatggggcagaaggatgcgtatgtcggtgactaggcccagtccttcaggggtatcctgaccttgaagtaccccatcaaacttcgtagtgttagcaattgggatgtacatggagaagatctggcaccacaccttctaaagtggaactcgggatggcgccggatgagctacctgtgctgatgactgaagccccactcaaccgctaagctaagcgggacaagacgacccttagagcgtttgagacccttcgatgctcgtgccatgagatgacacctcccggacagtgctctccctcgactccaatgggcgtactcactggcctcgtgtccgactctgaggggaggacgtctccgcatcggccctaccaacaagagatatgcccgtcctcactactatacagcaagcctgactttcgatggggcgtgatcttggactgtcaggctgtatgaacatcggcttacggagagga

SEQ ID NO: 80266 - DNA, 837 bp, Zea mays
  misc_feature: Ceres CLONE 1565527
  misc_feature: Encodes the peptide sequence at SEQ ID NO. 80267
ctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgttttgttgttggtgtcaatgaggacaagtacccctcggatgttaacattggtttccaaagctgactgcaccacaaacggccttggcccccttggctaaggcatttcaggacaacttcggcattttttgaaaggtttgaataaaaaacggtttcatggccttcactgccaaccaaaaaaaacgggtggacggaccccccccgccaagggaactggaaaaagggggcaagggccttcccaacctttaaacaccattcctaaagaaacccccggggcctgtccaaaggggtga

SEQ ID NO: 80267 - protein, 138 aa, Zea mays
  misc_feature: Ceres CLONE 1565527
  misc_feature (4)..(134): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFCCWCQ

SEQ ID NO: 80268 - DNA, 833 bp, Zea mays
  misc_feature: Ceres CLONE 1565528
  misc_feature: Encodes the peptide sequence at SEQ ID NO. 80269
  misc_feature (819)..(819): n is a, c, t, g, unknown, or other
  misc_feature (821)..(821): n is a, c, t, g, unknown, or other
  misc_feature (823)..(823): n is a, c, t, g, unknown, or other
ctccccgcggtggcggccgctctagaactagtggatcccccgggctgcaggaattcgtctcacccctagaaaaatgagtacttcaattggcgttggccgatcaatacgataaccgaatcatgcccgcttccagaacaacggggacggcgacgaccaacctaaatgggtaactatagcaagattggcggcgaactgctgcttgctctcctcctcttctctgctgctgccgcccctcacgaacttgaacttggctttggagacaatcacatgagaatcttcccggaggacatcattgacacagtcaacaaccttcccagtgctgggtggacagcctcacataatccttacttttcaaactataccattgcgcaatttacacacatacttggagtgaaaccagcaccactgaatgcactaagctatgttcctcgtcaaacttattctagatcactgcaacttccaaaacaatttgacgctatatctgcatggtaccgttgcagcacaattgggaacatacttgatcaacgtcactgtcgctcttgtcgctcttttaatgctgccgactgcatccagtaccgtttatacattcacctccacatgagcattttactttcagtcgatgacctactgacgtgctgtcaattttatgctcggcaatgagctctcatagcagctctcctatagaggcataggcgctacttcgttcaatacggtgttgtctacgtatgagtgtgatccatacgtgcgaccttggcgcgttgcaagcatcataggatgccgccatgcttatactacaccaaacctctgaaaccgaatgcnancnaacggaggcc

SEQ ID NO: 80269 - protein, 165 aa, Zea mays
  misc_feature: Ceres CLONE 1565528
  misc_feature (39)..(82): Pfam Name: Propeptide_C1 Pfam Description: Peptidase family C1 propeptide
  misc_feature: SWISSPROT Homolog: EC 3.4.22.1 Cathepsin B
MGNYSKIGGELLLALLLFSAAAAPHELELGFGDNHMRIFPEDIIDTVNNLPSAGWTASHNPYFSNYTIAQFTHILGVKPAPLNALSYVPRQTYSRSLQLPKQFDAISAWYRCSTIGNILDQRHCRSCRSFNAADCIQYRLYIHLHMSILLSVDDLLTCCQFYARQ

SEQ ID NO: 80270 - DNA, 882 bp, Zea mays
  misc_feature: Ceres CLONE 1565531
  misc_feature: Encodes the peptide sequence at SEQ ID NO. 80271
  misc_feature (405)..(405): n is a, c, t, g, unknown, or other
ctccccgcggtggcggccgctctagaactagtggatcccccgggctgcaggaattcgtctcacccctagaaaaacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgagcctaccagcctcgcgccgtacggactctccatctcgccactctccaaggacgcggccatggggctggtggtgagcgctgccacggggagcggctggacgacgggatcggggatggagagcccgccgacngcgagcaaaagcgggtggggctgggcaggccggaagtgtcaacgctgcccttggtccctcttcacgaaatcaccgcgggcggcgcatgcggggtgggcttccacctggcaactggtgcgggcaggcgtaccaacaggggccatcaattcctcatgccctcccccaaatgaaactggggtttggtccaggggctccgggttggcaacgaggttcccataaagtggggcaaaaaacccggaaaccggttttcaaaaaaaaaaaaaggcttatttgggccccaaatttcccccccaaaaagggggagagcccccctttctaaactacctttggaaaaaaaaaaaaggagaggcggcaacattttttttccccccccgaaaaaaacaaaaaaacccccccctttttttgtgtgagaaaaatttgggagaaaccaaaaaaaaaaagaaagggcgcccgcgctctcaatattattgtgctcgg

SEQ ID NO: 80271 - protein, 174 aa, Zea mays
  misc_feature: Ceres CLONE 1565531
MESVASAAIATTSRSLPLPFSSTPVHRRRRAAFLPVAASKRHDDDKEAAKGSGSEPRREPTSLAPYGLSISPLSKDAAMGLVVSAATGSGWTTGSGMESPPTASKSGWGWAGRKCQRCPWSLFTKSPRAAHAGWASTWQLVRAGVPTGAINSSCPPPNETGVWSRGSGLATRFP

SEQ ID NO: 80272 - DNA, 907 bp, Zea mays
  misc_feature: Ceres CLONE 1565533
  misc_feature: SWISSPROT Homolog: EC 3.1.4.4 Phospholipase D
  misc_feature (781)..(781): n is a, c, t, g, unknown, or other
ctccccgcggtggcggccgctctagaactagtggatcccccgggctgcaggaattcgtctcacccctagaaaaaatattacgggaaaggatctgtcctgtgctcatataattctactttttaaaaggatttaactctttttaaatgagaaaatagttactcttggtagcatagtgttgaacagccgaattcctgcttgaattgctctcttgcttggcttggaaggcatccatttactgacgaagatggtaacaatttctgtttgatttcagtggacgatgaatacatcatcattgggtccgccaacatcaaccagaggtccatggacggtgccaggtactctgagatcgccatggggcgcgtaccagcccgtacaacctggcgacttagcaagctgcccgtgggccagatccatgggcttccggaatgttctcttttggtacgaaccacctgggggatgcctgggaagaacgtctttccaagcgcccccgaaaaaccgttaaaatggcgttgccataaagggtgaaacaaaaatccccccaaaaagtaccggggaaccttgttcctccgaggggaatgaccctgggaaacaggggacctcccccggggcgcccccttccctccagggttaaccccgaagttgggggggttaaccttggcccaaaaagggaacccccttttatccatgaaaaccttcccccccgggggattagggaagaaaaaattttctcccctgggaaaacaccccctggtggtgcgcccgcggtgtttccccctctggnggggataaacaaagagggtgtgggggaaataaaaaaattttctcccccgccggcgccccaatatattctcattattacaaaaaaaaatatataaagagaggtctgttttgtcgagagaggtcgtat

SEQ ID NO: 80273 - DNA, 1174 bp, Zea mays
  misc_feature: Ceres CLONE 1565534
  misc_feature: Encodes the peptide sequence at SEQ ID NO. 80274
  misc_feature (11)..(11): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (703)..(703): n is a, c, t, g, unknown, or other
  misc_feature (894)..(894): n is a, c, t, g, unknown, or other
ttttttgagtncggggaacaaactaaaaccccaactttggggggagggtttttntttnnnnannnntnnccaagctggagctcaccgcggtggcggccgctctagaactagtggatcccccgggctgcaggaattcgtctcacccctagaaaaatcacaaggagaccctcctcagccgctagtaccagtagtcgtcacgttaacaggcggatctgagttagccggcggatccgatccgtgcgcgtgcagtgtacgtgtgtctgtggagatagccacagattacactcccctgtcgagcccgatgatgaagagcagcctcctcgtgcactccaggcctaggggcctgtcaggcgctgctgtgctcacgatacgggcgctgttcaccgtacaagacatccacccccagaaagcaacgtaccagggggggcagaacaataaagggggacaccttcatcggcagcctggaaaaacccccccccctgcagcccggatcgggaacgtggaaaccttctccaaacttacccggcctaccgccaacccccaagaagccccgcttactttcgaagagccttccaaagatcaggccctccggcaaaagggggtataccctcccaatatggggggaggccactatgggcgggatggaaaaggagacacgcggatacacgccaaagaaaacggccccaattgggcaacgggggcncaatgagaacgaggtgcgcgcgtttatgtaagggggagccacccacggcgggggcccttcggtgagtagggccacatatcacgcgaacaatatagggtgtaagaggactctgaagaaacgaaaaatgtgtaatgagggaggaaaactccccccactcacctgtgtccagagcgggtgggggtgggggaaancggggtctcacgaggggggtggcccacctcttggaggacagggggtttccaacgcgcgggagaagagaaagattacggagagggtgcgcgtagctatggcctgccaatgaacccatactcgaggggggggtgggggccgcaatgttttgcagggcggagacaatattttttcttcttggggagaaaatttatccgtgtgatgagtaggttttgaacacaaaattttttgtccgagtttagaggagcatcagaaacagcccccaaagatacgtaagaagag

SEQ ID NO: 80274 - protein, 135 aa, Zea mays
  misc_feature: Ceres CLONE 1565534
MMKSSLLVHSRPRGLSGAAVLTIRALFTVQDIHPQKATYQGGQNNKGGHLHRQPGKTPPPAARIGNVETFSKLTRPTANPQEAPLTFEEPSKDQALRQKGVYPPNMGGGHYGRDGKGDTRIHAKENGPNWATGAQ

SEQ ID NO: 80275 - DNA, 824 bp, Zea mays
  misc_feature: Ceres CLONE 1565536
  misc_feature: Translation starting site: 156
  misc_feature: SWISSPROT Homolog: EC 3.4.22.25 Glycyl endopeptidase
  misc_feature: SWISSPROT Homolog: EC 3.4.22.67
  misc_feature (705)..(705): n is a, c, t, g, unknown, or other
  misc_feature (789)..(789): n is a, c, t, g, unknown, or other
ctccccgcggtggcggccgctctagaactagtggatcccccgggctgcaggaattcgtctcacccctagaaaaaatccatctgctctgctccggtccgttccgctccttcctccccctatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgcctcgggctcaaccgcttcgccgacctcaccaacgacgagtaccgcgccacctacctcggcgtcaggagcaggccgcagagggagagggagctcggtgacaggtacctggccggcgacaacgaggacctgccggagtccgtcgactggcgggccaagggcgccgtcgcggagatcaaggaccaggcagctgcgggagttgctgggctttctcacaatagcggctgtggaggcatcaaccagatggtactggcgacatgatctccttgtctgagcnagagctttgtgactgtgacactcataacaccaggggtggcatggaagtctgatggactatgcgtttgagtcatcatcaacaatncggaatcgacaccgaagaggattaccctaccaggc

SEQ ID NO: 80276 - DNA, 997 bp, Zea mays
  misc_feature: Ceres CLONE 1565538
  misc_feature: Encodes the peptide sequence at SEQ ID NO. 80277
  misc_feature (997)..(997): n is a, c, t, g, unknown, or other
ctccccgcggtggcggccgctctagaactagtggatcccccgggctgcaggaattcgtctcacccctagaaaaaatcactaccaccgctctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgccccgagggccgtcttccccagcatcgttgggcgcccgcgccacaccggtgtgatggtggggatggggcagaaggatgcctacgtcggcgacgaggcgcagtccaagaggggtatcctgaccctcaagttccccttcgagcacggaatcgtcagcgactgggacgacttggagaagatctggcatcacaccctttcttcaacgagcctccgtgtggctccccgaggaaacacccccgtccttcctcaactggaaggcggccccctggaacccaaaagggcttaaccggtgggagaaagatggacccctgaaattattggtttcggaagaaccctttcaaacaaccccccggccttttggttaccgttcggcccatttccaagggccccggtcccctgggtcctcttggtttttgccccgagttggggtccgggtacacaccaaggggaaatccgtgggcccccgaaagtccgggaagagaagggtggggtcaagaccaacactggggtcccccacttctgttggggaggggatttacccgccccttcccccccaaagggccggtgtgcttttcgttcttcgaaacctgggggtgggggcaccggaacccttcctcccaaattaacctgttattgaataaatccccggaccgtgaagcgcgggggttacccctctttcaccacacaactggggtgtgaagacgggaaaaattgtccgcggtgcacatgtaaagggtgaaan

SEQ ID NO: 80277 - protein, 121 aa, Zea mays
  misc_feature: Ceres CLONE 1565538
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKFPFEHGIVSDWDDLEKIWHHTLSSTSLRVAPRGNTPVLPQLEGGPLEPKRA

SEQ ID NO: 80278 - DNA, 827 bp, Zea mays
  misc_feature: Ceres CLONE 1565540
  misc_feature: Translation starting site: 131
  misc_feature: Pfam Name: Y_phosphatase2 Pfam Description: Tyrosine phosphatase family
  misc_feature: SWISSPROT Homolog: EC 3.1.3.48 Protein-tyrosine-phosphatase
  misc_feature (515)..(515): n is a, c, t, g, unknown, or other
  misc_feature (596)..(596): n is a, c, t, g, unknown, or other
  misc_feature (641)..(641): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaaacccacccgcgcgccgtgcctcggttttagggcccttccctcaccgccccgcggccatgaagctggaggtcatgcccaagcccaaacagcgggtgctggaggcgcagcagagggaggaggccatggagatgagcgacctggacctgtggaagcacgagaagccgccaaggatctgccccttgcccccgtcgctcccgccgccgccgccagcgttcgacgaagcggcgctcgtgccgccgctcaacttcgccgtggtcgacgacggcatcttccgctccggattcccagggaccgccaacttccggttcctcaagtccctcaacctccgctccatcgtgtacctgtgcccggagccgtacccggggacgaacacggagttcctagaaaagaatgggatcaggctccaccagttcggaatcgaggggcgcaaggaaccatttngtcacataccccgacgacaaaataagggagggcgctcaagttgtcttagacccaagaaaccaacctctgcttatccattgncaagagagcaagcaccgaaactggctgtgtggtcgggtgcttgangaagctgcaggaatggtgctttgtctcagtcttggacgagtaccatcgctttgccgctgcaaaagcgaggatcacctgacagaggttcatggagctgntcgacgtttcaagcttgaagcactgacaccctcaactgttaaccaaaggcgtgtgatcgattggtcccccactctagtacatctcaaa

SEQ ID NO: 80279 - DNA, 810 bp, Zea mays
  misc_feature: Ceres CLONE 1565541
  misc_feature: Encodes the peptide sequence at SEQ ID NO. 80280
  misc_feature (274)..(274): n is a, c, t, g, unknown, or other
  misc_feature (282)..(282): n is a, c, t, g, unknown, or other
  misc_feature (336)..(336): n is a, c, t, g, unknown, or other
  misc_feature (374)..(374): n is a, c, t, g, unknown, or other
  misc_feature (389)..(389): n is a, c, t, g, unknown, or other
  misc_feature (425)..(425): n is a, c, t, g, unknown, or other
  misc_feature (509)..(509): n is a, c, t, g, unknown, or other
  misc_feature (546)..(546): n is a, c, t, g, unknown, or other
  misc_feature (576)..(576): n is a, c, t, g, unknown, or other
  misc_feature (765)..(765): n is a, c, t, g, unknown, or other
  misc_feature (780)..(780): n is a, c, t, g, unknown, or other
ctccccgcggtggcggccgctctagaactagtggatcccccgggctgcaggaattcgtctcacccctagaaaacccccctctctctctctctctcctgttccccgcgagagtcgctcagggccgcgacgaggagaagcggcagcgcgtcacctctccaatggcatccccgtccctcctccgtgcaacctgtgcgcttctcgagtgctgaggctccctgtccctaagacaagcttgcgcgcgcgatggagggtttttcgagggacttgctgtgcnggattgcnagggggacgcgccgccaccggagtagaagccggggcgctgcggagagatggaangaaagtggagcttagccctcggctgtctcttggcggcngattcagctcgacanggaagggagcagctcccccggttcgtcgtccgtggncgcatgctgactacgcccgtggaaggtgccggggccgccctcccctctcgccgggcgaggctcgctgccggtccagggcgaggncgtccgaaagttgagaagaagcaggggctgggatggnattgggggttcttgcccgtgaggggcggcngggtctccgcgtgcaacaaccccggccaggctgccggcgaagcgggaacccctcctctggctcctttcggtaggggaaagaccgatttttgcaaggcaccctcatggagactagttcaccccctgctggtcattgaggcttctgggcattgatgactgggagaaaccaaagggaagccccagctgaaanaggctccaggttaanaagaagaggatttgagaggagaaaccctcc

SEQ ID NO: 80280 - protein, 35 aa, Zea mays
  misc_feature: Ceres CLONE 1565541
  misc_feature (11)..(11): Xaa is any aa, unknown, or other
  misc_feature (31)..(31): Xaa is any aa, unknown, or other
MEGFSRDLLCXIARGTRRHRSRSRGAAERWXESGA

SEQ ID NO: 80281 - DNA, 826 bp, Zea mays
  misc_feature: Ceres CLONE 1565543
  misc_feature: Encodes the peptide sequence at SEQ ID NO. 80282
ctccccgcggtggcggccgctctagaactagtggatcccccgggctgcaggaattcgtctcacccctagaaaaagcctccccagcgtaacaagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaataaatcaatcgctggcattgtcactgagagagattatctccggaaaatcatagtgcaggggaggtcttccaagtcaactaaggggggcgacatcaggactgaagaaaacaaactgatcacagtgaatccccgacaccaagggtcctgcagggcaatgcagctcatgacagaaaaacggcttcagaaacatcccgggtgatccaacgggacgggggaatcctggggaatggtccccaatcggggaaaatcttggcgccccgggggggggcccaacccccggggggggacctaaaccccggctcaattgat

SEQ ID NO: 80282 - protein, 168 aa, Zea mays
  misc_feature: Ceres CLONE 1565543
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKGGDIRTEENKLITVNPRHQGSCRAMQLMTEKRLQKHPG

SEQ ID NO: 80283 - DNA, 799 bp, Zea mays
  misc_feature: Ceres CLONE 1565545
  misc_feature: Encodes the peptide sequence at SEQ ID NO. 80284
  misc_feature (197)..(197): n is a, c, t, g, unknown, or other
ctggagctccccgcggtggcggccgctctagaactagtggatcccccgggctgcaggaattcgtctcacccctagaaaaagcctggtgatcacaactccacgtcacacacctcacagagctgcagcagcatcagctgccacctcctgcctctcctccttccttcctgcctgcataggttgctacacgtatatattcntgaagaagagatcgagatgaccagcgtgtggaagaccaaggttctgcctggcctcaacaagatctttgacaaggatggcaagaaggctgcagctgcaggcttcttgaagtccttcaacaaggaggagtttgacaaggagattgaggacaagaagacagagctggagcccaaggtcgtggaggcctacgaagcatctcctcctgaggtcaaggctctcttcaaggataagaagccagtcaaggtcagcaagaagaactcggctgcagtcaccaagttccctcgatgagctgggctaagattgacttcccctggaaaaccaaaggtgggttaaacccaaggccgggtgggccaaagttccggggaccttcgccccctggctttccggggaattaacctttcatttttgggaaaaagggccacccccgtttttccccccagggaaggaaccccaagggaaaaaaccccggggggcggaagccccccccccccgggaaaaactccccccggggaagaaaaaaaaaaaaagggggaagaggccaaaaccccctttttttaaaaaaaggagagagggggaccccggggggcccgcggaaagaaaaaca

SEQ ID NO: 80284 - protein, 89 aa, Zea mays
  misc_feature: Ceres CLONE 1565545
  misc_feature (2)..(90): Pfam Name: DREPP Pfam Description: DREPP plasma membrane polypeptide
MTSVWKTKVLPGLNKIFDKDGKKAAAAGFLKSFNKEEFDKEIEDKKTELEPKVVEAYEASPPEVKALFKDKKPVKVSKKNSAAVTKFPR

SEQ ID NO: 80285 - DNA, 737 bp, Zea mays
  misc_feature: Ceres CLONE 1565549
  misc_feature: Encodes the peptide sequence at SEQ ID NO. 80286
  misc_feature (437)..(437): n is a, c, t, g, unknown, or other
ctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgngcaagaagccagaggacttcgccaagtaccaggcctacgagctgatccatgccagatgggccatgctccgtgccgctggcgctgtcatcccagaggccctgcaacaagttcgggggctaactgttggccctgaaggcttgtctgggttaaaaaacggggggcccttgttcctggaaaggggaaaaacccccaaaatagtttggggaaaagttccccctaaaaccgggggggggggcccgaaaacccgaaaggtatcccccccgggggggggcccaaaaatttccgggtatcccaagggga

SEQ ID NO: 80286 - protein, 203 aa, Zea mays
  misc_feature: Ceres CLONE 1565549
  misc_feature (83)..(203): Pfam Name: Chloroa_b-bind Pfam Description: Chlorophyll A-B binding protein
  misc_feature (104)..(104): Xaa is any aa, unknown, or other
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLXKKPEDFAKYQAYELIHARWAMLRAAGAVIPEALQQVRGLTVGPEGLSGLKNGGPLFLERGKTPKIVWGKVPPKTGGGGPKTRKVSPPGGGPKISGYPKG

SEQ ID NO: 80287 - DNA, 875 bp, Zea mays
  misc_feature: Ceres CLONE 1565551
  misc_feature: Encodes the peptide sequence at SEQ ID NO. 80288
  misc_feature (211)..(211): n is a, c, t, g, unknown, or other
  misc_feature (454)..(454): n is a, c, t, g, unknown, or other
ctccccgcggtggcggccgctctagaactagtggatcccccgggctgcaggaattcgtctcacccctagaaaaaccatctcacggctagctagcacaagcatagtgcaggggcttgccacctaagtaaggcccgcctgagagccatggcatccaaggccgtcctcttcttggctctcaaccatcctggttcttcaacggtggccaaacgcntggcggcaaactgccccgacccccctaccccccccgggtcgaagcccaccgcccgcccgccctccctggttgggtttaccccccccccccccttttttttccaagaggggggcaaaattggcccccccccttaaaaaaacccccccccccaaaaaaattctttcgccgcgcctttgtttttccccccccccacccataattaaggggggtttttataagagagaactccctcttctttttttntaataaaaaataatatttcccccacaaaaagctatatattttttttcaatcacctacttatacaatatttgtaatgataatgacccaccctctctgtgaaactgttatacacaagtagaagctgagaaaacaccccatggggtccttgtaagtatatatatttgttgtttttttattaactagataaactacctccccatctcatctttcataatttcaccctcaaccgttaaaaggacatatacgaacaggctattaactcttattttcttttgttttaaacacagtaataaacaaaaaaaaatataaattataaaaataaagacgggagaaaaacataattactagtgcacctaacacaaaagaggataattaaatagatgtggtataagaatggcagaaaaaatattttaatactaag

SEQ ID NO: 80288 - protein, 66 aa, Zea mays
  misc_feature: Ceres CLONE 1565551
  misc_feature (23)..(23): Xaa is any aa, unknown, or other
MASKAVLFLALNHPGSSTVAKRXAANCPDPPTPPGSKPTARPPSLVGFTPPPPFFFQEGGKIGPPP

SEQ ID NO: 80289 - DNA, 854 bp, Zea mays
  misc_feature: Ceres CLONE 1565554
  misc_feature: Translation starting site: 222
  misc_feature (450)..(450): n is a, c, t, g, unknown, or other
  misc_feature (556)..(556): n is a, c, t, g, unknown, or other
agctccccgcggtggcggccgctctagaactagtggatcccccgggctgcaggaattcgtctcacccctagaaaaaaaaaccctcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttttgagaggcatttatgcatatggttttgagaaaccatctgcaattcagcagagaggaaattgttccttctgcnaggggcttgatgtcattcagcaagcacaatctggtacaggaaagaacagcaccttctggttctggtatcttgcagcagcttgactatggtctggttgaatgcccanggccctggttcttggctcccaccccgtgagcttgcacagcaaatttgagaaaagtatgcggcgcacttgggtgactaccttggtggtaaagtcccatgcatgcggtgggaggaaccatctgggtcgtgagggaccaaggattctccgccagtgggtgtgcatgtttgttgttgtaacacccctggtcgggtgtttgaacatgctgcggtaaacagtcccctcgggcctgataacatcaaggatgttttgttcttgaatgaagctgaatgaaatggctttccccggggtttccaaggaa

SEQ ID NO: 80290 - DNA, 760 bp, Zea mays
  misc_feature: Ceres CLONE 1565555
  misc_feature: Encodes the peptide sequence at SEQ ID NO. 80291
  misc_feature (635)..(635): n is a, c, t, g, unknown, or other
  misc_feature (674)..(674): n is a, c, t, g, unknown, or other
  misc_feature (699)..(699): n is a, c, t, g, unknown, or other
  misc_feature (720)..(720): n is a, c, t, g, unknown, or other
ctccccgcggtggcggccgctctagaactagtggatcccccgggctgcaggaattcgtctcacccctagaaaaaaaggagacgtacgctctctgctagcacccatcgtcttgcagcaggcggagccgcccgacccgatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccggcctcgtcgccatcctcagcgtctgcctcacaatgtacggcgtcgcctcctttcacgagggcgaacccgtcacgggngccacgctcacgctcacgggccggaagaagaggccgacnagctgcagacccgcgacggctgggnccagtcaccggaggggtcttnctcggtggtatctccgggtgctctgggcatactcctcctc

SEQ ID NO: 80291 - protein, 192 aa, Zea mays
  misc_feature: Ceres CLONE 1565555
  misc_feature (44)..(172): Pfam Name: PsaL Pfam Description: Photosystem I reaction centre subunit XI
  misc_feature (173)..(173): Xaa is any aa, unknown, or other
  misc_feature (180)..(180): Xaa is any aa, unknown, or other
MASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTGPLRNTPVHGQAGALGAAGLVAILSVCLTMYGVASFHEGEPVTGATLTLTGRKKRPTSCRPATAGXSHRRGLXRWYLRVLWAYSS

SEQ ID NO: 80292 - DNA, 1030 bp, Zea mays
  misc_feature: Ceres CLONE 1565557
ctccccgcggtggcggccgctctagaactagtggatcccccgggctgcaggaattcgtctcacccctagaaaaaacggcggagggaagccaagaaaaccacgccaacgaccaaagcagctgtcgataacacggcgtgctacacctgcttgcctgcctgcctgcacaaccctcagcagggccgcaggcgagagagagagagagaggaagagagacagcgcgaagcggcagcggtagccagcaaaggcggctagagctgttgcccatgcaagggcaagtcccggtcttccagcaaggagtcggcggggcgcctgcaacaaccgcagccatgggctccctctggcgggcccgcccccggcccccttctattggaaaaacggagggcgggacccaggccggggtaattggtaaagaggcgggctgtcccccaccaaatttggggtggcgggcggccccaattcacccaggcacccaaaaacccccggtaaaattatagtccccccgggcgggcgaataatacccccgggggggtgggcgcatatgatacacaaaattcaggggggccccaaaaagcgggagtggggtcgccgtaaaaaaaataacgtggggaggcgccccaacatagaaaaagaggcaacaacgcgaaacattttctctggtggtggtggtggggggtggtccaaaaaaaaaacctatcacacaggtccaccatgttattttatgattaggacgacaccccccaccactcagttaataaaaagaaggaaacagaggtatgtattatactaaatagaactccccgatacggaatattgatgaggcccttagagttcttatatattttacatccccctaacaaaaaaataaaccataccatccgctctatggggagccgcccacacgtgggaggggaggaaagaagggtgaaaagcgcaccacagcggagggggaaacaccccggtgggaaaaaacccacaataatgtaaaaagggggtaaaataatgatatgagaagagaaatatagcggtcaaa

SEQ ID NO: 80293 - DNA, 823 bp, Zea mays
  misc_feature: Ceres CLONE 1565560
  misc_feature: Encodes the peptide sequence at SEQ ID NO. 80294
  misc_feature (773)..(773): n is a, c, t, g, unknown, or other
  misc_feature (774)..(774): n is a, c, t, g, unknown, or other
agctccccgcggtggcggccgctctagaactagtggatcccccgggctgcaggaattcgtctcacccctagaaaaagcccctgtggtgtggactcctgcactgtgctccttcgtctcctcctcccctgcctgccaccaactgccaaggtgccaagcaagtgcagataccttccctgcctcacaaacaacgccatcagggtcttcaaccagggcaggttctcttctttcattcagctatgggcaacctgtgctgctgtgttcaagttgaccagtcgactgtggccatcagggagcagtttggcaagtttgacagcgtgcttgagccaggatgccactgcatgccttggttcgccggcaagcgtgtagctgggcatctcacactcaggctgcagcaactggatgtgcgctgtgagacaaaaacaaaggacaatgtttttgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagaagctgagaaggccatgtcggcttatggctttgagatcgtgcagactctcatcgtggacatcgagccagacgagcatgtgaagcgcgcaatgacgagatcacgcagctgcgaggctcagggcggctgcaaacgagaagcggaggcnngagagatcgtgcagatcaagcgcgcgaagggggaggcagaagccaagtc

SEQ ID NO: 80294 - protein, 195 aa, Zea mays
  misc_feature: Ceres CLONE 1565560
  misc_feature (8)..(194): Pfam Name: Band_7 Pfam Description: SPFH domain / Band 7 family
  misc_feature (180)..(180): Xaa is any aa, unknown, or other
MGNLCCCVQVDQSTVAIREQFGKFDSVLEPGCHCMPWFAGKRVAGHLTLRLQQLDVRCETKTKDNVFVNVVASIQYRALADKASDAFYKLSNTRSQIQAYVFDVIRASVPKLHLDDAFEQKDEIARAVEEEAEKAMSAYGFEIVQTLIVDIEPDEHVKRAMTRSRSCEAQGGCKREAEAXEIVQIKRAKGEAEAK

SEQ ID NO: 80295 - DNA, 1103 bp, Zea mays
  misc_feature: Ceres CLONE 1565561
  misc_feature: Encodes the peptide sequence at SEQ ID NO. 80296
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (65)..(65): n is a, c, t, g, unknown, or other
  misc_feature (68)..(68): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (398)..(398): n is a, c, t, g, unknown, or other
  misc_feature (526)..(526): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (543)..(543): n is a, c, t, g, unknown, or other
  misc_feature (545)..(545): n is a, c, t, g, unknown, or other
  misc_feature (547)..(547): n is a, c, t, g, unknown, or other
  misc_feature (745)..(745): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (805)..(805): n is a, c, t, g, unknown, or other
  misc_feature (861)..(861): n is a, c, t, g, unknown, or other
nnnggggggttccnnntttcttttttacaaaaaaaaaacgagaaaaaataaaaaaaaaaagtttnatnaannnnnannnnnnnnttggaactccccgcggtggcggccgctctagaatagtggatcccccgggctgcaggaattcgtctcacccctagaaaaagaacagatacacacacactcgggtaaagctatctcgagctagctagctgctgtaagccgttgccatggccaaaatggtgttgctctgcgtgctcgtctccttcctcctgatgcccttgggctccctagccctgaccaaggaatttcttgcgtcgccgacctgacctggaaggaaacccccggcgggggtccccgggcaattccagggttacccgcaaaaaaattttattttcacnggcctggcccggccgggggaaaaataaaaccccttttttaaaggccccccttgaccccgggcctttcgggggccaattctccgggggtcaaaaaggggtttgggaaaccccccccccccagtgtgagncccgggtggggnnnaananantttgggggcctgtaaaaaccccacccccggggggggagcaaaaaaaacccccctctttttggaccccaccggagagacctttttctcgcgcggaggttgtttaaaagactcggggggggtctaacaaaaaacgtccggtatccaaacaacgaaaaacactttgtacgctgtacgccggcgactcatgtgttccaaggnctgtccacatacgcgacggtggtgcttctaacagtaatcacatctannnnnnnnnnnnanaaacattgtaggataacaaaaaaaaagatagagaagtagtggctacaaaacaatantgtttatcttctctaataagagtgtggtttaaaaaacaaaagagccaatgttgtaaaacatatttaatctttgtaccctcgtttgccatgtccgagtgtttctccaactaatacatgattttatcaagagtgtagattcgagtataaataaacctatgttattctggctgagaaaaacgtttggtacggggcgtggtcgatcaaaccaatgtggtggtagaacactctggtgtatagaacaa

SEQ ID NO: 80296 - protein, 32 aa, Zea mays
  misc_feature: Ceres CLONE 1565561
MAKMVLLCVLVSFLLMPLGSLALTKEFLASPT

SEQ ID NO: 80297 - DNA, 851 bp, Zea mays
  misc_feature: Ceres CLONE 1565562
  misc_feature: Encodes the peptide sequence at SEQ ID NO. 80298
  misc_feature (465)..(465): n is a, c, t, g, unknown, or other
ctccccgcggtggcggccgctctagaactagtggatcccccgggctgcaggaattcgtctcacccctagaaaaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctgggcgtgccgggggtgctggtgccngaagcgctggggctgggcaactgggtgaaggcgcaggattgggcggccgtccccggcgggcaagccacgtacctgggcgccccgggtgcgtggggcacgctgccgaccatcctgggcggtcgagttcgggggcatcgcccttcgccgagcaccagcgcacaatggagaaaggaccccaagatgaaaaagtaccccgggggggcccttccaacccggctcgggcttctccaggggaccccgccaagcctcgaaggaataacaagccccaaggagatcaaaaaacgggccggcctcggccatgggtggggccttccgtcgggtttttggcggtccaaaaagttcgggggttaacccggggggcaccgggcgcccggtttcggaaaacc

SEQ ID NO: 80298 - protein, 225 aa, Zea mays
  misc_feature: Ceres CLONE 1565562
  misc_feature (58)..(210): Pfam Name: Chloroa_b-bind Pfam Description: Chlorophyll A-B binding protein
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLGVPGVLVPEALGLGNWVKAQDWAAVPGGQATYLGAPGAWGTLPTILGGRVRGHRPSPSTSAQWRKDPKMKKYPGGALPTRLGLLQGTPPSLEGITSPKEIKKRAGLGHGWGLPSGFWRSKKFGG

SEQ ID NO: 80299 - DNA, 889 bp, Zea mays
  misc_feature: Ceres CLONE 1565566
  misc_feature: Encodes the peptide sequence at SEQ ID NO. 80300
ctccccgcggtggcggccgctctagaactagtggatcccccgggctgcaggaattcgtctcacccctagaaaaaacatccgccagaaccctctccctccctccctccctccctccctcactcatcggcgcgccgccaatggccgtgtggtgaagcgcacccgacggaagaagcaggcaccaacagccaagccccctttgccctcgccctcgccgccgccgtccgcggaaggttgagatcccaggattcagactggtgccattcgatttgatttggcgcggggtactttcctatggccgcctccatcgcggcctcgcccttctttccagggtcgccggcgccggccgctcctaagaacggccttggggagcgcccagagagcctggacgtccgcggcgttgcggcgaagccgggagcctcgtctaatgccgtgagggcgggcaagacgcgcgcccacgctgccgtccccaaggtgaacggtgggcagtctgcggtggcggatgtggagcacgagaccataactggaccttcggcggggccgaggacttttctacaaccagcttcccaaccggagcatggctcctttgctgccatcacaaccatccttcttgggccgccagagaaacaggggaaccatgcttggattgggaagcccaaggcgggcccggaactgcctcactgaaaactttttgggggtttggccgggatccttcattgatggggcctcctgtttcagggcaaaaacttccctcctttagggctcctaatgaaaattgggggcttaaatagaaccgcgctctctttgggagaccaaaggaatgaacccttttggccaggagaaagggccccttaaatcttgtagaaaaaacccgcgtggggcctgtcttagg

SEQ ID NO: 80300 - protein, 129 aa, Zea mays
  misc_feature: Ceres CLONE 1565566
MAASIAASPFFPGSPAPAAPKNGLGERPESLDVRGVAAKPGASSNAVRAGKTRAHAAVPKVNGGQSAVADVEHETITGPSAGPRTFLQPASQPEHGSFAAITTILLGPPEKQGNHAWIGKPKAGPELPH

SEQ ID NO: 80301 - DNA, 1235 bp, Zea mays
  misc_feature: Ceres CLONE 1565567
  misc_feature: Translation starting site: 658
  misc_feature: Pfam Name: NOP5NT Pfam Description: NOP5NT (NUC127) domain
  misc_feature (54)..(54): n is a, c, t, g, unknown, or other
  misc_feature (56)..(56): n is a, c, t, g, unknown, or other
  misc_feature (554)..(554): n is a, c, t, g, unknown, or other
  misc_feature (705)..(705): n is a, c, t, g, unknown, or other
ttgaaattggaagaaccgccgcgctagaggcgggggtgacgaggggctcaatangnggtggtggggttcaatctggacctccccgcggggcggccgctctagactagtggatcccccgggctgcaggaatgcgtctcacccctagaaaaatccgccgagcgagatggcgttgtacctgctgttcgagtccgcctccggctacggcctattccatgcgtacggtgtctatgagatctggcagagctttgagggcgagcgctcctccgtgggtggaactcgaacgcttcggaaaggacggtcagtttgctgggcttaaatcctttctccctctgccggcgaccgctctcaacccgtggaaacgctttctcctgagggaactcctgaaccggtgaagtttgaggaaccctccctgggagctgaaaccggcccgaaaaccctttgggacggggaaagaaggggcaagatacgggcccgcgggggtattcgcggccccccaccaacctgaccccccccccgccccccaccccctaccccctttccccccccccgccacnaccccctaaccccccccctctccccgctaccccctaccccacgcttcgcaccccgttaccacaccaccgcaccccccctttcacccactactgccccagtaacatgggccggttccccgtttggtcttcccagcagattacccgccgcagntatctaccgcgggccgaacggaggatttctattcgggcactatcgcggcgtggggtgcgcggagtgcgagtcggataatattcgcacggtcgtgttggtagaacacacgcggtgggaatgaaagacactcccgccgctgtggggggtgcggcacacaggacgtcggtagtggtgtctcatgtaacgcgatgtagtaacatcacatctctttgttcaagtgagtgagagttgtcgttgctccgtctacgcggatgcgcggaattgcggcggggtgcgatcagtgcgggtgcgggtgagaacgttggtgccgctgtcggaattgcgagggattggcattcactcctgtaaacgtggcgagatttacacagccggggggggggcgggaggaaacttcattcagagaagacgccgcgtgatacatgctcgcggaagtgttcgagtctcaggactatctgtgctctgtcggtgatatcacacacggataggatggacttactccctggcgactgagcgcgccgcgatcgcgcatt

SEQ ID NO: 80302 - DNA, 1261 bp, Zea mays
  misc_feature: Ceres CLONE 1565568
  misc_feature: Encodes the peptide sequence at SEQ ID NO. 80303
  misc_feature (59)..(59): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1261)..(1261): n is a, c, t, g, unknown, or other
acaaataaacaaaaaaaacgtaggtggagggaggtactatatcattattgtttttgttntttgnannnnnccaaagctggagctcacctgtgtgacggccgctctctaatactggatcccccgggctgcatgaattcgtctcacccctagaaaaaacacactgatacacactctggcaccagatttgcatgctcctcggcgtctgtgccgtgctgatggtggtctgtgtcactaactccgtggatggtcaggtggcttctgtagttgtgggtctggcgaggtgcgcctacaccgcgaggaagaacatgaaggctgaggccggtttcaaggatcttcttgtggtgatcatgtagaagatcgtcaactgggaggtatgatacaaacgccgaagagagagatgcatagctccggaaatcttcgacatattattcatactctagaccctccaaggtggcgcgaatgcctacggcggagtttccctaattgggcgccaatacccactgcttttgcccctaggtcaacgagcctcctttagggtatcagtcgcacaatggtccaggggggggggcccattctgggtgccctgtagcttatgggcgtatgatgttggtgttacaacattcacccctggtattactacacaatttgaaaaaaatatatcatcacagcatcgccccagtgttccatgggaggcctctttgttcccaactgaacccatccctctgacactctattgcggaagtcgcacatcaattgaagtgttgattgggtgaaaggcatatccccgaccctcgtttttgtaacacattgaggacactaacaaatggagttggtctctctacacctctatcacacactcgcgtatatattattcaaatgacccacaaaatgatggacgcggaggggaaaaactatttcggctaaggcccccgtgtatagagcccgagattattgagtcttaaacaagaggacacaacagacgcgacatagtgggtgagagtgaccaaatagcgatttccactcagatatcacacggtgtgaggaaggtggagggttacttaggtctaaaagtcagataagaattgatgcgatatgtgtcgattcgaacaacagcacaccgggatctaaacgatgcgtcttctggtgcggcgtgtcctatctccctacactgaacgttagaacacgtactggatagaaccgggtgactaatcgattatgctgtaacaacgttctcatctcttctttcaaaatgtaactatan

SEQ ID NO: 80303 - protein, 54 aa, Zea mays
  misc_feature: Ceres CLONE 1565568
MLLGVCAVLMVVCVTNSVDGQVASVVVGLARCAYTARKNMKAEAGFKDLLVVIM

SEQ ID NO: 80304 - DNA, 868 bp, Zea mays
  misc_feature: Ceres CLONE 1565569
  misc_feature: Encodes the peptide sequence at SEQ ID NO. 80305
tggagctccccgcggtggcggccgctctagaactagtggatcccccgggctgcaggaattcgtctcacccctagaaaaaacgaaaccctagactagataaaaagttcccatttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactacaccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagcttgtcaaagctaattccattcaaggtaataaagtcaataacattgatgtagtttatactccatggtacaatttgaagaagaccccttcaatggatgtaggccaagttggttttcacaacccctaaattgctgcagaaagacgagcttgagttgcagtgcaccaacattgctgctccctgtgcacaaacaatagctccctgtgcgcctgccagggagtatcaagcccctggcttatcggttctccctacttgtaacaccttaatggcaatccgcggttcgcacccattttaaggggggaaaaagaaggacccattgaagatttggtggaaccggcttgaaaataaaaaaaaaggggggaaaccgggaaaccctggatttttaaagg

SEQ ID NO: 80305 - protein, 113 aa, Zea mays
  misc_feature: Ceres CLONE 1565569
  misc_feature (7)..(99): Pfam Name: DUF814 Pfam Description: Domain of unknown function (DUF814)
MVFYFKARPEAGDYTIFMGLDKYENEDLIKYGFPEDIWFHVDKMSSAHVYVRLNKGQSMDDMSEGLLEDCAQLVKANSIQGNKVNNIDVVYTPWYNLKKTPSMDVGQVGFHNP

SEQ ID NO: 80306 - DNA, 1000 bp, Zea mays
  misc_feature: Ceres CLONE 1565572
  misc_feature: Encodes the peptide sequence at SEQ ID NO. 80307
  misc_feature (591)..(591): n is a, c, t, g, unknown, or other
  misc_feature (1000)..(1000): n is a, c, t, g, unknown, or other
aagctggagctccccgcggtggcggccgctctagaactagtggatcccccgggctgcaggaattcgtctcacccctagaaaaactcttccgacacccacactcgtcgacgaacgacgacgacgagcacgagcacgagcagcgcctgacgctcggctccgacccgcgcgcgtcgatggcgatgagtgacacaggctcgagcttcgcgcagtgggccgcgctctaccacctccaccaccacgacgccgggccggtcctgctgccccccgacgacgacgccggcaccaccgctgcggccgccgccgtagcgagcccgacatctggcgggtccagcggaggaagccccaccgatgtcggggcccatctgctgcacggagtagaggggccgcggatcagggaagccccccgcacggcggcggtcccgcgcgtcccggcgcgcgcccggtgacggctgctgaacacaggaacggcccaaattcccgtgccctggggggcgcaatttcacggggattgcccgcggccccccccgggggggtgggttcgggggcccccgggtaagtccaatttttcccggccgaaattacgggttttcncgggcccttacctgggggcggacgggtccatggtaccctttgggaacccaccaggctttgtgggccgggggaaccgaaaggtctccccgaggggcgcctttgtccataggagagaaatctccccccacaggagccgcgaatgtgggcggcccacggcgtttcatgcggggggggccgtgcgcttctcaccaatttcgagctctattaaataacccgggggggaggtggcgggggggctcttcgtttccaaaaaaggggtggggaatattgttttttcttgaagggggagcattttccacacagggttttccgccccccctccatgcaaaacaaaaaaagatgggttccctccccaaaaggttggagggggggccctcatatgcgcccctgggtcgcgttgtatttaaan

SEQ ID NO: 80307 - protein, 90 aa, Zea mays
  misc_feature: Ceres CLONE 1565572
MAMSDTGSSFAQWAALYHLHHHDAGPVLLPPDDDAGTTAAAAAVASPTSGGSSGGSPTDVGAHLLHGVEGPRIREAPRTAAVPRVPARAR

SEQ ID NO: 80308 - DNA, 815 bp, Zea mays
  misc_feature: Ceres CLONE 1565574
  misc_feature: Encodes the peptide sequence at SEQ ID NO. 80309
ctccccgcggtggcggccgctctagaactagtggatcccccgggctgcaggaattcgtctcacccctagaaaaaatgaatatgatggcaaaggtctattgaaccttaaaccaaagaaaaaggctgcatccactggtcaagctgagacgcatgcttctgcgggtggttcgacttcgtatcaacaacacctctcctcaacgagcatgccagggtcatcaccatcaggtggaactgattccgtagggtatggtgtcgaccaatcagcaacacatctatctcaactccagagttcatccgccaatctccagacgccatacgatgacacattttcgttcctaccacctaacctgctgacagggtctgcaaacgatgccatgggtctggaactgggccagttgcaccaagtaatttctcagggccagccaattcagccagcaaacgtgggatacgttgactggcccaggaaccgcgacagccagtacgccgacgacttcacagagtacattcgcgtgaagagccaccagatgctcgagagcgaggacatgcagcagctgctgagggtcttcagcatgggtggagcctccggggagtttgtcagagcacacgttcaacttccagccctacatgccctctcccttgcccaaccccgggttcgaaagcgagcgcagccattcatccggcaaaaactgtcgtcggcttggctcaagatcaaggcggcatggaaggtggggggatcctccttcaggaaagaaagcttgccgaaagacgggcgcaagctcgtcgagctgggaaggatttaccgtcgttcttggcttc

SEQ ID NO: 80309 - protein, 204 aa, Zea mays
  misc_feature: Ceres CLONE 1565574
MPGSSPSGGTDSVGYGVDQSATHLSQLQSSSANLQTPYDDTFSFLPPNLLTGSANDAMGLELGQLHQVISQGQPIQPANVGYVDWPRNRDSQYADDFTEYIRVKSHQMLESEDMQQLLRVFSMGGASGEFVRAHVQLPALHALSLAQPRVRKRAQPFIRQKLSSAWLKIKAAWKVGGSSFRKESLPKDGRKLVELGRIYRRSWL

SEQ ID NO: 80310 - DNA, 833 bp, Zea mays
  misc_feature: Ceres CLONE 1565575
  misc_feature (492)..(492): n is a, c, t, g, unknown, or other
ctccccgcggtggcggccgctctagaactagtggatcccccgggctgcaggaattcgtctcacccctagaaaaaaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggaatgaaagccatgatcaagcagccgacaccggagaagaaccgtgaagggcgcatgggccctcaagtgcttgacgaatcatcgggctttgggaattcccaaaccttcaaactcatttatggggtggggttacaggggcaaaatgggaaaattttggaaaaccttacctcccctttggggggggggggcttttttttccttttaacccgggggggccccccccgtttttttggggggggtgttttaaaaagggggggggggggccccngtttttttttctaaaaaaaaaaaaaaacctcctcccccccccccgaaaaaaaaaggggcccccccccctctatatacgccgggggggggggggccccccccccctaaaaaaaaaaaaataaggggggcgccccccttcctgggggggggggtggggtcctcaccccctccaccacccccccccccccggggggggggggtggggacaaaacaacaaaagggtggggggggggggtgggtgtttttttcttttcttttcaaataaaaaaaaaaaaggggggggggggggggccgggcgcaccaacaacattttttttttttatttttttcccccgccccccg

SEQ ID NO: 80311 - DNA, 899 bp, Zea mays
  misc_feature: Ceres CLONE 1565581
  misc_feature: Translation starting site: 144
  misc_feature (344)..(344): n is a, c, t, g, unknown, or other
  misc_feature (354)..(354): n is a, c, t, g, unknown, or other
  misc_feature (386)..(386): n is a, c, t, g, unknown, or other
tccccgcggtggcggccgctctagaactagtggatcccccgggctgcaggaattcgtctcacccctagaaaaatccccgcacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttcccgccgccgcctcctccatgttcccaaagccgcctcctgggacgaatccgtcccccgagatggtggagatgcngaggaatccngtgcccgctgggacgaacgagacgaggacgangaagccgcggcccgagccgggtgtcctccctcgaagtccagttcgcgggccccacccgaagggctacgtcgagccccgcggcgttttgaaaagcttacgcgccggattccccaaaaaaatgggcgggcggggtaacaaatcttctctaagggggcgggccttttaagggggaaaaaaattgggggggggaaaaaattggccccccaagggccaaaggggggcccaacccccccctcacaactggaacccgggggaacacgccccccaaaaaaacaaaatttttctcccaaagccccgtctttgtgaaggggcaaaaccccggtccccacaaagaggccccaaaggggaaggagagggaaccccctccccacacccggaaaaaaaattcttcttttttggggaaaaaaataaaagggccccccctttttttgttcttccccgcgggaaaaaaaaacaccacaaaggggtttccccaagaagcgcccctccaccacaggggcgcccccattaaag

SEQ ID NO: 80312 - DNA, 813 bp, Zea mays
  misc_feature: Ceres CLONE 1565582
  misc_feature (205)..(205): n is a, c, t, g, unknown, or other
  misc_feature (273)..(273): n is a, c, t, g, unknown, or other
  misc_feature (312)..(312): n is a, c, t, g, unknown, or other
  misc_feature (313)..(313): n is a, c, t, g, unknown, or other
  misc_feature (361)..(361): n is a, c, t, g, unknown, or other
  misc_feature (364)..(364): n is a, c, t, g, unknown, or other
  misc_feature (385)..(385): n is a, c, t, g, unknown, or other
  misc_feature (416)..(416): n is a, c, t, g, unknown, or other
  misc_feature (487)..(487): n is a, c, t, g, unknown, or other
  misc_feature (567)..(567): n is a, c, t, g, unknown, or other
  misc_feature (665)..(665): n is a, c, t, g, unknown, or other
ctccccgcggtggcggccgctctagaactagtggatcccccgggctgcaggaattcgtctcacccctagaaaaagtgtgtgtgtgtgtgtgaccgtgcgtgaggcgtgagtccgtgaccattcccgtcggccgtcccaaaagaagcgcaaatttacaacccagtccaccacgggccacacaatcccaaatctaaccctccacggncgatggggatctcgagcatgccggagccgcgggacagcctgctgggggtacctggtgtacaaacacgntgatctcgatcgcggcgctggcggggctggtgcgggcgnngcgctgtgttcctggacctgcaggccgcgctgccgcccggggacgacngcnggggaccgactggcggcgtcnggcccgggactggcggagcggttcctcaggnccttccggccggcgctgtacgaggtgctgagctcacgggcgacaacgtgcgaggcggaacgcggcgccacngcacgacctgcagcgtgtgcctggcccggttccgggcgaaggccgtggtgaaccgcctcccctgcgggcacctctttcancgcgcctgcctcgagacctggctcccgtacgagcgcgccacgtgcccgctctgccgcgcccacgtgcccctcccccgcgacgaagacgcgctgctcgnctacccggagttcgagtgatccggtaaaaaacacccccggccccccaccccccggggagcggtgaacggcccccgtcgcgcgcgccctcggctgtgtgctgccaagttccgtgtgggcttcccgtgtacccgtagcaaaccaaaaaga

SEQ ID NO: 80313 - DNA, 845 bp, Zea mays
  misc_feature: Ceres CLONE 1565587
  misc_feature: Encodes the peptide sequence at SEQ ID NO. 80314
ctccccgcggtggcggccgctctagaactagtggatcccccgggctgcaggaattcgtctcacccctagaaaaacccaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcagcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctgggagaccaggcggccggcatcatgaaagcggcgcgcgccaagatcgcggcggcgcttaacaagatgaaagaaggaaaccaccgcggaactgggaggcaaacctggaacaagggaacccaccctgggggagggccaaacccctaaaaagacaacccaccaacccccaaaggccaaaaaggaagaaggctttgaaagcgcccccaaacccccaaaataccccctccccccaagggaaaaaaatccccccaaaaaagggggcccccccaccccccgcggaaaagaaaacacaccaaccc

SEQ ID NO: 80314 - protein, 181 aa, Zea mays
  misc_feature: Ceres CLONE 1565587
  misc_feature: SWISSPROT Homolog: EC 3.6.3.14 H(+)-transporting two-sector ATPase
MATALMVAATTSCSPGRAAPRLKPVASSSSSSSSSSSARPRRPLAQQLPRLLATAAAAAVAAAPLPALAEQMEKAALFDFNLTLPAIATEFLLLMVALDKLYFTPLGKFMDERDAKIRGELGDVKGASEEVKQLGDQAAGIMKAARAKIAAALNKMKEGNHRGTGRQTWNKGTHPGGGPNP

SEQ ID NO: 80315 - DNA, 792 bp, Zea mays
  misc_feature: Ceres CLONE 1565588
  misc_feature: Encodes the peptide sequence at SEQ ID NO. 80316
ctccccgcggtggcggccgctctagaactagtggatcccccgggctgcaggaattcgtctcacccctagaaaaaactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttcaaagaagagccccgttgtttttctccaattcattaaagggacttgccagttcccaaaaacgacccagggtgaaggctatagcccaaaatatttgctgacccctgggtttttcaaaatgttacaaaaaaattccttgggccggtcccggggcgaaaaatggggcggggctaaaaaattttttgaaacccctttggcgggaaaaaaattgggttgattttggaccctggggaaacaaaaaggggggggaaaaataaaaagggttttgggggcccaaagaaaaaaaaattttttttttttcccccccccccccccccggggggggggggggggggaggaagaaaaaaaaaaaaaat

SEQ ID NO: 80316 - protein, 156 aa, Zea mays
  misc_feature: Ceres CLONE 1565588
MAAARHLRSGLPLLRAHLASSESAAVAQVSRGFASQAAKPTGKEIKVPKALFGGTGNYASALFLTAAKSNALDKVESEIKAIVEASKKSPVVFLQFIKGTCQFPKTTQGEGYSPKYLLTPGFFKMLQKNSLGRSRGEKWGGAKKFFETPLAGKKLG

SEQ ID NO: 80317 - DNA, 798 bp, Zea mays
  misc_feature: Ceres CLONE 1565589
  misc_feature: SWISSPROT Homolog: EC 1.1.1.37 Malate dehydrogenase
  misc_feature (721)..(721): n is a, c, t, g, unknown, or other
ctccccgcggtggcggccgctctagaactagtggatcccccgggctgcaggaattcgtctcacccctagaaaaatagaaaaaggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggatagatcattgcaattgttggtcttcaacgctatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttccatgattgctaggggtgttatgcttggtgcagaccagcctgttattctgcacatgcttgacattccgccagcagctgaagcccttatggtgttaagatggagttggtggatgctgcgtttcctcttctgaagggagttgtgctacaactgatgttgtggaagcctgcactggggtcatgtgggcgtcatggntgggtgattcccagggaggaaggaatgaaaagaaagatgttttgtcaaaaaaggttcaatctacaatcccaagcatc

SEQ ID NO: 80318 - DNA, 839 bp, Zea mays
  misc_feature: Ceres CLONE 1565590
  misc_feature: Encodes the peptide sequence at SEQ ID NO. 80319
ggagctccccgcggtggcggccgctctagaactagtggatcccccgggctgcaggaattcgtctcacccctagaaaaaccggtcttccccatcccctcttccctttctagccttccacccttcatccacccgccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcacagaaggcagttgaaaggctcgatgggagattggtagacgggagggagatcatggtgcagtttgccaagtacggcccaaatgctgaacggattaataaagggagaatagtggagccagttccaagaccaggggggcgttccaggagtcacagtccaagacggaggtaccgtgatgattatcgagatgaccatgatagagattatagaaggcgaagtcgtagccggagtagagatagatacacccgtgacaggtacagggataggggattccgccatcctagcccgagtcgcagctacagtcctgatgattacaagaagcgtgggaagagacagtttgtcccctgaccgaagaacccctcctcgtagcccccagtcctgatgattaacaagaaggggggcaaaaaacgtgcctccccaggcaagtagagcccctagtcgctcccccca

SEQ ID NO: 80319 - protein, 185 aa, Zea mays
  misc_feature: Ceres CLONE 1565590
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGPPPPIRDTYSLLVLNITFRTTADDLFPLFDKYGEIVDIYIPRDRRTGDSRGFAFVRYKYEDEAQKAVERLDGRLVDGREIMVQFAKYGPNAERINKGRIVEPVPRPGGRSRSHSPRRRYRDDYRDDHDRDYRRRSRSRSRDRYTRDRYRDRGFRHPSPSRSYSPDDYKKRGKRQFVP

SEQ ID NO: 80320 - DNA, 848 bp, Zea mays
  misc_feature: Ceres CLONE 1565593
  misc_feature: Encodes the peptide sequence at SEQ ID NO. 80321
  misc_feature (346)..(346): n is a, c, t, g, unknown, or other
  misc_feature (427)..(427): n is a, c, t, g, unknown, or other
  misc_feature (463)..(463): n is a, c, t, g, unknown, or other
ctggagctccccgcggtggcggccgctctagaactagtggatcccccgggctgcaggaattcgtctcacccctagaaaaaccatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtcccagcgcaagtgcccgctgaacgcgctcaagttcggcgtgtgcgccgatgtgctcngcctcgtcaaaagcgaagttgggcaagtgcctgcccaagcatgctgtaccctcatcaaaagccttgcggaacttcaagccngccgtcctgctcctgcacgggcattaaaggcaaacntgctcgggggtcttccttcaattgtccccattaaagctcaaggggcctccttaaactaacgggtgggaaagtgcttgccccaagggcctaaatttgggccctttaaacaactcccggggcggtttaaccccccctaaactttttcccccttcaaaaaatatattattgccccccccccctgcattgggccaaaaatctcggctttttgggcccccccaaaaaaaatccccccccgggccccaaattggggcccccaaaatttttgtggttttcccaaaaaacctctaaaaccctttccccccccaaaaaaaatttttggggggttcaaaaattcccacaagagttttgcccccccttggtagaaaaaccccacttattttttttt

SEQ ID NO: 80321 - protein, 123 aa, Zea mays
  misc_feature: Ceres CLONE 1565593
  misc_feature (66)..(66): Xaa is any aa, unknown, or other
  misc_feature (93)..(93): Xaa is any aa, unknown, or other
  misc_feature (105)..(105): Xaa is any aa, unknown, or other
MASKAVLFLALNLLFFTVANACGNCPTPTPPVEPPPPPPAATPPPSSQRKCPLNALKFGVCADVLXLVKSEVGQVPAQACCTLIKSLAELQAXRPAPARALKANXLGGLPSIVPIKAQGASLN

SEQ ID NO: 80322 - DNA, 871 bp, Zea mays
  misc_feature: Ceres CLONE 1565594
  misc_feature: Encodes the peptide sequence at SEQ ID NO. 80323
  misc_feature (395)..(395): n is a, c, t, g, unknown, or other
  misc_feature (832)..(832): n is a, c, t, g, unknown, or other
  misc_feature (834)..(834): n is a, c, t, g, unknown, or other
  misc_feature (835)..(835): n is a, c, t, g, unknown, or other
  misc_feature (838)..(838): n is a, c, t, g, unknown, or other
ctccccgcggtggcggccgctctagaactagtggatcccccgggctgcaggaattcgtctcacccctagaaaaaatcctgtgagctgtaacgcttggaggtatgtgaactatccatataagttcctgtgagctgtctcccgctcactcggtccctgtccatccgtagcgttccattccattccatcccatccccggaaagtgcaaggacgggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgccctgccgttctctccgctcaggctgaggaccgtcacgtgcttcgtgccncaagacacggcggccccggccgctcccgtgccggcgctggacgaagaaggcagggccgcggcgggcgcgcgcgtcacggaaaaggaagcgcggaaacggtccgagcgggcgaactaacctggggggccgccgtgatgtctaaccctcggagtaaccttccatgggccttccccccccttgaactattcccttacagctgggcaaatggatggggggccaaggcgcccggagaatccaaaagcctgggcaacgttccacactactccattccgggacggaaaggccgagaaaggaatattctggacccagtgtggcccaacccgagggcctgtggacaaaccctcccctttggggaactttgagaccaaggttcaaacacccgggcagggggagaaagacccctttttaagactagagaaaaacatgtttccctacgnannaanaaagcggcccgggcggggaaatcattccttcta

SEQ ID NO: 80323 - protein, 84 aa, Zea mays
  misc_feature: Ceres CLONE 1565594
MAAAMTSFVAKNPLLAAAARRRAPPLAGRALPFSPLRLRTVTCFVPQDTAAPAAPVPALDEEGRAAAGARVTEKEARKRSERAN

SEQ ID NO: 80324 - DNA, 802 bp, Zea mays
  misc_feature: Ceres CLONE 1565595
  misc_feature: Encodes the peptide sequence at SEQ ID NO. 80325
ctccccgcggtggcggccgctctagaactagtggatcccccgggctgcaggaattcgtctcacccctagaaaaaaattgccattgcactgcgcgcgcgcacctcacatccgccgccagcaggtgccaccgccatctctgctttctctctctctctctctctctctctctctctctctctcaagcaacgcccgcctgcccgcccgccatggcgaccatagccacgatggccctgctgaagcccgccaggatcgtggcgcggtcggcgccgccgtccaccagcggcagcgtctcgctgcgcgtcccggcgcgggccaagaaggccgcggtgtccgcgtccgtgtcgtccgcgctggcgggcgccttcttctcggcgctggcgtcgtcggaacccccgctggcggcgcagcgcgtggcggacgtcgcggcggcggccgacgccgggagcgacaaccgcgggcagctgctgctcttcgtggtggcgcccgccatcgggtgggtgctctacaacatcctgcagccggcgctgaaccagctcaaccgcatgcgcagccaggccgtggtcgccggcctgggcctcggcgccgcccccgccggggatggcggccgcgcccgaagcctccgccgccgccgcggcgcaagacctcgccgctcttcgcgcttgttgcgggtgcggccgcacccggccaacgacaaccgggggctcctgctgctcatcgtcgtcacgccccccatcggatggggggttccttaaaaatcctccaggccggcgcttcaaacaggatcaaccggatggaaggtcca

SEQ ID NO: 80325 - protein, 181 aa, Zea mays
  misc_feature: Ceres CLONE 1565595
MATIATMALLKPARIVARSAPPSTSGSVSLRVPARAKKAAVSASVSSALAGAFFSALASSEPPLAAQRVADVAAAADAGSDNRGQLLLFVVAPAIGWVLYNILQPALNQLNRMRSQAVVAGLGLGAAPAGDGGRARSLRRRRGARPRRSSRLLRVRPHPANDNRGLLLLIVVTPPIGWGVP

SEQ ID NO: 80326 - DNA, 832 bp, Zea mays
  misc_feature: Ceres CLONE 1565596
  misc_feature: Encodes the peptide sequence at SEQ ID NO. 80327
ccccgcggtggcggccgctctagaactagtggatcccccgggctgcaggaattcgtctcacccctagaaaaagcatcgctccctctcaacttcctcattggccatccttcgtcttccatggagaggctccttggcggcctactactcggcttcctattattgatcgcgtcactacgaagccatgcaactcgtgctccagatcagtactggaagtctgctcttcccgacactcccatgccgagctccctctcccaactcctcaacaccccagctggtctttatcactactagatacgtgttgtatagggaggctcgtccatcgcacaaacatatatacgtaataacaccggtcgatctcttcagattccctgcgagttcataggcaagggcggcgtcggtggaggcagcagccgcaagaagcccggcggcaccacggtgggagttgggaaagggggagtgggcgttaacgttaaccctaccaaacccagcagcgccggtacaaccgctggcgctggcaaaggtggcgtcggcgtctgcgtcaatcccgggtacggcaagccgggtggcaccgcggtgggcgttggcaagggcagggttggcgtccacttgaacccgggcaagaagcccgtccacgtccccgtcagccgtttgcagtacgagtactccgaatcaggagacgctggtgcacgacgacaccagagtgacgctcttcttccgagaggaagaccctgcagccggtgagaagacgaccgtccagttcgccaactccgaaatgggctgcgcctagttcctcccacgtaacgatgccgatgacactcccgttctcgtccgc

SEQ ID NO: 80327 - protein, 57 aa, Zea mays
  misc_feature: Ceres CLONE 1565596
MERLLGGLLLGFLLLIASLRSHATRAPDQYWKSALPDTPMPSSLSQLLNTPAGLYHY

SEQ ID NO: 80328 - DNA, 922 bp, Zea mays
  misc_feature: Ceres CLONE 1565598
  misc_feature: Encodes the peptide sequence at SEQ ID NO. 80329
ctccccgcggtggcggccgctctagaactagtggatcccccgggctgcaggaattcgtctcacccctagaaaaagcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcaggcaggctcgacatcgaggtggggcggcgtcgtgccgctgcacacccaacccggggggctcaaagctccctcttcagaaccaggggcacccgtccccccccggtttctatcagctcccggcctccaacaccgttcttacacccaataagcctgttacccccggcgaaaattcattgggtgtttcccccccatggggccttgcttcccaccttcccatttacacaaagggggggcaaccgggggcccttcccctgtgaggccctcctgtgcggcctttcaagaaaaccccctaatcccccgggtctgtgaaaattcaccccaaaatttttggcgctcttttggccaaaaaaaactcccccggtcacccccattcctggtggataaaaggtccaccctttcccttagaacaaaaacctcccgggtggaaaataaaaccctaaaaaaattgtttcttctgtctcggcatggcgataataccttgtgttctttaaaaaaaacaataaaggggtggggctt

SEQ ID NO: 80329 - protein, 191 aa, Zea mays
  misc_feature: Ceres CLONE 1565598
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQGKINPLIKAAVTPAFVGQFPGVNGLGISAGRLDIEVGRRRAAAHPTRGAQSSLFRTRGTRPPPVSISSRPPTPFLHPISLLPPAKIHWVFPPHGALLPTFPFTQRGGNRGPFPCEALLCGLSRKPPNPPGL

SEQ ID NO: 80330 - DNA, 850 bp, Zea mays
  misc_feature: Ceres CLONE 1565599
ctccccgcggtggcggccgctctagaactagtggatcccccgggctgcaggaattcgtctcacccctagaaaaaccatctcacggatagctagcacaaggatagagcaagggcttgccacctaaggaaggcccgcctgacagccatggcatccaaagccgtcctcttcttggctctcaacctcctgttcttcacggcggccaacgcctgcgggtaactgcccgaccccaacgcccccgatcgagccaacggcaccgcctcctgctgctaccccacccccttcgtccagctgctaatgcccgctgaacgcgctcaacttgagcgtgtgcgccgatgtgctcagactcgtcaaaggcaaggttggcaaggtgtctgccgagccatgctgtaccctcatcaaagggattgcggacttcgagggcgccgtctgcctctgcacggccatcaaggccaacgtgctcggcgtcgtcgtccatgtcaccatcaaggtcagcgcgctcgtcaactactgtggcaagtgcgtgcccaacggctacatgtgcgcgtaagcagatacgggctggtacaccctcgtaagatgttcgcgtacaaagatatataatgcactcaccctgccatgcacgaatgcattgcctggtagtaccgctgatataatcccaccctggccaagttggtgccccctagcttttcagagtctgcaaaaccaaataaacagttcccacccaaaatacattggtcaggttcaaattccccatggaatttggtcccctctggtggaaaatcccccaataaattttggccttttgttacctctgggcacattcccctcccttaaaaaaggcccaaaaacc

SEQ ID NO: 80331 - DNA, 975 bp, Zea mays
  misc_feature: Ceres CLONE 1565600
  misc_feature: Encodes the peptide sequence at SEQ ID NO. 80332
tggagctcaccgcggtggcggccgctctagaactagtggatcccccgggctgcaggaattcgtctcacccctagaaaaagctagcacccatcttgcagcaggcggagccgcccgacccaatccgtgcgtgtgttggtcgagatggctacaacagcttacgctcccatggcgagccaggtgatgaagagcagcccgttgcactcgaggccgaggggcctgtcaggcgctgcgctcacgcggacccggccccggttcagcgtcgtcaaggccgccatcctgcccgagaaggcaacgtaccaggtggtgcagcccatcaacggcgacccgttcatcggcagcctggagacccccgtcacctccagcccgctcatcgcgtggtacctctcccaactggcgggcccaccccaccgcccgtgagcccccctgctcgggggggtacaagttcgggcctccgcccacggggtaccttccttcgttgggggcccctttgcgcttcaacgggggcccgttcccgtaaaaaagcccccttggcacggggccaaggggggggcgccgcctcggggggtcccccccgggccttccgttcgccccattccgccaggggggtgttggcgctccaccccattgtaaaagggggggtcccccccccccctttttaaaaagaaggggggcggagacccgggttcccacaggagcgccccaccgccttttaaaaggcttcccccggggccccggaaaaaaaaagggggagggccggacaaaaacttgccaaaaacccctcccaaccggttttggggcccaaagttttcccccgggaggggggttcctttccctccggggggggtgttctccccgggggggccccaaggggggaaaatattctcccccctcagacgggaaggaaaaaatccccccctatttttttggaggtgggaaaaaaacaaattccctaagagagtgcgcatttgctataag

SEQ ID NO: 80332 - protein, 83 aa, Zea mays
  misc_feature: Ceres CLONE 1565600
MASQVMKSSPLHSRPRGLSGAALTRTRPRFSVVKAAILPEKATYQVVQPINGDPFIGSLETPVTSSPLIAWYLSQLAGPPHRP

SEQ ID NO: 80333 - DNA, 792 bp, Zea mays
  misc_feature: Ceres CLONE 1565601
  misc_feature: Encodes the peptide sequence at SEQ ID NO. 80334
ctccccgcggtggcggccgctctagaactagtggatcccccgggctgcaggaattcgtctcacccctagaaaaactcatcatcgagtcatccatctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgcggggaacccgtgccccggtcaagaaccttccagaattgtgccacaatcgtcaaagggcaacttcgtcgtggtccctggaaagacagactacccatcgaaggaatgtgcgtccgcaaccctgtgtgggtcgatcaagaagcacctactagaccatttccacaagaaacctgtgccaccaaaacccaagccccagccagagtaccactctccaactccaacatatgggtcgcccacaccgatctaccaccctccggctaggcatttgtttgataagaagcccttgctagatcacttccataaggaccatgactatcaccacttcttagacacttccacaagaaaccgtgcccacaaagccaaagcta

SEQ ID NO: 80334 - protein, 226 aa, Zea mays
  misc_feature: Ceres CLONE 1565601
  misc_feature (34)..(226): Pfam Name: DUF1210 Pfam Description: Protein of unknown function (DUF1210)
MAADALRGLLPGVYAVLMVIAVTSAASSDASSVVVGLAKCADCTRKNLKAEAAFKGLEVAIKCKNSKGEYESKAMGKLDGFGAFSIPLSTDLHGADCVAQLHSAAGNPCPGQEPSRIVPQSSKGNFVVVPGKTDYPSKECASATLCGSIKKHLLDHFHKKPVPPKPKPQPEYHSPTPTYGSPTPIYHPPARHLFDKKPLLDHFHKDHDYHHFLDTSTRNRAHKAKA

SEQ ID NO: 80335 - DNA, 868 bp, Zea mays
  misc_feature: Ceres CLONE 1565602
  misc_feature: Encodes the peptide sequence at SEQ ID NO. 80336
  misc_feature (27)..(27): n is a, c, t, g, unknown, or other
  misc_feature (47)..(47): n is a, c, t, g, unknown, or other
  misc_feature (48)..(48): n is a, c, t, g, unknown, or other
  misc_feature (733)..(733): n is a, c, t, g, unknown, or other
  misc_feature (735)..(735): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
ctccaccgccggtggccggcccgctcnttagaactagtgggattccnncccgggctgcaggaattcgtctcacccctagaaaaaaccctacccaaccgccgcccatggcgtccatctcggagcccgctgctagggagaagcccatcgtcgtccgggtcaagcgcaaaccttcgcaaaaccgcccggacgctttctggctagagattaatgagagggccggcaaagaaagcggccgattgattttctcccgccttttccatcttcgaacccctctttggtcttctgccagtgtgcaaactttcaaaagaaccccggggttaaaaaaaatttttttcccagcccttcggaaaacgttacacccccctttaaaaacttccaaaaaaagtttttaaaaacccttttttcttttgtgggcccaaattccccgggggaaccaaaaagcccgacaaaagaggggggtggtgttgggcaaattttccccgggggaaaaaaaaaacccggggggtttttctttttttttttttgcctcaaaaaaaagttttttttttttttttgggaaaaaaataattcccgttttttcccccctttttttgggagagacccccccaaataaagaaaaaaaagagggggttggggggggggccccctctttaaaaaaaaaaaaaaacccccccttcttttttttagggcgcccccccccaaatccccccccccgggagagaggaaaaagaanancnnnaaaaaacaaaaacacccgttttttttttttttttatttaaagaagggggggggggttttttaaaaaaaaattttctcttcttctccctctctggaggaaaagaaaaatttctcttcttccctcccggcg

SEQ ID NO: 80336 - protein, 95 aa, Zea mays
  misc_feature: Ceres CLONE 1565602
MASISEPAAREKPIVVRVKRKPSQNRPDAFWLEINERAGKESGRLIFSRLFHLRTPLWSSASVQTFKRTPGLKKIFFPALRKTLHPPLKTSKKSF

SEQ ID NO: 80337 - DNA, 982 bp, Zea mays
  misc_feature: Ceres CLONE 1565604
  misc_feature: Translation starting site: 237
ctccccgcggtggcggccgctctagaactagtggatcccccgggctgcaggaattcgtctcacccctagaaaaagttcgtctccacgcccctctcattcgcaccgctcccacccacatcctcttcgcctctctgagtctctctctctctctctctctgcacgcctccgctccgcgtgtgcttccgttcggcggtggtttcatctcgcggaggcagcagaccacagcgccagcagccatgaccgcggccgacggggagtcctgcgcggtggtcgcgacggccgccgacatcatctgctctctccgtggtgcggacctcgccggctggaccccgccgtggcgcaagcacgaggccgcctgcgagggcgtccgtgaggaggatggcggtggcggcaaccagggcgcgtgattctggcctggcctggcggtggcccgcgggaaagcgctcgcggtccccgggcggagtccccgttcggccctcgtggctccgccggcctccccggggacgccaaaaaaagaattaaaaaaggccaaggcggatggggttcctccgaaaaagccccccgggttcaccattcttcgaagtaacagcggggcgggggccccgggggtcccggggggccgttcccaccctagtcgtggcgggtctaagggaacggaggcgcccttttcttggccttttccaaggccctttaatcccgattctgtttcccccctctcggggcccggcccatcgttgacctacggcttgcctgggagaacccggcctcctgggcctttcatatccccccggactcctcgttccccccagatatgtgggggggggggtgggccctcccgccctggaacggaggtggacaaattccttcccccggggtgggcgcgccaaccattagggcccgccacggagaaatggcggggaggcggggaaagaaaaaagagagggcctcccgcggaaatcccccctctaataggcgcgcggcg

SEQ ID NO: 80338 - DNA, 1592 bp, Zea mays
  misc_feature: Ceres CLONE 1565606
  misc_feature: Encodes the peptide sequence at SEQ ID NO. 80339
aaatctcccccttaacaactccactcccgcggaaaaaaaacccatatccctccggcataaacccaaaaaggttagcagcctcctcctactcgatctcccagatccgcactatctctgatgctacctgcttctttattactagctgtatcgatcgatcgatccagcgttgtttagctgacgagtcctgtttaattctgcgtgtttagctgcaagcagtgtgaccaaaagcaggcctgacggcgatcctcggctctctagccaggcagcaggagatggagcacgacgtgcaccaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacgggactgaggacgaaccgggccaccgagtcgggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgtacggggatgatgttggtggaggacgtcgtgggaccgccgtccatgtccatggaggacgacctcgccgcgtgcgcgctgcctccgctgatggacgtgtccggcggtggcggcgccaacatggcggcggcgtccatcgagctgctggcgccaccggcaccacacgtgacctgcttctccaacgcgctggagggccagttcttcctgaacccaccctgcctccacccctccacgtcgccgctccgcctggcgagcatggtgcaggcgcaggcgcagtacgacggcgacgcgggcatggtgctccagctcctgcaggaggccggcgggtggtacagcaagctgggcgagggggagcggctgagcggcggcgcgtcgcaggacaccggcgtcacctcggaggtgaacgtgaaccccgccgagatctcctcgacgcggcaccacataatggaccccgaggcggcctccttctggggcttctgaacttcccccacatcttttttttccgcgatcgctaaaaattggattagaattagtcactggattggaaactgggattgtaattgtgccgttgaatattgctatatgcaaaatggggcaaaaaaaacaaaaagttgtgaacgaagtgtgtgtgtatatataatatatatatgcgcgcgcgcctgtgtgcacggtactatatatcccgcgacaaaattgtatttatgatgatagaattgtgtttaaaaaaaagggtcctattttggatcggaaaaaaaaaaaaaaaaa

SEQ ID NO: 80339 - protein, 344 aa, Zea mays
  misc_feature: Ceres CLONE 1565606
  misc_feature (13)..(139): Pfam Name: NAM Pfam Description: No apical meristem (NAM) protein
MEHDVHHQQAMELPPGFRFHPTDEELITHYLARKAADARFAPRAVGEADLNKCEPWDLPSRATMGEKEWYFFCVKDRKYPTGLRTNRATESGYWKATGKDREIFRSKALVGMKKTLVFYTGRAPRGGKTGWVMHEYRLHGKHASSSRLMPSSVRAGASKDEWVLCRVFKKSIEPPPSVGKRSSVACTGMMLVEDVVGPPSMSMEDDLAACALPPLMDVSGGGGANMAAASIELLAPPAPHVTCFSNALEGQFFLNPPCLHPSTSPLRLASMVQAQAQYDGDAGMVLQLLQEAGGWYSKLGEGERLSGGASQDTGVTSEVNVNPAEISSTRHHIMDPEAASFWGF

SEQ ID NO: 80340 - DNA, 803 bp, Zea mays
  misc_feature: Ceres CLONE 1565608
  misc_feature: Encodes the peptide sequence at SEQ ID NO. 80341
  misc_feature (669)..(669): n is a, c, t, g, unknown, or other
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtgggtcaggccgggtcgcagatcttcagcgaaggtggggctggactacctcggcaacccgagcctgatccacgcgcagagcatcctcgccatctggggcctgcaggtcgtgctcatgggcgcaatcgaggggtaaccgcgtcgccgggnggcccggctcggagagggtcgtcgacccgctcctacccgggggggaggcttcgacccgcttcggcctccgccaacgaaccctgaaggcccttccccggaacctccagggggaaaggaacctcaaagacccggcc

SEQ ID NO: 80341 - protein, 173 aa, Zea mays
  misc_feature: Ceres CLONE 1565608
  misc_feature (64)..(174): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWVRPGRRSSAKVGLDYLGNPSLIHAQSILAIWGLQVVLMGAIEG

SEQ ID NO: 80342 - DNA, 893 bp, Zea mays
  misc_feature: Ceres CLONE 1565610
  misc_feature: Encodes the peptide sequence at SEQ ID NO. 80343
  misc_feature (359)..(359): n is a, c, t, g, unknown, or other
ctggagctccccgcggtggcggccgctctagaactagtggatcccccgggctgcaggaattcgtctcacccctagaaaaatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacangctctcggcgtccttaaaaaggaaaaagatcactatttgatcccagatgaccccagcgggcagtttcctcaaatatggctccaaggtccatggaaaaacctgggtaggggggaaaaagggggggagaccctccccctttccgggaaatccccccaaagggggttttatatttttccccccttggggaacacccctcccccccaaggggggggtccccccccgtgttagcggccggggaactttttttttgggggaaagaaaccccttcctcgaaaaaagggggcacgtgaaaaaaaaaaaaaagaaggggggggggctccttataataagaaaccccctttttgggggaggggaaccccccccccccccctccttttttaatggggagaaggacccccccccccctctcgagggaaaaaaaatttttgcggagaagaaagttgtttttcttttattttagagagagaaccaccccccctttttttcgtttattggagaggggtgagggggcacaccaagaagaataaaacaaat

SEQ ID NO: 80343 - protein, 68 aa, Zea mays
  misc_feature: Ceres CLONE 1565610
  misc_feature (64)..(64): Xaa is any aa, unknown, or other
MAMAARLVSRSRQLHSVQAAFANGGATQVRSFAKDAAPADRPPVGGDDLLKGIFFEVKKKFETXSRRP

SEQ ID NO: 80344 - DNA, 831 bp, Zea mays
  misc_feature: Ceres CLONE 1565612
  misc_feature: Encodes the peptide sequence at SEQ ID NO. 80345
  misc_feature (599)..(599): n is a, c, t, g, unknown, or other
  misc_feature (616)..(616): n is a, c, t, g, unknown, or other
ctccccgcggtggcggccgctctagaactagtggatcccccgggctgcaggaattcgtctcacccctagaaaaagctctgccttcccagtctcccatccctgaaaacctcacaaaaccctcgtttgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagcgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcacatggatgggatggacttctcgaattttcgtggcatgggtggtatgggcggcatgggtggcatgggtgatatgctggntatgggtggtctgtgantggggggggggaaaaggggtaaattttggtgggatgggtggggatggggaatgaatgattttaaagatgagagtgatgattaagaaaaaattggtgaaaacttcaagctggggaaaaaggttgtttaaggttaagaaaaaggaatcagcggaaaaccaaagatggggccggccccaaaacaatttaaaaaacctttggaatctaagctagattgg

SEQ ID NO: 80345 - protein, 165 aa, Zea mays
  misc_feature: Ceres CLONE 1565612
  misc_feature (5)..(79): Pfam Name: CS Pfam Description: CS domain
  misc_feature: SWISSPROT Homolog: EC 5.3.99.3 Prostaglandin-E synthase
  misc_feature (143)..(143): Xaa is any aa, unknown, or other
  misc_feature (148)..(148): Xaa is any aa, unknown, or other
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADITWMGWTSRIFVAWVVWAAWVAWVICWXWVVCXWGGGKGVNFGGMGGDGE

SEQ ID NO: 80346 - DNA, 777 bp, Zea mays
  misc_feature: Ceres CLONE 1565614
  misc_feature (188)..(188): n is a, c, t, g, unknown, or other
  misc_feature (209)..(209): n is a, c, t, g, unknown, or other
  misc_feature (210)..(210): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (431)..(431): n is a, c, t, g, unknown, or other
  misc_feature (750)..(750): n is a, c, t, g, unknown, or other
ctcaccgcggtggcggccgctctagaactagtggatcccccgggctgcaggaattcgtctcacccctagaaaaaaacgcccatctgcacgggccacgcgaagcgttcgagctcctcccacggcagccatggtcaccgccaccacctccccgctcttctccctctcctccctccgcagcctccctcccnttcacccacccgaatttcacnnacgtctctctcgctcccgaagcccctctcccacgtgcccgtctctctgccctcccttcccttttggccttccccaatttttttttccaaggcgggggtaccggggaactggggggggcaacttcagtgggtctcccccgggaaaaaggtttaaaaacacccgggggggggccccaaaaaaaatgggggtgtttcccacaaaaaaccccccnnnnccacagnggggggggggggggggggccgcgaccccctttttaaaaaaaaaggggggggggcccaaaaaaaaaaaaaaaacaccccccccccataaaaaaaaaaaccccccccccccgggggggaaaaaaaaaaccccccccccctaggaaaaaaaaaaaaaaaaagggttataacaaaaccccccctctcctaaaaaaaactttgaaaaaaaaaaaaaaaataatgtggggcccgccccccccccccggaaaaaaaaaaaatttttttttataaaaaaaaaaaatttctctactttcttttggggggggggagagaaaaaaaaaancccccccccaccaaaaaagagaggagg

SEQ ID NO: 80347 - DNA, 824 bp, Zea mays
  misc_feature: Ceres CLONE 1565617
  misc_feature: Encodes the peptide sequence at SEQ ID NO. 80348
ctggagctccccgcggtggcggccgctctagaactagtggatcccccgggctgcaggaattcgtctcacccctagaaaaagttactagtaagcatgtaaagggtggcaaggagtcaaagatggatttgcttgtgatggaaaatcttttgtttggacggaatattaccaggctctatgatctaaagggatcttcaaggtcaaggtataatgcagattcaaatggtagcaacaaggttcttcttgaccagaacttaattgaagcaatgccaacttcaccgatttttgttgggaacaaggcaaagcggctactggaaagagctgtttggaacgatacatctttcctagctggaatcgatgtgatggactattccttgcttgtgggagtcgacgaggagaaacatgaactggtcttaggaattattgattttatgaggcagtatacatgggacaagcaccttgaaacatgggtaaaatcttctggcattctaggtgggccgaagaacgcttctccaactgtcatttcacctatgcaatataagaagcggttcaggaaagccatgtctgcttattttattgtcattcctgagcaatggatgcctgcaataatcaatccaagcaaatcatcatcaaatatttgccaagaagattctcaaaatgggtctcaagagtgatatgatgttcgataagtccggttttttgtcctgtcctgtcgtgaaaagttctgaactgctagtctggcaatgccttggctgctactgttgcgtcaaagtgatattctggctgaccgcattctcttgtgctaattggcacaggtccgattgcat

SEQ ID NO: 80348 - protein, 222 aa, Zea mays
  misc_feature: Ceres CLONE 1565617
  misc_feature (4)..(190): Pfam Name: PIP5K Pfam Description: Phosphatidylinositol-4-phosphate 5-Kinase
  misc_feature: SWISSPROT Homolog: EC 2.7.1.150 1-phosphatidylinositol-3-phosphate 5-kinase
GAPRGGGRSRTSGSPGLQEFVSPLEKVTSKHVKGGKESKMDLLVMENLLFGRNITRLYDLKGSSRSRYNADSNGSNKVLLDQNLIEAMPTSPIFVGNKAKRLLERAVWNDTSFLAGIDVMDYSLLVGVDEEKHELVLGIIDFMRQYTWDKHLETWVKSSGILGGPKNASPTVISPMQYKKRFRKAMSAYFIVIPEQWMPAIINPSKSSSNICQEDSQNGSQE

SEQ ID NO: 80349 - DNA, 847 bp, Zea mays
  misc_feature: Ceres CLONE 1565618
  misc_feature (378)..(378): n is a, c, t, g, unknown, or other
ctccccgcggtggcggccgctctagaactagtggatcccccgggctgcaggaattcgtctcacccctagaaaaattgtgctgattaatttgctgaggcctttggacccttcaagatggccatcgcctacaccaacggagtctcttgctgtaaaaaatcagaagttttcagacttagttgtcaaatgtttaattaagttgacgaaggttcttcagagtacaatatatgaagttgaccttgatcgaattcttcagagcatccatatttatttacaagaacttgggatggaagaaatacggagaagggctggtgctgatgacaagccattgagaatggtcaaaactgtcttgcatgaacttgtgaagcttccggaacggcnataaaaggtcaccttttcatggttcctatagatgctggacctcagcccataattctagcttacattgatcctcatctccagacccttgcagccgctagaatgttgacgccatcgggggctaatggttcaaactcccctgggggggatgctgcttcgaaccattccaaatccatcttactaccttcagtggacccccaattgaaaacaaaaacttggctgctttttttcaaaaaaaatggggggaaaagcaaaccgttccccttggccccccttgaaactgttttcgaaaaacccaccccttccccaaagggtgaatatttttgccccccctccaaaaagcttgtgaaaccctttaaaacccttttttaaaaatgggcccccccccgggggggaaaaaaaacccccccccgggaaaaaagcccccccacgctttttatttttccccccccccccccaaataggaaaaaca

SEQ ID NO: 80350 - DNA, 814 bp, Zea mays
  misc_feature: Ceres CLONE 1565619
  misc_feature: Encodes the peptide sequence at SEQ ID NO. 80351
  misc_feature (496)..(496): n is a, c, t, g, unknown, or other
  misc_feature (550)..(550): n is a, c, t, g, unknown, or other
  misc_feature (555)..(555): n is a, c, t, g, unknown, or other
  misc_feature (575)..(575): n is a, c, t, g, unknown, or other
  misc_feature (576)..(576): n is a, c, t, g, unknown, or other
tggagctccccgcggtggcggccgctctagaactagtggatcccccgggctgcaggaattcgtctcacccctagaaaaaagcccagcaccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattggggggtggtgatgatgctttcaacaccttcttcagtgagactggtgctgggaagcacgtccctcgtgctgtttttgttgaccttgaaccaactgtcatcgatgaggtgaggactgggcacctacgccagctcttccaccctgagcagcttatcagtggcaaggaggatgcangcaacaacttcgcccgtggtcactacaccattggcaaggagattggtgacctgntgccntgatcgcatcaggaagcttnngcgacactgcactgggtctcaggggcttcctcggtctcaacgctggttgggggaggaacagctctgggcctgggtccctcctcctggaacgtctgtctgttgactacggcaaaaagtccaggcttggtttcccggggtaccccatccccccaaagttcaaccccggggggtggagcataaaaaagggtccgggccaccaatccccctcccgaggaaacggagtggggctatcccgcgg

SEQ ID NO: 80351 - protein, 92 aa, Zea mays
  misc_feature: Ceres CLONE 1565619
  misc_feature (73)..(73): Xaa is any aa, unknown, or other
  misc_feature (91)..(91): Xaa is any aa, unknown, or other
MAFRLMVRCPVTRPLGGGDDAFNTFFSETGAGKHVPRAVFVDLEPTVIDEVRTGHLRQLFHPEQLISGKEDAXNNFARGHYTIGKEIGDLXP

SEQ ID NO: 80352 - DNA, 807 bp, Zea mays
  misc_feature: Ceres CLONE 1565620
  misc_feature: SWISSPROT Homolog: EC 2.4.1.14 Sucrose-phosphate synthase
  misc_feature (780)..(780): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
ctccccgcggtggcggccgctctagaactagtggatcccccgggctgcaggaattcgtctcacccctagaaaaacacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacatcaaaaaggatgtgccaggtgagaatggtaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgatctttgttatccatcttcaagctctgaggacatgcttaaccctgctgagctcccattcatgattgatcttgattatcactcccaaattgaatatcgctgggggaggagaaggtttaaggaagacattaattncgtgggcagctgagaaattagtnnnna

SEQ ID NO: 80353 - DNA, 805 bp, Zea mays
  misc_feature: Ceres CLONE 1565623
ctccccgcggtggcggccgctctagaactagtggatcccccgggctgcaggaattcgtctcacccctagaaaaacatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaaatcaaaagaagggaaagtggggattacatttggatgaattccttagggaagactttcccaaagaaaataaggcctaagtaagcgctctttgcccttggtttgagcaaaccgaattctgtttcaccaaggaaaagaaaaaattccgggaaaaattgaaaaaggcaacttgaatttgacaaattccggtcccgcccttttcccatttaaggggggacacaattttgggtttccggctttaacaaaaaataaaatttttttttgggacctttccttaaaaaaaaaaagagcccttattcccaatttttggggaattttgggggttttcgggagaattttttccccccccggtgg

SEQ ID NO: 80354 - DNA, 1202 bp, Zea mays
  misc_feature: Ceres CLONE 1565624
  misc_feature: Encodes the peptide sequence at SEQ ID NO. 80355
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (55)..(55): n is a, c, t, g, unknown, or other
  misc_feature (70)..(70): n is a, c, t, g, unknown, or other
  misc_feature (325)..(325): n is a, c, t, g, unknown, or other
  misc_feature (668)..(668): n is a, c, t, g, unknown, or other
  misc_feature (860)..(860): n is a, c, t, g, unknown, or other
  misc_feature (892)..(892): n is a, c, t, g, unknown, or other
nnnnccccnnccccccggcgtctacataaaaaagaaatagacaaaaggacaaagntcgctcgtcaacaanttttatagtggagctccccgcggtggcggccgctctagaactagtggatcccccgggctgcaggaagtcgtctcacccctagaaaaatcatcatcgagtcatccatctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcnccaggaaaaacttgaaggccgaggcggcattcaagggtcttgaggtggcgatcaagtgcaagaacggtaaaggcgagtacgaaagcaaggccatgggcaagcttgatgggttcggcgccttcggcatcccacttaagcaggaacgtgaaggcccccaactgcgttgcaaagactccaccagcactgcgggggaacccgttggcccccgggccaaaaaaccctttccccaaaatttgtgcccacaaaatccttccaaaaggggcaaccttcgcttccgcgggtccccgttgggaaaaagaacagaaaactaccccaccttccctaaaaggaaatgtgagggcgntcaccgagaacaacaccctttatggtgaggtggggatccccgcatctcaaaataaaagataccacccaccaatacggtaaagaaaacacccatattttttctcccccacactcaggaaaacagagccctgtgggtgtgggcgcccaccacccacaaataaaaaccgccgaagaaagccccacctcacacaanccgcagagaaaaagagaaacaccaaatctctncttacccacagagaattctccaaaaataatataaagagtggtgggatgctacgcccacctacaccactcatatatatttaagcacacctctgaactcgggggattaaggccgcctcttggtttctctagcgaagagatgaaagaacgaccgttgggtagaaaaataaaacacttccaccaaaagaggaagcaccggaaaacagtttatcgccactcagttgaaagaaccaaccttctcgagaggagatacaccgcgtggcacagaaaaaacgaataaccagagtgacccgtcggcccaccgccccataaa

SEQ ID NO: 80355 - protein, 166 aa, Zea mays
  misc_feature: Ceres CLONE 1565624
  misc_feature (34)..(164): Pfam Name: DUF1210 Pfam Description: Protein of unknown function (DUF1210)
  misc_feature (44)..(44): Xaa is any aa, unknown, or other
  misc_feature (158)..(158): Xaa is any aa, unknown, or other
MAADALRGLLPGVYAVLMVIAVTSAASSDASSVVVGLAKCADCXRKNLKAEAAFKGLEVAIKCKNGKGEYESKAMGKLDGFGAFGIPLKQEREGPQLRCKDSTSTAGEPVGPRAKKPFPQNLCPQNPSKRGNLRFRGSPLGKRTENYPTFPKRKCEGXHREQHPLW

SEQ ID NO: 80356 - DNA, 1087 bp, Zea mays
  misc_feature: Ceres CLONE 1565628
  misc_feature: Encodes the peptide sequence at SEQ ID NO. 80357
aaaaaagaaaaatataataggggtgagaaaaaattattataaacaagcgttggaaaaaaagggggtggttttttttaaattggtgctcaccgcggtggcggccgctctagaactagtggatcccccgggctgcaggaattcgtctcacccctagaaaaaagtcgcgacccggacgcgactagtacactgcctgccaaacagctgagcagagtagagtagagcagagggcgaagtgcagcgcagtgtgccccgtctcggaacagcgcggaccaccagagcgtgcgcgtccgtgccccacccctccctctctatccatggcggtcccccgcgggtgcctcgggctccccctggtcgccgtgctcctcgcgtccctctgccgcggccaggcgggcggtgagggagctcaaggtcgggtactaccccgagacgtgcccggaggccgaggacatcgtccgtgagaccatggcgcgcgcgcgcacacacgaagggccgcagcgtcgccctccgtcatgggccatccagttcccacgaactgcttcgtcaaaggggggcgaacggcctccgtggctaaagggacccccaccccccaacaaatgccccgggctgaaaaggaatgccgcctctcccaaaaatacaaactctccctggcggctcccttttcaaaagggtccgtccaggcaaaaaattcacaggggacccccccctaggaaagggaaggggactctgccccccccgggaagggggggagtaccccccgggggagcccgtaaaaaaatccgtgccattttaaggggggcgccgcccccgggggaaaagctccccgttctcattcccttggaaacgccggctgggagggcccttaaatctggggggaaagagtgggtcgggtttttctgggccgccctaagggagcaacgctattgggagagggctctagccccgcggggagggaaaccgcggacacacatattccgtgtcccgagagacccgctcgggcgaaaaagacgagaatggcgtctctttttcacgggtgttcttatgcggggggagtctaacctatatatggttacccgaacacagggataaa

SEQ ID NO: 80357 - protein, 65 aa, Zea mays
  misc_feature: Ceres CLONE 1565628
MGHPVPTNCFVKGGRTASVAKGTPTPQQMPRAEKECRLSQKYKLSLAAPFSKGSVQAKNSQGTPP

SEQ ID NO: 80358 - DNA, 740 bp, Zea mays
  misc_feature: Ceres CLONE 1565629
  misc_feature: Translation starting site: 183
  misc_feature (406)..(406): n is a, c, t, g, unknown, or other
  misc_feature (417)..(417): n is a, c, t, g, unknown, or other
  misc_feature (429)..(429): n is a, c, t, g, unknown, or other
  misc_feature (455)..(455): n is a, c, t, g, unknown, or other
ctccccgcggtggcggccgctctagaactagtggatcccccgggctgcaggaattcgtctcacccctagaaaaaaaggagacgtacgctctctgctagcacccatcgtcttgcagcaggcggagccgcccgacccgatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtacccaggtggtgcagcccatcaacggcgaccccgttcatcggcagcctggagacgcccgtcacctccagcccgctcatcgcgtggtacctctcnaacctggcggnctaccgcaccgncgtgagcccgctgctgccgggcgtcnaaggcgggcctcgccaacggctaccttcctcgtcggggcctttcgggtttacggggcccggtccgaaaaacgccccgttgaacgggccaggggggggggcgcccttgggggcccccgggccttttttccccattccttaaggggttggccttaccagttgtagggggttccccctccctttaaaaagggggggaacccccgttccagggggggcccacaggttttatggtttttaaagggggggcgaaaaaaaaaagagggggccccaaaaaaattgtttaaaaa

SEQ ID NO: 80359 - DNA, 1051 bp, Zea mays
  misc_feature: Ceres CLONE 1565630
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (255)..(255): n is a, c, t, g, unknown, or other
  misc_feature (761)..(761): n is a, c, t, g, unknown, or other
  misc_feature (763)..(763): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnccccccnnnnaaaaagtggagctccccccggtggcggccgctctagaactagtggatcccccgggctgcaggaattcgtctcaccccagaaaaaaggttaaagcgacgccgccgccgcaagccgtccgccttgcccttcacgaaggcttggtcctcctccttgtatcntcactccccccttcacagatcccgttcctccagctaggggttagcggttctcctgcagcgaatggcgatcaaagcggactaaggccgaaaaaaaagatcccgtaccaacagaaagcctgccaccctgctccaatgaattacccaaggggctcattgccccggtccaaaaaaattgggtttccaagagattcccgggaaatccccccgggggccccccggggggaaaacccgggggggcctcttggggaaaaaaaaacccccctttcaggggttttgttcacaggggggtgccccccaaaaaaaaccgtggaacccccccccttttttaccccccctttgggaaaacccccccggggggggaaaaaaaaaaaggtttctttttttttttcttttggggggggggagccccctccccccgggggggggcccccccaaaaagaaacccccccccccaaaacaaaaaaaatggggggggggggcccccccccccccccccccctgtgtgngnggggggggccccccccccccccccacaaagaatgttttgtggtgttgccccccccccccccccacaaacaaggagggggggggggggtggggtgtgtttccaacaaaaaaaaaatttttatttttttttttttggggggggggggggggggggggccccccccccccccccccttataaaaaaaaaaaaaaaaacaccccccccgccgagaaaaaaatataacaaaaaaccacccccccccgggggggggtgttgttattttttaaaaaagggggggggaggagaaga

SEQ ID NO: 80360 - DNA, 892 bp, Zea mays
  misc_feature: Ceres CLONE 1565635
  misc_feature: Translation starting site: 115
  misc_feature (890)..(890): n is a, c, t, g, unknown, or other
cggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttcccacccccccgaggtgccggattacctcaccggagaggtccctggagactatggctacaacccttttggcctggggcaagaagccagaggacttcgccaagtaccagggcctacgaggctgatccttgcccagatggggccatgcttcggggccccctgggggctgttattcccaaaaggcctgcaaacaaggttcgggcgctaaactgggggcccctgaaggcttgttctgggttcaaaaaaccgggcccgccttgcttcctgggaccggcaaaccccccctcaacttacctttgggcaaacaggcatccccccaactcaaacgggggggggggggcccgggaatcccccggaaggttaatccccccctccgggggggcgtccaaagttccaccccgggattcacccaacgggactgggaaccctgaagggaaaaaacccgtgccccccccggtggggccccctttcaaccccccctgggggccctggggccgggaaacccccaaaccacggcccgccctctccctagaggggggaangg

SEQ ID NO: 80361 - DNA, 819 bp, Zea mays
  misc_feature: Ceres CLONE 1565636
  misc_feature (574)..(574): n is a, c, t, g, unknown, or other
  misc_feature (608)..(608): n is a, c, t, g, unknown, or other
  misc_feature (697)..(697): n is a, c, t, g, unknown, or other
  misc_feature (767)..(767): n is a, c, t, g, unknown, or other
  misc_feature (768)..(768): n is a, c, t, g, unknown, or other
ctccccgcggtggcggccgctctagaactagtggatcccccgggctgcaggaattcgtctcacccctagaaaaaacggcacggcggacgcgctcgcctctcctctcctctcatctcctctcctcttcttccggctctccctctccgcatgccattccaacgcattaccggtatttttagccgccggaggagacgggtagctgcgtagccactagcgagagagagagggaggggagaaacatagctcctggccgttctgccctgcccatcacgcggcgcgggcgtccgtctccggtcacatccctcctcctctcctgcaagtccctgtgccgtatggtatgctaactcggctcccgggggattcccccctcatccgaaaatttaatgccccccggaaaggggttttaaaaccgggggcccccttttgggggaaatttgggcccccccccaaaaccccaaaaagggggccgaaaaatccgaaaattccgaaaactcccaaaaaaaaaaaaaaagggggggggggtgtcccccctccaggggggcgcccccccggggggggggtttttttggggaanaccccactctccccgccccccaaaaaaaaaaggnaaaaaaaaaaaggggtggggtggtgcgggaaaacaccccggaggggtgggggggcccccccccacatttttttggggggggcccgcccnaaaaatttatatatttttttcccccccccccccgaggaatatttgtttgtgtgggaaaaaaaccccaaannaacatccccccccccccccgggggggggggcgccccccctccttccccaaa

SEQ ID NO: 80362 - DNA, 830 bp, Zea mays
  misc_feature: Ceres CLONE 1565638
  misc_feature: Encodes the peptide sequence at SEQ ID NO. 80363
  misc_feature (589)..(589): n is a, c, t, g, unknown, or other
  misc_feature (652)..(652): n is a, c, t, g, unknown, or other
ctccccgcggtggcggccgctctagaactagtggatcccccgggctgcaggaattcgtctcacccctagaaaaactccaatccaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaagaagtcgtggatcccggccatcaagagcgacgccgagatcgtgaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatccccgtggttcgaggccgggcgcgacccgagcgccatcgcgcccttctccttcgggtcgctgctgggcacgcagctgctgctgatggggtggggtggagtcaaaagcgntgggtggacttcctcaacccggactcccagggccgtggagtggggcaaccccttggtcccgcnaccgccgaaaacttcgctaacttcaccgggcgagcaaggctaccccgggcggaaggttcttcgacccgctcgccctcggcgggcaccgtaaaagaacggggtctacatccccgaacgtcgaaaaagctcgagggggctcaagctgggccaaaatcaaggcacgcccccatcgcccatg

SEQ ID NO: 80363 - protein, 231 aa, Zea mays
  misc_feature: Ceres CLONE 1565638
  misc_feature (58)..(186): Pfam Name: Chloroa_b-bind Pfam Description: Chlorophyll A-B binding protein
MALAPTSAAVLKTPFLGARRALANAAAKPAPRRALVVAAAAAAKKSWIPAIKSDAEIVNPPWLDGSLPGDFGFDPLGLGKDPAFLKWYREAELIHGRWAMAAVLGIFVGQAWSGIPVVRGRARPERHRALLLRVAAGHAAAADGVGWSQKRWVDFLNPDSQGRGVGQPLGPATAENFANFTGRARLPRAEGSSTRSPSAGTVKERGLHPRTSKKLEGAQAGPKSRHAPIAH

SEQ ID NO: 80364 - DNA, 858 bp, Zea mays
  misc_feature: Ceres CLONE 1565645
  misc_feature: Encodes the peptide sequence at SEQ ID NO. 80365
  misc_feature (588)..(588): n is a, c, t, g, unknown, or other
  misc_feature (678)..(678): n is a, c, t, g, unknown, or other
  misc_feature (706)..(706): n is a, c, t, g, unknown, or other
  misc_feature (770)..(770): n is a, c, t, g, unknown, or other
ctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtgggtcaaggccgggctccagatcttcagcgagggtggactggactacntcgggaacccgagcctcattcacgcgcagagcatcctcgccatctgggcctgccaggtcgtgctcatgggcgcccttcgaggggtaacgnatcgccggcggcccgttcggggaggtcntccacccttttatccggggggaagtttagacccgttggccttccaaaaaacccggaggctttgnttgagctcagggagaaggagtcaaaaagggcgccctccccatgttccccagtttgggatttttttcaaggcctattccccggggaagg

SEQ ID NO: 80365 - protein, 236 aa, Zea mays
  misc_feature: Ceres CLONE 1565645
  misc_feature (65)..(217): Pfam Name: Chloroa_b-bind Pfam Description: Chlorophyll A-B binding protein
  misc_feature (147)..(147): Xaa is any aa, unknown, or other
  misc_feature (177)..(177): Xaa is any aa, unknown, or other
  misc_feature (186)..(186): Xaa is any aa, unknown, or other
  misc_feature (207)..(207): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWVKAGLQIFSEGGLDYXGNPSLIHAQSILAIWACQVVLMGALRGVTXRRRPVRGGXPPFYPGGSLDPLAFQKTRRLXLSSGRRSQKGRPPHVPQFGIFFKAYSPGK

SEQ ID NO: 80366 - DNA, 1173 bp, Zea mays
  misc_feature: Ceres CLONE 1565646
  misc_feature: Encodes the peptide sequence at SEQ ID NO. 80367
  misc_feature (752)..(752): n is a, c, t, g, unknown, or other
gacattaacccccgctttattaaatgtgatcgctccccacccccccccccctttgttcctgttattctctatcctacaaaatggaactccccgcggtggcggccgctctagaatagtggatcccccgggctgcaggaattcgtctcacccctagaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaaggcgtccaagcaggcgtccccaccctgctcaagttaccaactcccacgccttcggcaatctttccaaatgcccaaaggttcaaagcccccgtccgggcggaacaaaccgcccatttcttccccttcccaaaccgggcaaaagggtcccattccaaaagggctcccgtgtgggttccccaaaaacccgcccaaaaaaccccctcccaggtgtaaaaaaccctctttggttccccctatagtggaggggtgggnccaaaaaaaaaatctctcttcgtggggggataatattctataatataagaccaccctctcgcgcggtatttaaaatattcttatagatgagggtgtggggatatacacaccgacggggcgggggggagccctcctattttttccttaacttcgcaaataacccccccgcccattaaaagaagagggcgcctctctccccctggggggggaataaaaaaaccacaacctcttttcttctcccccctaacattatgcgcggagaggggcctcctccccacaaaaaaaaaaagagggggggtttttctctccactcatatatgtagagtgggggcccacccctcccgtgctcagtaatggtatgggtgggacaaaaataatcatcctcccaccactcaattatttctgtgtcatatatttcgcg

SEQ ID NO: 80367 - protein, 183 aa, Zea mays
  misc_feature: Ceres CLONE 1565646
  misc_feature: SWISSPROT Homolog: EC 1.2.1.13 Glyceraldehyde-3-phosphate dehydrogenase (NADP(+)) (phosphorylating)
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGRRPSRRPHPAQVTNSHAFGNLSKCPKVQSPRPGGTNRPFLPLPKPGKRVPFQKGSRVGSPKTRPKNPLPGVKNPLWFPL

SEQ ID NO: 80368 - DNA, 864 bp, Zea mays
  misc_feature: Ceres CLONE 1565647
  misc_feature: Encodes the peptide sequence at SEQ ID NO. 80369
  misc_feature (581)..(581): n is a, c, t, g, unknown, or other
  misc_feature (607)..(607): n is a, c, t, g, unknown, or other
gagctccccgcggtggcggccgctctagaactagtggatcccccgggctgcaggaattcgtctcacccctagaaaaaattacagtgagtgggggcagcccccctgagccaagcagaatcctcgcctcgtgaatgcagcacctggccgccgtgctcctcgtcttggtggttaccaccgcgctgccgcccggcgtggtggcgtggggcccgtggccgccgcgtgacaacgcgacggctgtggcgggctttggacgcgtccaagaggctggagggctcttacgacttcgtgaagctggagtaccatatgggccctgtcctggcgaccgccatcatggtgcaccccatctggtacgggccctgggcagctgcgcataagcacaggatccgcgcgttcctccgctacgtgtcgccttctgtaggcattttttcgccgtgtgtgtctgcttggtggcatacggtgcggctgtaccttgaccacacctcggcgaacgtgtcggcgtctgtgtctctgggcgcgcagagtcggacgctcgcatgtcgcgatggtagcggctgtctcgcatggacatctatgcagtgacnagctacgccatgacggagcgaaatcngccgctactcgtggacgacaacagccgctgtgtacctggtgttagagtcccaggatgacgtcgtctaggacttctgcaggtaggtgtgcggcttacactacttgaccttttcgtcaagtgacagagtctatctgcccgtacatctgggttgggcaatggggcacctcatgtaccacgagttgtgtcccgtacccggctcgcggtccccggtctacgtgggtaaggggcaaaggtccgagttaccgtcctagggggga

SEQ ID NO: 80369 - protein, 91 aa, Zea mays
  misc_feature: Ceres CLONE 1565647
MGPVLATAIMVHPIWYGPWAAAHKHRIRAFLRYVSPSVGIFSPCVSAWWHTVRLYLDHTSANVSASVSLGAQSRTLACRDGSGCLAWTSMQ

SEQ ID NO: 80370 - DNA, 827 bp, Zea mays
  misc_feature: Ceres CLONE 1565648
  misc_feature: Encodes the peptide sequence at SEQ ID NO. 80371
  misc_feature (627)..(627): n is a, c, t, g, unknown, or other
ctggagctccccgcggtggcggccgctctagaactagtggatcccccgggctgcaggaattcgtctcacccctagaaaaaaggctattgccgccgccgccctacaccagatgcccagttcttcgtcagccccttctccggcaacgagcacctaacaggctgaaaaaaaatcattgatacacgtacgccgtcagaggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattaaagcactcagacaaagaacgagtgctccaatcaaagatgtcaaggcctctctagttacctgcaactgggatattgaagctgcacagaaggaccctaggaaagagaggtgttgctcttgctgcccaaaagtctcacgcactgctgctgaaagtttgctagctatcgcaacagatgacaaaaggcctgctgtagttgaagctaactgttgaaactgatttcgntagcagaaaatgatgtttttccaggacccgggctttcatcatttggcaaagaagggctttaacttgcctcagggtgctggggggaaattgttcaaggcccctttggggccccggaccttttaaaaaaaaaaggcctattaaatttaaaaacccccccaaagccccgggggggaaaaaacacttttcccaaaagggccctt

SEQ ID NO: 80371 - protein, 132 aa, Zea mays
  misc_feature: Ceres CLONE 1565648
MAWGQGAKRSILGLLFRSQHQTARAYSSSAFQTHQLSTHVPQDGVFIRRFGSEVSSSEQMNLIKALRQRTSAPIKDVKASLVTCNWDIEAAQKDPRKERCCSCCPKVSRTAAESLLAIATDDKRPAVVEANC

SEQ ID NO: 80372 - DNA, 859 bp, Zea mays
  misc_feature: Ceres CLONE 1565649
  misc_feature: Encodes the peptide sequence at SEQ ID NO. 80373
ctccccgcggtggcggccgctctagaactagtggatcccccgggctgcaggaattcgtctcacccctagaaaaagcgccccaaacccagggcagagtcgcagggtgacggggagagcccatcatggcgccgcagcagccgtgaagcacaagagcttttctgcagcacgacggctttgtcctctctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaagggcaagcgcgtctgcgcggaacacccgcacgtcaagggggagacgatggtggagagcggggacccccgggaagtcatctgcggacccgccaacaagaatggcgccggacctgcttctctggggcagcatgggtacggctttaatcccaaaggggttctttggggagggtcagcaaacaatgggggcgcaaaaatgaaaaaggccgggccccccttttttaaaagggcccagggagtagaagagggccccccccatgaacccggcccactttacccaaataag

SEQ ID NO: 80373 - protein, 183 aa, Zea mays
  misc_feature: Ceres CLONE 1565649
METAAVAAAGAGRRIMVAVDEGEESLHALNWCLANVVSPAGGDTLVLVHARRPRPVYAAMDSAGYMMTSDVLASVERHANAVSAAAVDKGKRVCAEHPHVKGETMVESGDPREVICGPANKNGAGPASLGQHGYGFNPKGVLWGGSANNGGAKMKKAGPPFFKRAQGVEEGPPHEPGPLYPNK

SEQ ID NO: 80374 - DNA, 823 bp, Zea mays
  misc_feature: Ceres CLONE 1565650
  misc_feature: Encodes the peptide sequence at SEQ ID NO. 80375
  misc_feature (571)..(571): n is a, c, t, g, unknown, or other
  misc_feature (575)..(575): n is a, c, t, g, unknown, or other
  misc_feature (576)..(576): n is a, c, t, g, unknown, or other
  misc_feature (781)..(781): n is a, c, t, g, unknown, or other
ggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactnactnncgcaaccgagccctgatcacgcgcagagcatcctcgccatctgggccctgcaggtcgtgctcatgggcgccatcgaggggtaccgcgttcgcggcggcccgctcggaaaggtcgtcgacccgctctaccccgggggagctttcgaacggtttggcctcgccgacaaccctgaaggcttcgcggagctcaggtgaaaggagctcangaccgccgcctcgccctgttccccccggttgggggttcttta

SEQ ID NO: 80375 - protein, 210 aa, Zea mays
  misc_feature: Ceres CLONE 1565650
  misc_feature (64)..(211): Pfam Name: Chloroa_b-bind Pfam Description: Chlorophyll A-B binding protein
  misc_feature (145)..(145): Xaa is any aa, unknown, or other
  misc_feature (147)..(147): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDXLXQPSPDHAQSILAIWALQVVLMGAIEGYRVRGGPLGKVVDPLYPGGAFERFGLADNPEGFAELR

SEQ ID NO: 80376 - DNA, 760 bp, Zea mays
  misc_feature: Ceres CLONE 1565651
  misc_feature: Encodes the peptide sequence at SEQ ID NO. 80377
ggagctccccgcggtggcggccgctctagaactagtggatcccccgggctgcaggaattcgtctcacccctagaaaaaaaacaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaagggacctgtcacgggcacctacatgccgtccacctccctcaccggcgggctacccgcgtctgctcggtacctggacccctccgagcccacccacaccaagggtgagcagctgctcttctccttcctgctctcccgaaagacgaagtgatccccacctttcggttcaaatttttccttggttccttgccaacgggggaggccggagctggccaaaggggcggcaaggggcaaattttcaaaaggtttaaggaaagttcccctccttttggaattttattggggggaagggccc

SEQ ID NO: 80377 - protein, 140 aa, Zea mays
  misc_feature: Ceres CLONE 1565651
  misc_feature: SWISSPROT Homolog: EC 4.2.1.92 Hydroperoxide dehydratase
MASSDHGSTTAPKDVPGSYGLPLVGAVRDRLDFYYFQGQDKYFESRVERYGSTVVRMNVPPGPFMARDPRVVAVLDAKSFPVLFDMDKVEKKGPVTGTYMPSTSLTGGLPASARYLDPSEPTHTKGEQLLFSFLLSRKTK

SEQ ID NO: 80378 - DNA, 815 bp, Zea mays
  misc_feature: Ceres CLONE 1565652
  misc_feature: Encodes the peptide sequence at SEQ ID NO. 80379
  misc_feature (338)..(338): n is a, c, t, g, unknown, or other
  misc_feature (351)..(351): n is a, c, t, g, unknown, or other
  misc_feature (368)..(368): n is a, c, t, g, unknown, or other
  misc_feature (380)..(380): n is a, c, t, g, unknown, or other
  misc_feature (381)..(381): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (582)..(582): n is a, c, t, g, unknown, or other
  misc_feature (749)..(749): n is a, c, t, g, unknown, or other
  misc_feature (750)..(750): n is a, c, t, g, unknown, or other
ggagctccccgcggtggcggccgctctagaactagtggatcccccgggctgcaggaattcgtctcacccctagaaaaaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagnctagtcatccttngccgacgacgatccatngtctctgtatcnntgcgtctgttcatatgccctgattgccgacctgnnntgctgtatgtaggttgctttgaatttcaggtcgggggtttttggctacccgtaaccccacccccaatggcattcaatcttggtcaccccgcgaacccccaattaattccttaggtaaaataacccaagttttccaaaaagatttggattttccaaaaannnnggngccaattagttttgtatatacacttcgtttattattaatgtatgggggtgccgaaaattatatttgcgtgctaaaagatcttatacaagacccaaaaagaaggaggggggggggaatttttttcccccccccggggggggcggggggcccccccttccttctataanntttttttccctcctctcccccccctcccgacgggagagggtaagaatcttggttttcgcggcggg

SEQ ID NO: 80379 - protein, 58 aa, Zea mays; identical to SEQ ID NO: 46528
  misc_feature: Ceres CLONE 1565652
  misc_feature (6)..(56): Pfam Name: UPF0057 Pfam Description: Uncharacterized protein family UPF0057

SEQ ID NO: 80380 - DNA, 1259 bp, Zea mays
  misc_feature: Ceres CLONE 1565653
  misc_feature: Encodes the peptide sequence at SEQ ID NO. 80381
  misc_feature (794)..(794): n is a, c, t, g, unknown, or other
  misc_feature (931)..(931): n is a, c, t, g, unknown, or other
  misc_feature (1018)..(1018): n is a, c, t, g, unknown, or other
  misc_feature (1209)..(1209): n is a, c, t, g, unknown, or other
  misc_feature (1259)..(1259): n is a, c, t, g, unknown, or other
cggatatagaagaaaattaaatattcaaaattaagacagcttcccacctttccccgggtttgtgtgattgattaccctcctgtgtaagctcaccccggtggcggccgctctagaactagtggatcccccgggctgcaggagttcgtctcacccctagaaaaaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgcccacttctgctgtatgtagttgcttgaattcagccgtgttttgctaccgtacccaccccatggcatcatctgtcaccgcgacgcaattaatatagctaatacccccgcctcagaagaattgatttccaaagcaactaattagttgccgcgggcgtctttcgttgttttgacagcaagtagctagcatatttccatagcgcgccgagaaaataaacaaaaaggtttttctccctccgcggggggggggcgtccgatctcatcctatgacctcaaacgcggtagtgagggtctggcgctttctaagcgacangccacccggcgccgaaacagagaaggctctttttgggtatgttgagataaaagtgtcgtgtaaatcgaagtcccgacgctccccaccgaaggggagtgcgataaagggtgtcgcgcgacgagacggtgcgaagaagnactcattctcgtccatcaaaagagaatatattgggggtgtgttagaaacacctctctccctcacccccttggagcgtgcccctcganataaccagaagcgtcctcgtgataattatatgtgtatagattcccgtcgcgtgaatttgtgtggagataaaatctgtcttgttccgcaacaaaaggggcgccgtgcagagggtgttctcccctttgtaaaagtcggtgtatataatataagatgatgtccgtccgcaaagtatatttcgaggcgggcgtgngaggtccacgcgcgtagaggtgaattcgcgcattctatttattataaccn

SEQ ID NO: 80381 - protein, 58 aa, Zea mays; identical to SEQ ID NO: 46528
  misc_feature: Ceres CLONE 1565653
  misc_feature (6)..(56): Pfam Name: UPF0057 Pfam Description: Uncharacterized protein family UPF0057

SEQ ID NO: 80382 - DNA, 947 bp, Zea mays
  misc_feature: Ceres CLONE 1565655
  misc_feature: Encodes the peptide sequence at SEQ ID NO. 80383
  misc_feature (947)..(947): n is a, c, t, g, unknown, or other
tggagctccccgcggtggcggccgctctagaactagtggatcccccgggctgcaggaattcgtctcacccctagaaaaagattcgcctcgcaaaatcgccgccgccatcgcctactccaccagacgccgatagttccgccttcctttcctgctgcgcgcctgtcgccatggtgaagcggtggcttcccctcgaggccaaccccgacgtcatgaaccagttcatgtggggactgggggtccccgaggacgtggggttctgcgacgtgtacggcctcgatgacgagttgctcgccatggtgccccagccggtgctcgcgggtctacttctctacccccaggaccggagcaaggagtcccaagcttcagctacctcgtcggtgggagaccaagggagcccagccaaaaacgtttatttcccaaaagcaaactggttgggggatggcttgtgggcacagtttgggatttattcttggcccgggggggaatggctactttcccaaaaatccaagtttggggggaaggggggcccaaattttttgagaaaagtttttttaaaaaacaaaaactggtctggaaatgtggaatccttttcccccgggtggggggtgggatttttttttgagggggggggcccccgagaaaaattgggggaaaagggctccttttccccttttggccccctctcatggggtgggggggacacaaaaaaggcccacgggggagggggggtaattttataacaaataaaaactttgttttttccccctcttgggcgccccggggggaaacttttttttaactttttttgggggggggagaatattttgacccaaaataccccgctggggggccctctccccccccgaagaacccttttgtgtggggggggttctccaaaaagatttttaaaaaaagaagaaccccccccttttttttcccccccaaan

SEQ ID NO: 80383 - protein, 190 aa, Zea mays
  misc_feature: Ceres CLONE 1565655
  misc_feature (4)..(183): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
MVKRWLPLEANPDVMNQFMWGLGVPEDVGFCDVYGLDDELLAMVPQPVLAGLLLYPQDRSKESQASATSSVGDQGSPAKNVYFPKANWLGDGLWAQFGIYSWPGGEWLLSQKSKFGGKGGPNFLRKVFLKNKNWSGNVESFSPGWGVGFFFEGGGPREKLGEKGSFSPFGPLSWGGGDTKKAHGGGGVIL

SEQ ID NO: 80384 - DNA, 861 bp, Zea mays
  misc_feature: Ceres CLONE 1565657
  misc_feature: SWISSPROT Homolog: EC 4.1.1.39 Ribulose-bisphosphate carboxylase
  misc_feature (841)..(841): n is a, c, t, g, unknown, or other
ctccccgcggtggcggccgctctagaactagtggatcccccgggctgcaggaattcgtctcacccctagaaaaacaggacgacccaagcaagcaagcaagcagcgagtacatacatactaggcagccaggcagccatggcgcccaccgtgatgatggcctcgtcggccaccgccgtcgctcccgttcaggggctcaagtcacccgccagctcccccgtcgccgccgcttcctcagaaagcctcggcacgtcagcaacggccgaaggatccggtgcatgcaggtgtggccgggctacggccacaagaaagttcaaaacccttgtcttaactgccccccccttttcaacggaacaacctgctaaaaacagggggattaccttgtttggcaaagggttggaaaaccccggccccaaagttacacaagagtcgggttttcttttacccccaaaaaaacccccccccccccggggttaataaaaaaagggcccctttttgggaccatttgggaaaaaaccccccccctttttggggggtgaaaaaaaaccccccccccccccgggtgtaaaaaaaagactcctctcggggggggcccccaaaaaaatcttcccccggggggcgcctttttccccccccgtttttttttttttttttataaaaaatattttaaaaaaacaccgggggggggggggtatttttttttttccacaaaaaaaaccccccccggagggaaaaaaaaaataaaaaatatccccccggggggcccccccccccccgcggggggagagaaaaaaaaaaaaaacccctccccccggggaggaaaaaaaaaaaaagggggggcggngggcgttcttttctcttttg

SEQ ID NO: 80385 - DNA, 819 bp, Zea mays
  misc_feature: Ceres CLONE 1565660
  misc_feature: Encodes the peptide sequence at SEQ ID NO. 80386
  misc_feature (428)..(428): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
ctcaccgcggtggcggccgctctagaactagtggatcccccgggctgcaggaattcgtctcacccctagaaaaatctcatcatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggaccctcacggcgctgactgcgttgcacagctccacagcgctgncgggaacccgtgcccccggtcaagaactttccgaaattgtgccacaatcgtcaaagggcaaccttcctcctggtcccctgggaagacagactacccatccgagggaatgtgcgtcccccaaccctgggtgggggtcgatcaagaaagcacttactaaaaccatttccccaaagaaaccctggggcccccaaaggccaaagcccgaaccctaaccccaaaacccgggacccaaaaccccaaacccttagcccaagaccccgaagaaacccccccccttaacccaaaaaaagggggagtcctaaaaatcccagaatttcccccccctcggtgaactgctcaccctaggnnnnnnnnnnnnnnnnnnnnnnnnnnnnnnnnnnnnnnnnnnnnn

SEQ ID NO: 80386 - protein, 156 aa, Zea mays
  misc_feature: Ceres CLONE 1565660
  misc_feature (34)..(146): Pfam Name: DUF1210 Pfam Description: Protein of unknown function (DUF1210)
  misc_feature (105)..(105): Xaa is any aa, unknown, or other
MAADALRGLLPGVYAVLMVIAVASAASSDVSSVVVGLAKCADCTRKNLKAEAAFKGLEVAIKCKNSKGEYESKAMGKLDGFGAFSIPLSTDPHGADCVAQLHSAXGNPCPRSRTFRNCATIVKGQPSSWSPGKTDYPSEGMCVPQPWVGVDQESTY

SEQ ID NO: 80387 - DNA, 778 bp, Zea mays
  misc_feature: Ceres CLONE 1565661
  misc_feature: Translation starting site: 170
  misc_feature (726)..(726): n is a, c, t, g, unknown, or other
ggagctccccgcggtggcggccgctctagaactagtggatcccccgggctgcaggaattcgtctcacccctagaaaaaactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaataaatcatcgctggcattgtcactgagagagatatctccggaaaatcatagtgcaggggagggcttcccagtcaactaaaggtggcgaactcttgactgaagaaaaaaaactggatcccggggaatccccgacaccaaggtcctggcgggcatggccccttcttgaaaagaaaaacccggttaaaaacactttcccggggaatttcaaccgccccggggaatccctgggggatgggtctcccattgggnaaaaaatttttttgcccccggggggggtggccccaaacccccaggggggggg

SEQ ID NO: 80388 - DNA, 817 bp, Zea mays
  misc_feature: Ceres CLONE 1565663
  misc_feature: Encodes the peptide sequence at SEQ ID NO. 80389
  misc_feature (640)..(640): n is a, c, t, g, unknown, or other
ggagctccccgcggtggcggccgctctagaactagtggatcccccgggctgcaggaattcgtctcacccctagaaaaaaagggcaaaggcgcagcagcggcgcgagcggagcacaagagagcaccacgccaccccttcctgtctctctgctcctccgcatccgcttgtgcgcccgtgccgctcactgcactccattcccaatctctctgcctcccctgcctgtctctccacgccagtgcgcgcagatcgggcgggtgtgaagaggagctcatcacatcctctgctgcttcttctgtccaataagagctagctagctagctcgctcgccgattcaacagcaagcggcggcagtgatgcgcggacttgtcctcgcatagccaagatccgtccagcagcggcagcttgagcgcagacagattcaagaatggaggagaaagcggcggacgcgacggcgacggcgacagtggcggcggcggcggcagcggatcaggacggcgcggtgtactgcagcgagcacccgtacccgcagggcgcgcagcggcggccggggcgggcgccggcggcatctgcgccttctgtctgcaggagaagctcggcatgctggtctcgtcgtccaagtccagcccctttcccaccgccnacgcagcagccggtctccgccgcttctccgtcctcgacgacggccgccggcgttcaaacgcgccctcttcggagggcgccggccgcggccattctaacccttccgggggggtctgcggcaaggtgatgccccgcccaaaaaaaccccgggccggccggccggcggccgggctaaaaa

SEQ ID NO: 80389 - protein, 113 aa, Zea mays
  misc_feature: Ceres CLONE 1565663
MEEKAADATATATVAAAAAADQDGAVYCSEHPYPQGAQRRPGRAPAASAPSVCRRSSACWSRRPSPAPFPPPTQQPVSAASPSSTTAAGVQTRPLRRAPAAAILTLPGGSAAR

SEQ ID NO: 80390 - DNA, 1107 bp, Zea mays
  misc_feature: Ceres CLONE 1565664
  misc_feature (18)..(18): n is a, c, t, g, unknown, or other
cttattattagtgtatanacacctggctacaccagccgccgagcccatatcgatataaaaaaaaaacaaaaaaaataataggaactcacgcggtggcggccgctctagaactagtggatcccccgggctgcaggaattcgtctcacccctagaaaaaaccacaatcgcaattcgcaagcccttccaacggcagtcatggcttccatcaccctcctctccctcgctcccaccgccatcttcctccacatcccggctttcacctcctcctccgtcgttggtcccggaatcctagccggccgctgggccgcgccccgcgccctcccgctccgcgcgctcccgccccgtcgcgtcaccgtcgtctgcagcagcgccgcggcggcagccgaggcctcggacgccgcagcgccagtggagaagttccggctcgacaatttggggccccagaaggggtcccgccggcgggccaagcgtaagggacccggtatttgctgccagccaagggcgcgaagctcccgggtttcggtatcccccgggcagaaaatcgcgcctcgggggcccggccgtcccgggccgcgggtttccaaggggaagggcaaaaatgccccccttcttacccgcccggtcttcccccaaagcttaaccggggggcaattttgcccgggcggggggaatagcaaaaatttgggggccctgtccccccaaaaagaaattgtttggccccctttctcaaatttttataaaaaaagagaaactattaattttccccccccgcgcccgggaatatttctcaaaagaatatagggtgggaacccacaaaaaatttttctcctctgggaaaaaaaaccctgcgaaaaaatcatccgcggggggtgctcgtaataacaaatcccccaattaaagggacaaggggaaaaaagggaaaccttccccccccctttaaagaatcttaagggaaaaaaatgggggggaatttatatccattttaaagtttagaaaaatcaaaggggggcggaaaggcttttttcaccctttccgcccaaagaaaaaacttttgaggccaacccggtttttttcccacaaccctggttaccacaacaaaaaaaatgg

SEQ ID NO: 80391 - DNA, 831 bp, Zea mays
  misc_feature: Ceres CLONE 1565665
  misc_feature: SWISSPROT Homolog: EC 2.7.7.49 RNA-directed DNA polymerase
ctccccgcggtggcggccgctctagaactagtggatcccccgggctgcaggaattcgtctcacccctagaaaaatcaggatggtcacccaatagcctttatcagcaaggcattaggccccaaatctcaaggcctctccacttatgaaaaatagtatatggccattctattagcagtgtctcactagtgcgcttatttgcatctcaaagaattcaccatttttactgaccaacgcagcctaatatcattgttcgaacaacgcctccatacaatgtggcaacaacgggtgttttccaaactcttgggcattaattaccatattgtttacaaacgcgacactgagaattgagtgatagatgccctttcacggaaatcttctcatgaagcttcttgtgcagctatttcatcagctactccaaagtggtttgccgaggtgattgctggatacgatcaggatacccatgcaacaaacctacgagctcaattggctgttgatcccacattggtgcccactttcgcattggtggagggattactgcgctacaagtccaaagtttggattttccataatgtgccactacaacagaaaactgctatcagcttgttacgccagtgcattaggtggccattctagattcccggtaacatatatgaagatgaagaagctgtttgcttggaccgacatgtgtgttgcggtgaaagcatttgtgcaaacatgtctggtatgcccagcagctaaaccggacagaacccgttttaccagtctgctacagcccgttaccatgccctcatcagcttggcagatttattcggtggactttgttggaggctt

SEQ ID NO: 80392 - DNA, 841 bp, Zea mays
  misc_feature: Ceres CLONE 1565673
  misc_feature: Translation starting site: 480
  misc_feature: SWISSPROT Homolog: EC 4.1.1.39 Ribulose-bisphosphate carboxylase
  misc_feature (419)..(419): n is a, c, t, g, unknown, or other
  misc_feature (767)..(767): n is a, c, t, g, unknown, or other
  misc_feature (826)..(826): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcnggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccgggccgccccccgccggctagctatagctcctgcgtgagctagtagctagctagtgccatgcgtcgtctctgtcgttcggtttttgcttcgggtcaccgtacccntttgcttgctggtttcttctttcctttttccttttttttttcttttcccccgccatggntcctttgnctttcag

SEQ ID NO: 80393 - DNA, 809 bp, Zea mays
  misc_feature: Ceres CLONE 1565679
  misc_feature: Encodes the peptide sequence at SEQ ID NO. 80394
  misc_feature (16)..(16): n is a, c, t, g, unknown, or other
  misc_feature (286)..(286): n is a, c, t, g, unknown, or other
  misc_feature (294)..(294): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (704)..(704): n is a, c, t, g, unknown, or other
ctgggagctccaccgncggttggcggccgctctagaactagtggatcccccgggctgcaggaattcgtctcacccctagaaaaaacaaaagccattccttcaatcactcaaatccactgtgactccgtgagctccctgcctgctgccctgcactgctgcacactccccgcccagccgcaccagctcagctcagctcagctcagcagtcatggctcgcccctgccgcagcagcagcgccgctgcccgcctcctgctgctgctcgccgccgtcgcagcggcgcttcangccgcggnccgcgcgccgccggtggccagcgggctttcaatccgcaaatcttgccgcgcgacgcagtaccccgtcggtgtgccagcaaaaccttccgggcttacggaggctcccccgccccccccgaaaaccccccttaaactgggccccccccccccctttggggggaaacccggaaacccccttttgggaaaacttcccccctaaacttgggcccccccttttgggggtccccccggcccgaaacccgggaaaaaggaaacccccccccccccgggggccccggggaaaaaaaaaaggggggttgggggggccccccggggtcccccttgggcccaaaaattttttttggggaaaaaataaattccggaaaaaacgggggggggcgacaccctctcccccaaaaaaaaannnntnnaaaaaaaaaaaaaaaaaaggggggcccccccccggaaaaaagccccccccccccccccggggaaaaaaaacacccccccttttttttgtggggggggggcccccc

SEQ ID NO: 80394 - protein, 94 aa, Zea mays
  misc_feature: Ceres CLONE 1565679
  misc_feature (26)..(26): Xaa is any aa, unknown, or other
  misc_feature (29)..(29): Xaa is any aa, unknown, or other
MARPCRSSSAAARLLLLLAAVAAALXAAXRAPPVASGLSIRKSCRATQYPVGVPAKPSGLTEAPPPPPKTPLKLGPPPPFGGKPGNPLLGKLPP

SEQ ID NO: 80395 - DNA, 885 bp, Zea mays
  misc_feature: Ceres CLONE 1565681
  misc_feature: Encodes the peptide sequence at SEQ ID NO. 80396
ctccccgcggtggcggccgctctagaactagtggatcccccgggctgcaggaattcgtctcacccctagaaaaactcaatccaaagagagccttctccaccgctcttgctcgtccaaccttctccatcgtctcaccttaggtttcgctccccgccgccgccgccatgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaagtcaggacgctctggatcggggatctgcagtactggatggacgaatactacatctacgggtgcttcgcatccacgggggaggtgcaaaatgggaaagctattcgtgacaagcatactggaaaacttcaggggtatggttttattgaattcaaaagccgccctgcttgctaaaaaatttcttcaaacttcacacggggacatgatgccaaaaggtgaagttgccctttccggttgaaattggggctaaggccgggggaaaaaacggtgaagaacccccccaaatataacaaaatatttttggggagaaatttgggcgcgcgcaggtgtacaacacattttttttttcaaaaaaaaaacttttggg

SEQ ID NO: 80396 - protein, 175 aa, Zea mays
  misc_feature: Ceres CLONE 1565681
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDEYYIYGCFASTGEVQNGKAIRDKHTGKLQGYGFIEFKSRPAC

SEQ ID NO: 80397 - DNA, 1284 bp, Zea mays
  misc_feature: Ceres CLONE 1565683
  misc_feature: Encodes the peptide sequence at SEQ ID NO. 80398
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (982)..(982): n is a, c, t, g, unknown, or other
gaatttggctgtgtgcgctgcgctccccgtttttcttgtctcccgtttttccctcaccaaaaaaaaaagnnnnccatacttggactccccgcggtggcggccgctctagaatagtggatcccccgggctgcaggaattcgtctcacccctagaaaaaacggaggaaggaagcgagaagaccataaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcaaaggcagctgaggctgtggttgactggcataaacacgacagcaagaggatgctccatgcggtttaccgtgttggggatctggaccgcacaatcaagtacttcacggaatgctttgggatgaaactgctgaggaaaagggatgttccttgatgaaaaaccccccaatgcccttccttgggcttttgggccaaagaaaacccaaccttttccacttgaaattggccataagaaattatggggtgtgaaaccaagtattaacatttgggaaaccggggttttttggggctttttcccccaaatttgctaaagagagagatatgtgtttaccaaagttttagcttggagagaaatattccaaacctcccgaaagggttggggtaaaaaaaaatctaccctctgtaaaaaaacccgtgttttctttttgttcctcagggggagaaggaaaaccccccccggtgtatatttttttccgccttttctccagaagcgcgaggggagtctcctcttgtgggggggcgtgcgtacacaccgtatcttgttatgtgagcgggctctattttttctcctctttaagagaggggttctttattataccacaccccgctgcggagaacacctctctcgtttgttgtcgcccacgaagtcttaagtggtctcctttcnctcccctaggtggggggttgatcaaactctgtggatggcgtcgatgataccctgagtgtagttagtatttcacgatagaaagaaagaagcggccccctcgcggcggagacagaaagtgactctcccctctctcgggtgggcagatgtcgagaacttggccgcccgtggaaatagatagaaggtgcacgtccggcgtgtgcgtccctttgttgggacgacgccactctgtatgtggtaacaagagacgacacgctcgtgtgtttttgtgagcctgcttctcactgctcattatttgtaaacgg

SEQ ID NO: 80398 - protein, 57 aa, Zea mays
  misc_feature: Ceres CLONE 1565683
  misc_feature: SWISSPROT Homolog: EC 4.4.1.5 Lactoylglutathione lyase
MATGSEASKAAEAVVDWHKHDSKRMLHAVYRVGDLDRTIKYFTECFGMKLLRKRDVP

SEQ ID NO: 80399 - DNA, 922 bp, Zea mays
  misc_feature: Ceres CLONE 1565685
  misc_feature: Encodes the peptide sequence at SEQ ID NO. 80400
  misc_feature (20)..(20): n is a, c, t, g, unknown, or other
  misc_feature (30)..(30): n is a, c, t, g, unknown, or other
  misc_feature (31)..(31): n is a, c, t, g, unknown, or other
  misc_feature (261)..(261): n is a, c, t, g, unknown, or other
  misc_feature (304)..(304): n is a, c, t, g, unknown, or other
  misc_feature (314)..(314): n is a, c, t, g, unknown, or other
tggagctccaccgcggtggngcggccgctnnctagaactagtgggatcccccgggctgcaggaattcgtctcacccctagaaaaaattgtcattttcgctcccgtgacctacctcgtcgtgtctcggcttggcttggcttcctcctccccgacgaccaccccgcgcttctcctctccccccgtcccaccttccgagaggctcgagccctgatcccacgctgagggcggcggtgttaggagtttagccatggccaagtggcngccggcggccctgctggtagtggcgctgacagcggttctgtcngcggcgcggncgggcggatgccctcttcgtgacgggggaccgaacccgaggggatccccccattccgtttcctacaagggtggaaccctgttccgggaaacttcctcctgtttcaccccccaaaattttttgggggctcccgtttcccccgggtttcgccccccccggggaaccctcccccgggggggaaacccttgggccccccctttgaggggaaaaatttgggggacaaattttttggtttttacgcccccccggggggggggggtggtaaaaatttttttttttctttaaacccccatttggggggccccccccaaaattttttttttttttccacaccccggggggggggggggcgctcccccccccggggggcaacccttttggggaagaaaaaaagagaaacctttggccccccctctccccccttcaaaaaaaccggggggggcgtgggggggggtgtttttttattttttctccccccccccccgcgggaaagatttctcttttagacccgcgggcggcggggcttttttttatacccccccctcttgggggggccccccccaagcgggggggggttgtttttctccccccgcggggggggggggaatt

SEQ ID NO: 80400 - protein, 116 aa, Zea mays
  misc_feature: Ceres CLONE 1565685
  misc_feature (5)..(5): Xaa is any aa, unknown, or other
  misc_feature (23)..(23): Xaa is any aa, unknown, or other
MAKWXPAALLVVALTAVLSAARXGGCPLRDGGPNPRGSPHSVSYKGGTLFRETSSCFTPQNFLGAPVSPGFRPPRGTLPRGGNPWAPPLRGKIWGTNFLVFTPPRGGGVVKIFFFL

SEQ ID NO: 80401 - DNA, 862 bp, Zea mays
  misc_feature: Ceres CLONE 1565687
  misc_feature: Encodes the peptide sequence at SEQ ID NO. 80402
cggccgctctagaactagtggatcccccgggctgcaggaattcgtctcacccctagaaaaaatcacagatacacaccacgctaagccaaatcgagcaacgcctatcatcatattataatttcccctcattcatctcacagtcccaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcagcagacccttctgttttcttgatgggagaagaggttggcgaataccaaggtgcatacaagatatccaagggtttgcttgacaagtatggcccggatagggttctcgatactccgatcactgaggcgggcttcactggcattggtggtggggtgcgctaccatggtcttcgacctattgtagagttcatgacatttaacttttcgatgcaggccattgatcacataattaattcagctgccaagtcgaactacatgtctgctgggcagatatctgttcctattggcttagggggccaaattggtgctgctgcctgagttggggcccaacccctcccggggctttgcagcctgggtatgccccattttcccgggattgaaaggttctagcctcctattttctgcaaaaaaaagttctcagggttggcttgaaagcgcccatttgggggtccccaattccggttggggttcccttgaaaaaagaaccttcttttgg

SEQ ID NO: 80402 - protein, 158 aa, Zea mays
  misc_feature: Ceres CLONE 1565687
  misc_feature (37)..(159): Pfam Name: Transket_pyr Pfam Description: Transketolase, pyrimidine binding domain
  misc_feature: SWISSPROT Homolog: EC 1.2.4.1 Pyruvate dehydrogenase (acetyl-transferring)
MLGVARRRLGSGCVLAQLAQALRPAAAPARTYSAAAKEITVREALNTALDEEMSADPSVFLMGEEVGEYQGAYKISKGLLDKYGPDRVLDTPITEAGFTGIGGGVRYHGLRPIVEFMTFNFSMQAIDHIINSAAKSNYMSAGQISVPIGLGGQIGAAA

SEQ ID NO: 80403 - DNA, 860 bp, Zea mays
  misc_feature: Ceres CLONE 1565692
  misc_feature: Encodes the peptide sequence at SEQ ID NO. 80404
  misc_feature (547)..(547): n is a, c, t, g, unknown, or other
ggagctccccgcggtggcggccgctctagaactagtggatcccccgggctgcaggaattcgtctcaccccagaaaaaacttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcnaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacgggtgctggcatgcattttctccggccctgaacagtgtggccaagctgatgggtacatccttgaaggtaaagagcttgagtctccttggagaagcttccgaggaagaaggcccagagcgcctgtacttaaaacctttcccatggattgcttggccccgaaatgggtggtcc

SEQ ID NO: 80404 - protein, 235 aa, Zea mays
  misc_feature: Ceres CLONE 1565692
  misc_feature (1)..(199): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKTPAAKKDNAEGQEVEAAAEETKKSNHVTRKLEKRKEGRTLDPHIEEQFGSGRVLACIFSGPEQCGQADGYILEGKELESPWRSFRGRRPRAPVLKTFPMDCLAPKWVV

SEQ ID NO: 80405 - DNA, 826 bp, Zea mays
  misc_feature: Ceres CLONE 1565693
  misc_feature: Translation starting site: 157
  misc_feature: SWISSPROT Homolog: EC 2.7.7.4 Sulfate adenylyltransferase
ctccccgcggtggcggccgctctagaactagtggatcccccgggctgcaggaattcgtctcacccctagaaaaatcgccgtcgtcttctgcggttctgccgtctacgcctccaatttggcctctctcccttgcaagtttaagcttcatcttcagccatgggtaaggagaagtcccacatcaacattgtggtcattggccacgtcgactctggcaagtcgaccaccaccggccacctgatctacaagcttggaggcattgacaagcgtgtaatagagaggtttgagaaggaggctgctgagatgaacaagcggtccttcaagtatgcttgggtgctcgacaagctcaaggctgagcgtgagaggggtatcaccattgatattgctctgtggaaagtttgagaccaccaagtattactgcaccgtcattgatgcccctggacaccgtgacttcatcaagaacatgatcactggtacctccagggctgactgggctgtccttatcattgactcccccctggggggttttgaggctggaatcccccagggatgcccaaacccgggaacaagctccccttgggttcacctcttgggaggaaacaaaatatttgcttctcccccagatggggatgcccccctcccaaaaacccccagggggttttttataaaaaattttgaaaagaaattcctcccccccccccaaaaaaatggggggacaccccccaaaaaaaaaggcccttttgtcccccccctctggggtttggggggggcaaccccctttttttggaggggcgcccccccccttttttgtggggaaaaacaagccccc

SEQ ID NO: 80406 - DNA, 874 bp, Zea mays
  misc_feature: Ceres CLONE 1565695
  misc_feature: Translation starting site: 167
  misc_feature: Pfam Name: Herpes_LMP1 Pfam Description: Herpesvirus latent membrane protein 1 (LMP1)
  misc_feature (735)..(735): n is a, c, t, g, unknown, or other
ggagctccccgcggtggcggccgctctagaactagtggatcccccgggctgcaggaattcgtctcacccctagaaaaaatcgccccgagatccatcactcgcattctcaccggcgagctaagcatccgcgcgcctcctctccaagcagaccaccaccgccggaagcatggccgcgccgctgcttcggcaatggcgcagcctcgccgtgctcggcgccctcctcgggctccacctcatcgccgccgtggcgcagtcgccgccaactgcacccacgacccctgccgcacccacgacccctgccgcacccacgactccggctacacccacgacccctgccgcacccacgactccggccgcacccacgacccctgccacacccacgactccggccgcaccgacgacccctatcgcacccacgactccggctgcaccgacgacccctgccgccaccccggtcgcgccagcaaacccgccgccggttccgacaacgccagcgcccaccgccaccccagtcgcgccagcgaagccgccgccggtcgcgcccgcggtcgcgccggccaaacccccgccggtgacgccgccaccagtgacgcctcctcccgctacgcctccacccgcgacgccgcccgcggtgctcccacccgccgtgctgccggcccgccgcggcgccttcgccgacggccacgcctccggccgaggcgccggcgtcgctgcctcccgcgacgacgcccccgnccggtggcccgaggccccgcgggagctgccgcccgcccgaggcgcccgtccaaggggaagaacaaggccccagaagggaggagggaaacccccccggcaagaaaaggagggccctcggccggaaacggcccccaccccc

SEQ ID NO: 80407 - DNA, 850 bp, Zea mays
  misc_feature: Ceres CLONE 1565696
  misc_feature: Encodes the peptide sequence at SEQ ID NO. 80408
  misc_feature (137)..(137): n is a, c, t, g, unknown, or other
  misc_feature (330)..(330): n is a, c, t, g, unknown, or other
cggagctcccgcggtggcggccgctctgaatagtggatcccccgggctgcaggaattcgtctccccctagaaaaaatactttccaaagagagaaagggcaggcccagctctagcctttccaaagtgcgcgcaatctncctctgccgcatccgatattccgatctcgatcccgcgacgcggtgtctccggtcagcgccgccgccttctccctcgccggccgccactgcatcgccgcagtcgccatgaattatatcattggagcattcaagccaccttgtgacatctcgatcacattctctgatgcgaggactaggaagcaggtttcggttnagaagggacatgggaaagacacgatgggtccctgtttttccagagcctcgaaactatattctggaggagttatcaatagcacccagtttccaggtaaaagggattgaccacacgggttgtccaaaatttgaatttgctagggccaaattaaaagctctattttttgacccggagggacctttccagtgactttccccttcccttaagaaccggggagtttaaaaatttccctggggggagaattctttgggaaagggggaaaaccctttcccccttttggaaattttttccaccgggtggaaaaaggccccaaaagagaatcttttacaagggggggccaaaataggtcaaaactccccggggtcacttttttttgaagggggggaaaaattttggcgaaaaaaacatttttttgggggaaaaaattttggggggaaaaattcgcgggggatatttctgtggggggaggaaaaaataaatcccccccccgggtggcccccacaaaaaaacaaaaaaaaaa

SEQ ID NO: 80408 - protein, 64 aa, Zea mays
  misc_feature: Ceres CLONE 1565696
  misc_feature (30)..(30): Xaa is any aa, unknown, or other
MNYIIGAFKPPCDISITFSDARTRKQVSVXKGHGKDTMGPCFSRASKLYSGGVINSTQFPGKRD

SEQ ID NO: 80409 - DNA, 879 bp, Zea mays
  misc_feature: Ceres CLONE 1565699
  misc_feature: Encodes the peptide sequence at SEQ ID NO. 80410
  misc_feature (370)..(370): n is a, c, t, g, unknown, or other
  misc_feature (371)..(371): n is a, c, t, g, unknown, or other
ctccccgcggtggcggccgctctagaactagtggatcccccgggctgcaggaattcgtctcacccctagaaaaagatggcgtcctcctccctcccggcgcccgcggccggccgcgccgagctcctcaaggccttcgacgacgcccgcacgggcgtgcgaggcctcgtggagtcgggcgtctcgtccgtcccggagctcttccgccacgcggacccctacgcctccatcccgctcgccccgcccggcgtttccatccccgtcgtagacctctccctcccgccccacctcgccgccgcggccgccgcggccgccgcccgcacctggggcttcttccacctcgtcaaccaccaccacgccctccccgcgggcnngcgcgcggccgccgccgccgacgactaccccgagcgcgccttcgcggcggtgcgcgcccttcacgaactccccgcacgcgagcgcgcgccgcactacagccgcgccgtggacggcggggtaactactccttcaaacgtcaacctgtacaattcccccgggcccagttggggggaaaacatcccaaaatctgttgggcccaaacgccacccggaacttgccaacgggatccgggcccccttccccccccagggggtctaaaggggaaggccccgccccccccccgttcccccgccctttgttaggggccccttccccggggggttggcctctcccccccagggggcgtgggaagaccttcctttccccccaagggaaaaacccatggggggggaacaataaaaccccccttttcccccagaggggggggggcaacactggggttttttttccccccaaaaagagccccccgggggtgttccccccggttctcccaaaaaaagaaggggg

SEQ ID NO: 80410 - protein, 184 aa, Zea mays
  misc_feature: Ceres CLONE 1565699
  misc_feature (99)..(99): Xaa is any aa, unknown, or other
MASSSLPAPAAGRAELLKAFDDARTGVRGLVESGVSSVPELFRHADPYASIPLAPPGVSIPVVDLSLPPHLAAAAAAAAARTWGFFHLVNHHHALPAGXRAAAAADDYPERAFAAVRALHELPARERAPHYSRAVDGGVTTPSNVNLYNSPGPSWGENIPKSVGPKRHPELANGIRAPFPPQGV

SEQ ID NO: 80411 - DNA, 1277 bp, Zea mays
  misc_feature: Ceres CLONE 1565707
  misc_feature: Encodes the peptide sequence at SEQ ID NO. 80412
  misc_feature (839)..(839): n is a, c, t, g, unknown, or other
  misc_feature (1066)..(1066): n is a, c, t, g, unknown, or other
  misc_feature (1070)..(1070): n is a, c, t, g, unknown, or other
  misc_feature (1161)..(1161): n is a, c, t, g, unknown, or other
  misc_feature (1202)..(1202): n is a, c, t, g, unknown, or other
gttttgtggagtttcaccacaagctagccaaatatcggcggtggggggttaggggggggcggtaataattttccataaacaaagagagtccctcggtggcggccgctctagaacagtggatcccccgggctgcaggaagtcgtctcacccctagaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttctcgggccacttacgctgggacacggcgggggttgtcgggggacccccacacattcgccaagaaaccgggacctggagggcatccacttccccgctgggccatgcctgggcaacgtttgggtctgcggtgttccccggaagttggcttcgacccggcaaacggtcgtgcaagtttcgggccaagggccgttgtgggttttaaagggcccggggtccccaaagaattcttccaccccaaggagtggaggccagggaaattaatcccctcggtttaagcccccgaatgcctctttatatccacccctcggccagagaagagaaattccctttgcgaccacaatactgtgggagggccctttggaccccaaggggattgaggcggggccactatagaggagaggagncgccccccccacttgcgcgtgggggggagagtataacccgctctacgtatgcaacctcccgcgaggcgcgggagtctcgcacacactctcgctgaagaaagagagattccttggttctaagacacccgcggcgtctctaaacacttctcggtgggggtggagagaaatcatattcggagagaaccctcggatatgtggagggtctttatgagcccgaaagaaagaanaccnccgtggaggtgtgtcctttattccgcgaggagaacttatacacaagagtgttacaagagagaatcttcttactgtaaagagtggggggccnctcctctccggtccacatgagagtctcacgcaacgagggtnatgacggggagttacataatcgtatagaagagagtgaggtactggctatcgcggcggcagaagagaggcacctgg

SEQ ID NO: 80412 - protein, 139 aa, Zea mays
  misc_feature: Ceres CLONE 1565707
MASSTMALSSTAFAGKAVNVPSSLFGEARVTMRKTAAKAKPAASSGSPWYGPDRVLYLGPLSGAPPSYLTGEFSGHLRWDTAGVVGGPPHIRQETGTWRASTSPLGHAWATFGSAVFPGSWLRPGKRSCKFRAKGRCGF

SEQ ID NO: 80413 - DNA, 836 bp, Zea mays
  misc_feature: Ceres CLONE 1565712
  misc_feature: Encodes the peptide sequence at SEQ ID NO. 80414
  misc_feature (610)..(610): n is a, c, t, g, unknown, or other
  misc_feature (702)..(702): n is a, c, t, g, unknown, or other
  misc_feature (729)..(729): n is a, c, t, g, unknown, or other
  misc_feature (750)..(750): n is a, c, t, g, unknown, or other
  misc_feature (757)..(757): n is a, c, t, g, unknown, or other
  misc_feature (758)..(758): n is a, c, t, g, unknown, or other
  misc_feature (809)..(809): n is a, c, t, g, unknown, or other
tccccgcggtggcggccgctctagaactagtggatcccccgggctgcaggaattcgtctcacccctagaaaaaagctgagcacgccgaaaagctcatcagtgctcatcccctgctggcccgttctcagtcccagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgaggtcgtcgccgccaccgtaggccctgcccagtccgccgacacgctccgcaccgcactcgccatgggcgccgatcgcgccgtccacgtgctccacgacccggaccctgcgcggcccctcctccctctcgccgttgccaagatccttcgcgccgtcgcgctccaggagaagcccggcctcgtcatcctcggcaagcaggcaatttgatgatgattgcaccaaactggacaaatgttagctggatttgctcagtgccacaaggaactttgcctccaaggttacattggacacagaaancaaaaagctactgttgagcgagaagttgatgggtggaatttgaacatctgccttgatctgccagcagtgatcaccacggatttaagacttanccagcccagatatgcactttgccccancatatgaaggcaaaatcaaangttattnnagaagtcgccgctgaagaccttggcgtagatatagatcagacatggaggtngattgagggtcatgaaccacaaaacat

SEQ ID NO: 80414 - protein, 124 aa, Zea mays
  misc_feature: Ceres CLONE 1565712
MKILVAVKRVVDYAVKVRVRPDGRGVETANVKMSMNPFCEIAVEEALRLREAGVAAEVVAATVGPAQSADTLRTALAMGADRAVHVLHDPDPARPLLPLAVAKILRAVALQEKPGLVILGKQAI

SEQ ID NO: 80415 - DNA, 790 bp, Zea mays
  misc_feature: Ceres CLONE 1565717
  misc_feature: Translation starting site: 148
  misc_feature: SWISSPROT Homolog: EC 1.2.1.12 Glyceraldehyde-3-phosphate dehydrogenase (phosphorylating)
  misc_feature: SWISSPROT Homolog: EC 1.2.1.59 Glyceraldehyde-3-phosphate dehydrogenase (NAD(P)(+)) (phosphorylating)
  misc_feature (301)..(301): n is a, c, t, g, unknown, or other
  misc_feature (308)..(308): n is a, c, t, g, unknown, or other
acccgcggtggcggccgctctagaactagtggatcccccgggctgcaggaattcgtctcacccctagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccngtccacnggccactggaagcacagcgacatcacactcaaggactccaagacccttctcttcggtgacaagccggtcaccgtctttggcatcaggaaaccctgaggaatcccgtggggtgaagctggcgctgagtatgtcgtggagtcaaccggcgtcttcactgacagggacaggctgctgcacatctcaagggtgggtgccaggaaggttgtatctctgcccccagcaagaagcaccccctgtttgtttgtgggtgtaaatgaggaacaatacccctccggaggttaaaattgtttccaaagggtagctggccccaaaaacgggcctggccccccttgggaaagggcatttcttgaaaaattttcgaattttttaaggggtttaaaaaaacaactgtttcatgccccatccctgccccccccaaaaaaattttttgaggggaccccctctccccccagaactttgtaaaaagggtggcggaggccctt

SEQ ID NO: 80416 - DNA, 899 bp, Zea mays
  misc_feature: Ceres CLONE 1565718
  misc_feature: Encodes the peptide sequence at SEQ ID NO. 80417
tccccgcggtggcggccgctctagaactagtggatcccccgggctgcaggaattcgtctcacccctagaaaaaacagtcacacaccgctgcttcaagaaaccaccgagagcccaagcgcgcaaggcaggagagagagagagagagagcagggagagaagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccgggctctccggaggacacatcaaccccgctgtgaccttcgggctgttctttgccaggaaactgtccctgactagggccctcttctaccttatcatgcaatgcccgggggccatctgtggagcctggagtggtgaaagggtttccccccgggggcttttaatggggcaacgggggggggcgcccaatgttttttcccccccggggtcacccaaggggggattggccctctggcccctaaaatatttggggacccttctttctgggtgttaacccggactttcttgggccccccgatgtcctaaaggaaaaccccccgggggttcccccttgttccccactccctttggccccaatggtggatattgggggttccgcggggtgttc

SEQ ID NO: 80417 - protein, 201 aa, Zea mays
  misc_feature: Ceres CLONE 1565718
  misc_feature (50)..(193): Pfam Name: MIP Pfam Description: Major intrinsic protein
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGLSGGHINPAVTFGLFFARKLSLTRALFYLIMQCPGAICGAWSGERVSPRGLLMGQRGGAPNVFSPPGSPKGGLALWPLKYLGTLLSGC

SEQ ID NO: 80418 - DNA, 888 bp, Zea mays
  misc_feature: Ceres CLONE 1565719
  misc_feature: Encodes the peptide sequence at SEQ ID NO. 80419
  misc_feature (351)..(351): n is a, c, t, g, unknown, or other
  misc_feature (888)..(888): n is a, c, t, g, unknown, or other
ctccccgcggtggcggccgctctagaactagtggatcccccgggctgcaggaattcgtctcacccctagaaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccancatgttgaggaggccgagaagatgggacttgactacatggatgttgaggctctcaagaaaatgaacaagaacaagaagcttgttaagaggcttgcccagaagtaccatgctttcttggcatcagaggccatcatcaagcagattccccgtctccttgggcctggtctcaacaaagcaggcaagttccccaccctggttactcaccaggaatccctccagtccaaggtgaagaaaactaaagcaacccgcagttcccgcctcaagaaggttcttttcatgggggttgcccttggcaacttggccgatggaggaaaaacaaatcccgccgaaacatcccgatgaagggccaactttcctgggtttcccctttttaaaaaaaaaaatgggcaaaatggggggaaacccttcaccctccaaaaaacccctggggggaaggcccaccacggggtggttgttaaaaaaatactcctcttttttgtaaagacacccctaggggtttttggcgcccccaagggtttttattttgaagataaaaan

SEQ ID NO: 80419 - protein, 184 aa, Zea mays
  misc_feature: Ceres CLONE 1565719
  misc_feature (9)..(180): Pfam Name: Ribosomal_L1 Pfam Description: Ribosomal protein L1p/L10e family
  misc_feature (71)..(71): Xaa is any aa, unknown, or other
MSKLQSESVKDAISQIVGDAKEKNRKFTETVELQIGLKNYDPQKDKRFSGSVKLPHIPRPKMKVCMLGDAXHVEEAEKMGLDYMDVEALKKMNKNKKLVKRLAQKYHAFLASEAIIKQIPRLLGPGLNKAGKFPTLVTHQESLQSKVKKTKATRSSRLKKVLFMGVALGNLADGGKTNPAETSR

SEQ ID NO: 80420 - DNA, 839 bp, Zea mays
  misc_feature: Ceres CLONE 1565723
  misc_feature: Encodes the peptide sequence at SEQ ID NO. 80421
tggagctcaccgcggtggcggccgctctagaactagtggatcccccgggctgcaggaattcgtctcacccctagaaaaaaaaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagctgctccccccagagctgcacgagatgcgcggcggcctgatccgcctctgcgccgacgcggaggcgctgctggaggcgcactactccgacctgctggcctccttcgacaacccgctggagcacctgtcgctcttcccctacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaacctccgggcgcctccttcgacaactacgacatctgcggggagggcaacgaccgggcgccggacgcttgttctccggccacggcgctctccaggcgcgcctgggcgttcccccaactcgaaagttggcggacgtgaacccgggaagtgggcgttcttaccaaca

SEQ ID NO: 80421 - protein, 226 aa, Zea mays
  misc_feature: Ceres CLONE 1565723
  misc_feature (38)..(227): Pfam Name: NAS Pfam Description: Nicotianamine synthase protein
  misc_feature: SWISSPROT Homolog: EC 2.5.1.43 Nicotianamine synthase
MVVMGKEQQHEEEEVQGKVVQEEVQVVQETVVPVPSEEDKEAEAALVHKISSLAAAIAKLPSLSPSPEVNALFTELVTACIPRSSVDVELLPPELHEMRGGLIRLCADAEALLEAHYSDLLASFDNPLEHLSLFPYINNYILLSQLEHGLLARHVPGPAPARVAFVGSGPLPLSSLVLAARQPPGASFDNYDICGEGNDRAPDACSPATALSRRAWAFPQLESWRT

SEQ ID NO: 80422 - DNA, 847 bp, Zea mays
  misc_feature: Ceres CLONE 1565724
  misc_feature: Encodes the peptide sequence at SEQ ID NO. 80423
  misc_feature (705)..(705): n is a, c, t, g, unknown, or other
  misc_feature (706)..(706): n is a, c, t, g, unknown, or other
  misc_feature (744)..(744): n is a, c, t, g, unknown, or other
  misc_feature (750)..(750): n is a, c, t, g, unknown, or other
  misc_feature (753)..(753): n is a, c, t, g, unknown, or other
  misc_feature (754)..(754): n is a, c, t, g, unknown, or other
  misc_feature (821)..(821): n is a, c, t, g, unknown, or other
ctccccgcggtggcggccgctctagaactagtggatcccccgggctgcaggaattcgtctcacccctagaaaaaatccaagcccccgaatcccccgggcgcgcgcagcacaaccttgccgcgatcgcgcgcgggaaccgccgctgattgggtcgtgaaagctcgattttggcgattttgattcggagaacccgccgtcattcgattttggcgcgcgttgcgagccgggatggggttgcagcagtccaaagaggaactgctgtaccagcaggtcaactacggcaacgtcgacgggattcgcacgctccgggggcaaggcgctggtctcgagtggattgacaaggaaggcaagacgcccctgatgcttgcctgtatgcgcccggatctgttcgacgtggccaaggtgctgatcgagttgggagctaatgtgaatgcctacaggcctgggtcacactgtgggacagcattgcaccatgctgccaagaaaggacttcagcagactgtccatttactactctcacatggagctaatccgttcataccaaacgatgattgcaatactgccctcgaattggcaagagaaaagggtcatgtgaatgttgtacgtgccatagagggacggctttgtcttttttgcggatggatgagagagaactatgctcctgcttttttggatgcaattgctccacagttcatgacaagaaannatttgggctgtgttttaccccgtgaagtgcgaactccnacaggnccnntcttagtagagatagctatatatcccgaattacaggcatctaaaccacgtgctgtacttaaactatnggaatgcccaattgagcacccaagct

SEQ ID NO: 80423 - protein, 206 aa, Zea mays
  misc_feature: Ceres CLONE 1565724
  misc_feature (75)..(107): Pfam Name: Ank Pfam Description: Ankyrin repeat
  misc_feature (39)..(72): Pfam Name: Ank Pfam Description: Ankyrin repeat
  misc_feature: SWISSPROT Homolog: EC 2.1.1.43 Histone-lysine N-methyltransferase
  misc_feature: The sequence is a functional homolog of SEQ ID NO 413 in the 11/479,226 US patent application
  misc_feature: The sequence is a functional homolog of SEQ ID NO 834 in the 11/435,388 US patent application
  misc_feature (159)..(159): Xaa is any aa, unknown, or other
  misc_feature (160)..(160): Xaa is any aa, unknown, or other
  misc_feature (176)..(176): Xaa is any aa, unknown, or other
  misc_feature (198)..(198): Xaa is any aa, unknown, or other
MGLQQSKEELLYQQVNYGNVDGIRTLRGQGAGLEWIDKEGKTPLMLACMRPDLFDVAKVLIELGANVNAYRPGSHCGTALHHAAKKGLQQTVHLLLSHGANPFIPNDDCNTALELAREKGHVNVVRAIEGRLCLFCGWMRENYAPAFLDAIAPQFMTRXXLGCVLPREVRTPTGPXLVEIAIYPELQASKPRAVLKLXECPIEHPS

SEQ ID NO: 80424 - DNA, 1234 bp, Zea mays
  misc_feature: Ceres CLONE 1565725
  misc_feature: Encodes the peptide sequence at SEQ ID NO. 80425
  misc_feature (62)..(62): n is a, c, t, g, unknown, or other
  misc_feature (68)..(68): n is a, c, t, g, unknown, or other
aagtgaaaaggtcgaggttatcctcacataagcactttcccttcattccaccgtatatactnccctcncctccccaaaactggagctccccccggtggcggccgctctagaactagtggatcccccgggctgcaggaattcgtctcacccctagaaaaaaccaagcccccgaatcccccgggcgcgcgcagcacaaccttgccgcgatcgcgcgcgggaaccgccgctgattgggtcgtgaaagctcgattttggcgattttgattcggagaacccgccgtcattcgattttggcgcgcgttgcgagccgggatggggttgcagcagtccaaagaggaactgctgtaccagcaggtcaactacggcaacgtcgacaggattcgcacgctcccggggcaaggcgctggtctctagtggattgacaaggaaggcaagacgcccctgatgcttgcctgtatgcgcccggatctggtccacccccccaaggtgctgatcgaggttgggagctaaagtgaattgcctaacaggcccgggagtcacactggtggggaaaaacatttgcacccatggcttgccaaaaaaaagggactttcagccaggaactgggcccaatttaagcttacctccttcccccctgggagaaggctaaagaaccggtttcccttcccccaacacccaagagtaattttgccccaaatacctggcctccccttcctaaaaaatatggggcccaagaaaaaagaagaaaaaggggtgttcccttggttgtgcaaaattgtgtgtttgtgaaaagcttattgcgcccccacatatattaaagaggggggaaacacgcgcgcgcctttttgtggggcgccgctttttttttttcgttcccgcgaaaaagtggggtatagttgaaacagaggaaagagaaaacacttcggtggcttctccgcgtgggccttttttttttttgggggaggaagtctcaaaattgttggcttttccccccccgagttttcctcgggtagagcacacgaaataaaaatatattgtgagggccgcggagcggtattatttaaaccccccgcatggaaaaagtgggcgagaaaactctccaagacccaagaaccttctcttttaaaattttaagaggatagagttttatatattacttccccaaattataaacgcgggcatcccttaacaccacaccgggcggtgttcccttaaaaattattgcgaaagagcg

SEQ ID NO: 80425 - protein, 33 aa, Zea mays
  misc_feature: Ceres CLONE 1565725
MGLQQSKEELLYQQVNYGNVDRIRTLPGQGAGL

SEQ ID NO: 80426 - DNA, 764 bp, Zea mays
  misc_feature: Ceres CLONE 1565727
  misc_feature: SWISSPROT Homolog: EC 3.1.3.37 Sedoheptulose-bisphosphatase
ctggagctccccgcggtggcggccgctctagaactagtggatcccccgggctgcaggaattcgtctcacccctagaaaaagtgatccattcatccccgcgccgtgctagcttgctagttgcaagcaccagccgaccaccaaacgatagcgcacgcggacaatttaacagcatcaggtttaggccctgctgccgtcgtcgagcgcccgggccaccgcacacctgaaagcaatggagatcgtcgccacgcgctccccggcctgctgcgccgccgtgtccttctcccagtcgtacaggcccaaggcgtccagggccgccgaacacgtttctacgggcgagtcgggtgccgggtgaaacacgggggcgggcccggctcttcgggcaagggagggcaggtccaaaggggggggccaagcccgccccccggcccccttaaagggcccccgggggggccgaaaaaaattggggaaaaaaacacccccccgggaaaggggaaattttttcccttggaaacccaaaaggggggggaaaaaacccccccgggaaaaaaaaaaaaaaacccccctttcttttatggggggggggtggggttccttacttttttttttaaaaaaagaggggggggggggggggggagaggcccccccttctgtggggggggggggcgaaaaacatatctccgcgcgccggtttttttttataaaaaaaaaggggcgcccctccccaaaaaaaaaaaagaaaggagggcttttgttcctctttttct

SEQ ID NO: 80427 - DNA, 832 bp, Zea mays
  misc_feature: Ceres CLONE 1565729
  misc_feature: Encodes the peptide sequence at SEQ ID NO. 80428
tggagctccccgcggtggcggccgctctagaactagtggatcccccgggctgcaggaattcgtctcacccctagaaaaagacaagtgcagtcacccgagccgcaaactgcagctctgcaagctacagaggcgaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctgcgaccgcttccagacgctcgcgttccaccaggtggagctctggtgcgccgacgcggcctccgcagcgggtcgcttctccttcggactgggcgcgccgctcgacgcaggctccgacctgtccacgggcaactccgcgcacgcgtccctgctgctccgctccggctccctctccttcctcttcacggcgccctacgcgcacggcgccgacgctgccaccgccgcgctgcgctccttctccgccgccgccgcgcggcgcttcggagccgaacactgggctcgcggtgcgcgccgtcgcgctccgcgtcgccgacgccgaggacgccttccgcgccagtgtcgcgagcggagcgcgcccggcggttcgtccccgtcgacctcgggcgcggattacgcctcgacgaggtcgagctctaccgcgacgtcgtgctcttgtacgtgagctaccctgatcgcggcgcgggcgagcccttcctgccgggggttctagggcgtgggcagtccccggggcggacgactacg

SEQ ID NO: 80428 - protein, 185 aa, Zea mays
  misc_feature: Ceres CLONE 1565729
  misc_feature: SWISSPROT Homolog: EC 1.13.11.27 4-hydroxyphenylpyruvate dioxygenase
MPPTPTAAAAGAAVAAASAAEQAAFRLVGHRNFVRFNPRCDRFQTLAFHQVELWCADAASAAGRFSFGLGAPLDAGSDLSTGNSAHASLLLRSGSLSFLFTAPYAHGADAATAALRSFSAAAARRFGAEHWARGARRRAPRRRRRGRLPRQCRERSAPGGSSPSTSGADYASTRSSSTATSCSCT

SEQ ID NO: 80429 - DNA, 846 bp, Zea mays
  misc_feature: Ceres CLONE 1565730
  misc_feature (678)..(678): n is a, c, t, g, unknown, or other
  misc_feature (685)..(685): n is a, c, t, g, unknown, or other
  misc_feature (781)..(781): n is a, c, t, g, unknown, or other
tccccgcggtggcggccgctctagaactagtggatcccccgggctgcaggaattcgtctcacccctagaaaaaactgcctaaaatcttgccgactgtttctggttcctgcacagactccgtatgccatgggtataaaaatggaggtggagcagttctggcttggcagcttcaccttgactccgggagggcgtccagggactcgctaggcgcgtatggtgcgcggggcggctggcgatgtctcgccggtgttgggaaccatgccacgtcgtggccagggactacgattgcacgatggctgcagtgaggtcacgtgtcatctgaagagcaagttggtacctggaatctcaagtcccaggcaagttgtgcccttgatcacttctttttacccagccatgttctgattaatcataatgatctgcataggttaattttgatgggacccaataggttaccctagtttgattatctttataccttgttaccactgaactttttgggtagtacttgctagtgctttatgtggttttgggtatgaagatgcattactcatgattatacttttgttatccgttgttatttatcgttcatgataagatcattatgttaattggaacatggagcgaccacccgggaaaacagtgctaccacaagggtataatgggacgcccttggctganttaatangaaagctagtggaggactaccttaccctgaaggggcaggacagtaggggagtggtcagtgtagggaggcccctcgggagattttgctgccatggcngtcctgcaggggattcctgcattggagctcctataaactgtagcgggtttctgaggctagtggaa

SEQ ID NO: 80430 - DNA, 882 bp, Zea mays
  misc_feature: Ceres CLONE 1565731
  misc_feature: Encodes the peptide sequence at SEQ ID NO. 80431
  misc_feature (190)..(190): n is a, c, t, g, unknown, or other
  misc_feature (388)..(388): n is a, c, t, g, unknown, or other
  misc_feature (406)..(406): n is a, c, t, g, unknown, or other
  misc_feature (453)..(453): n is a, c, t, g, unknown, or other
  misc_feature (457)..(457): n is a, c, t, g, unknown, or other
  misc_feature (458)..(458): n is a, c, t, g, unknown, or other
  misc_feature (556)..(556): n is a, c, t, g, unknown, or other
tggagctccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcnggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatncgcagcctggagacgccngtcacctcgagcccgctcgtggcgtggtacctctccaaccttccggnctanncgcacggcgtgagcccgctgctgcggggcgtcgaggtcggcctcccgcacggctaccctcctcgtggggcccttcccgctcacgggcccgctccgaancacgcccgtgcacgggcaaggcggggccgcttgggcccccccgggctttttcccatccttagggtttggcctcacaatggaagggggttccctcctttaaagagggggggacccgttcccggggccccttttttacctttcccgggggggaaaaaaagggagcccaaaaattttaaaaccccccaagggtggggacaatttcccccgggggaatttttttttgggggaattttcccggggggtcttgggggccctttttttcccccagggggtggcccaccccccctattttttagaaaaaaaaaatctcaaaagagggtcttttt

SEQ ID NO: 80431 - protein, 220 aa, Zea mays
  misc_feature: Ceres CLONE 1565731
  misc_feature (44)..(202): Pfam Name: PsaL Pfam Description: Photosystem I reaction centre subunit XI
  misc_feature (56)..(56): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (112)..(112): Xaa is any aa, unknown, or other
MASQVMKSSLVVHSRPRGLSGAAALTRRPGRFTVKAIQPEKATYQVVQPINGDPFXRSLETPVTSSPLVAWYLSNLPXXXHGVSPLLRGVEVGLPHGYPPRGALPAHGPAPXHARARARRGRLGPPGLFPILRVWPHNGRGFPPLKRGGPVPGAPFLPFPGGKKREPKNFKTPQGWGQFPPGEFFFGGIFPGGLGGPFFPPGGGPPPLFFRKKKSQKRVF

SEQ ID NO: 80432 - DNA, 837 bp, Zea mays
  misc_feature: Ceres CLONE 1565735
  misc_feature: Translation starting site: 256
  misc_feature (532)..(532): n is a, c, t, g, unknown, or other
ctccccgcggtggcggccgctctagaactagtggatcccccgggctgcaggaattcgtctcacccctagaaaaagctagcggtaaccgtcgcctcacttccgcagcaccggcgcggcgactattagctatagccgagtaggcgcagccgcgcacggcgcacccctcgtgttcccttttcgtccttgttcctcaacgtcgccggtgcgcccgcctcctgcctctctccccctgcgagcgatcgtgaggggatcgggatggcctcccaccattccgagcccctcgaccccgccgacgctgacgacccctcagataacaacccagaattaccatgcccctcctatcatatcgttaccaaacctggtcaactcccagtcgagtttcttgaaccctcagctgcccacaagttggtaattggatttgactgtgaaggtgttgatctctgccgcaatggtgctctctgtattatgcagcttgcattccctgatgctgtttacctagttgatgctattgagggtggaaaagaacttattncagcttgtaagcccgcacttgagtctgatcatatcaccaaagttattcatgattgtaaaaagggacagtgaggctttgtatttatagtttggcataaaactgcataatgtgatggatacacagattgcttattctctgataaaagagcaggaacaggaaggaaaaaagatgacatctgatgattacaattacatatctttttgtcagcccttcttgctgaataacgatactggtggcatactatatcctggaaaaggaggagttcggtaccccttctagggaaggaccctaacttttgggaaaac

SEQ ID NO: 80433 - DNA, 844 bp, Zea mays
  misc_feature: Ceres CLONE 1565737
  misc_feature: Encodes the peptide sequence at SEQ ID NO. 80434
  misc_feature (661)..(661): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (680)..(680): n is a, c, t, g, unknown, or other
  misc_feature (817)..(817): n is a, c, t, g, unknown, or other
agctccccgcggtggcggccgctctagaactagtggatcccccgggctgcaggaattcgtctcacccctagaaaaaatctcgactcgtggggaagtttcgctctcgcccgcgtcgacttcctagggttcgaggaacgtccgtccgtccgtccggggaaggagcaggagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggttggtctgaattctgaagtcatgggtgcaattcgcttcgcggtgatctcttaagctcatcacatatataaaagcaacctcagttggctatgtaagacatggcgtgccaaactatcagtgaccactgccagctttgcaatacgttgttgtatggtcaacctgcaaacttggtgtactgctactcgtactataaataacatagggttttaacccttggttgtgctaaaagaganggncnncaaacgccccccncaaaaagaaaaaaaaagcggcgcccgtcgcctccctttccccttccgtccctccctatccccgcgggccgccaaagggcattttcgccctcgattcgacgcccaattcgttccgcccgcgacccgggattccttccncccagcgcggatctgaacgcttgcccc

SEQ ID NO: 80434 - protein, 73 aa, Zea mays; identical to SEQ ID NO: 58555
  misc_feature: Ceres CLONE 1565737

SEQ ID NO: 80435 - DNA, 765 bp, Zea mays
  misc_feature: Ceres CLONE 1565738
  misc_feature: Encodes the peptide sequence at SEQ ID NO. 80436
  misc_feature (390)..(390): n is a, c, t, g, unknown, or other
  misc_feature (538)..(538): n is a, c, t, g, unknown, or other
ctccccgcggtggcggccgctctagaactagtggatcccccgggctgcaggaattcgtctcacccctagaaaaaaggggatcaagttcgcttctgccagtctgcctgcgtgctctgctggacagctggagagctagatggcgatgccgtccgggtggaggggtatcctgggcttccactacggcatcgtgcaggcgccgttgggccccgacatctccggccccgagctcgtcgccgccgtagcgaacgccggcgccatcggcctcctccgcctccccgactggccggcgccggatcacgtcagagaactgatccggaagaccaggagcctcacgtccaagccgttcggggcggccatcgtgctggccttcccgcacgaggagaatctcanggtcgtcctggaggagaagctcgccgtgctgcaggtctactggggggacttccccaacatcggggtcaagaagcgcatcgcgccggggttaaagtcttgcatcaggtcggcagccttgaggaagcagctaaagctaaagaagccgggntagatggggatcattgtttcagggaactttagggcaggggggtcatttaaattgggtcagggaaaggaatgttttccccctggttccccccaaaaaaaaaaaaatcttttgttttcaaaaccccgaggaattttcccctttttttttgcccccccggggccggaaaattttttaaaatgggggacccggggggcattattttttcccccccactttttgggcccccc

SEQ ID NO: 80436 - protein, 134 aa, Zea mays
  misc_feature: Ceres CLONE 1565738
  misc_feature (85)..(85): Xaa is any aa, unknown, or other
MAMPSGWRGILGFHYGIVQAPLGPDISGPELVAAVANAGAIGLLRLPDWPAPDHVRELIRKTRSLTSKPFGAAIVLAFPHEENLXVVLEEKLAVLQVYWGDFPNIGVKKRIAPGLKSCIRSAALRKQLKLKKPG

SEQ ID NO: 80437 - DNA, 891 bp, Zea mays
  misc_feature: Ceres CLONE 1565739
  misc_feature: Encodes the peptide sequence at SEQ ID NO. 80438
  misc_feature (508)..(508): n is a, c, t, g, unknown, or other
  misc_feature (624)..(624): n is a, c, t, g, unknown, or other
  misc_feature (625)..(625): n is a, c, t, g, unknown, or other
  misc_feature (745)..(745): n is a, c, t, g, unknown, or other
ggagctccccgcggtggcggccgctctagaactagtggatcccccgggctgcaggaattcgtctcacccctagaaaaagcgcactctctgactcagctacgatctgaaagaaacccgccaccagctctcgtccttccttctctccaatccaaccgcaatcctttcagcttcagcttcttctgctccttctctggtgaggaggcgtggtgagagactgcgactgcgcgatggaggcgtcgtcgtcggcgttggcgctcgtggccgccgtgctcctcctctcctccccgctcgctgcgtcagatttctgcgtgtgccgttcggaccagccgacggcggtgctgcagaaggcgatcgacttcgcgtgcggcccgcagggcggcgccgactgcacgcccatcctgcagggcggcgggtgctacagcccggacacccgccgcgcgcactgctcctgggggcgccaacactactaccagaacaacaaggcccaggggcgccacctgcgactttnggcggcgcaagcaccgttcttcaccacccgacccgaggtttctcccggggcacttttcgctttcagggggcacaaccccccggtgctggggactggaaacggggaaaggggggaannaaacctttaagcccccgggggggggacccgggtttaaagggacccgggaaaacggaagggggggggaagcaaaaataaccgggctggggaaccccggggaaaaaccctttttacactccnccccccccccccccccgcggggggttttttccaaaggcccgggcctcctgggggttcaaaatttcggggtcctttcttcttttaaaacaaaaaacgggggggggccaataaaagggggaccctcccccccccctctatatgtgggt

SEQ ID NO: 80438 - protein, 135 aa, Zea mays
  misc_feature: Ceres CLONE 1565739
  misc_feature (25)..(100): Pfam Name: X8 Pfam Description: X8 domain
  misc_feature: SWISSPROT Homolog: EC 3.2.1.39 Glucan endo-1,3-beta-D-glucosidase
  misc_feature (94)..(94): Xaa is any aa, unknown, or other
  misc_feature (133)..(133): Xaa is any aa, unknown, or other
MEASSSALALVAAVLLLSSPLAASDFCVCRSDQPTAVLQKAIDFACGPQGGADCTPILQGGGCYSPDTRRAHCSWGRQHYYQNNKAQGRHLRLXAAQAPFFTTRPEVSPGALFAFRGHNPPVLGTGNGERGEXNL

SEQ ID NO: 80439 - DNA, 859 bp, Zea mays
  misc_feature: Ceres CLONE 1565741
  misc_feature: Encodes the peptide sequence at SEQ ID NO. 80440
tccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaagtgtggccggcctacggcaacaagaagttcgagacgctgtcgtacctgccgccgctgtcgacggacgacctgctgaagcaggtggactacctgctgcgcaacggctggataccctgcccccagttcagcaaggtcggcttcgtgtaccgcgagaactccacctccccgtgctactacaacggccgctactggaccatgtggaagctgcccatgttcggctgcaacgacgccacccaggtgtacaaacgagctgcaggaagccatcaaatcctaccccggacgccgtccaccgcgtcatcggcttcgaacacatcaagcagaacgcagtgcggcagcttcatcgcctacaaacccccggggcgcgaactagaccgcgcccgccgggccgccccccggccgggtagctataactcccggggggagcaagtagctagatagggccatgcggctttcctctgtcctttggggttttgcattaggggggaaccggaaccccttgaggttgcctgggggttttttcctttccccattttccccttttttttttttcttttttcccgcgggcccaggggtttcc

SEQ ID NO: 80440 - protein, 194 aa, Zea mays
  misc_feature: Ceres CLONE 1565741
  misc_feature (58)..(167): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLLRNGWIPCPQFSKVGFVYRENSTSPCYYNGRYWTMWKLPMFGCNDATQVYKRAAGSHQILPRTPSTASSASNTSSRTQCGSFIAYKPPGRELDRARRAAPRPGSYNSRGEQVAR

SEQ ID NO: 80441 - DNA, 928 bp, Zea mays
  misc_feature: Ceres CLONE 1565742
  misc_feature: Encodes the peptide sequence at SEQ ID NO. 80442
  misc_feature (75)..(75): n is a, c, t, g, unknown, or other
cgtgtttccaccccccttaatccactcagcgtggcgggccagaccacattattataccttatcatgccaataaancaaagctggaactccccgcggtggcggccgctctagaatagtggatcccccgggctgcaggaattcgtctcacccctagaaaattcgttccatcccttcaccacacacaccattcctgggcctgggcgacaaggccacacacgatcgccggcagtttccgaaacgagaaaaggaagaaacaggaggcgagagatcgagatcgatgagcagcggtcagtcgtcgccatgcccacatggcggcgcccggccgggagcgagcccctccaagaagctgtggcgcggggtgcaagccgtctacctcgtcctcgtcaagaagcaccagccgaagctcgccgcgttcggcgtccacatgcaccgcctcctctccagcagcaagcgccgccgccgccgccacctcgccgcgcgggggcgggagcagaacccggcgctgacgtacatgtcgtgccggtccatggaccccgctgccgcggtggtgcacccgtacccgcacagccacggccacggccgccggcgcgcgccgtcgaggtcgaggtcgaggtcgaggctcgcggccccgtcgtccctgtcgtgccggtccttggaccccgccgccgccgtgcgcagcaagtaccagtaccgtcccccccgaggtggagttcagctgcaagagcacgccgatgcacacacgccggcgccgcctgcgcctgcatcagggccgcggccacccgtcggacccggagccggaagcggcacgtctcggccccggcggttgacaaggcctgttcccgctcagtgaacaacgtccaaggtccaggaaggccgccggaaccgccaatctgggggcctgggccctgggccctggaaagcccccggt

SEQ ID NO: 80442 - protein, 190 aa, Zea mays
  misc_feature: Ceres CLONE 1565742
MSSGQSSPCPHGGARPGASPSKKLWRGVQAVYLVLVKKHQPKLAAFGVHMHRLLSSSKRRRRRHLAARGREQNPALTYMSCRSMDPAAAVVHPYPHSHGHGRRRAPSRSRSRSRLAAPSSLSCRSLDPAAAVRSKYQYRPPRGGVQLQEHADAHTPAPPAPASGPRPPVGPGAGSGTSRPRRLTRPVPAQ

SEQ ID NO: 80443 - DNA, 896 bp, Zea mays
  misc_feature: Ceres CLONE 1565743
  misc_feature: Encodes the peptide sequence at SEQ ID NO. 80444
ctggagctccccgcggtggcggccgctctagaactagtggatcccccgggctgcaggaattcgtctcacccctagaaaaagtgctgctggccaacgacctgttcggcgtcaagcccccggcgtccgcgccgcccgccgccaggaagccggccaagggcgggtccgtcgccgaggcgcccgccgccggctcggctgacgcgccgccctccggcgcggccgcgcgcggcgccagcaggaccgccggatggagctcgctgcccgctctgctgttcctggccgccgcggcctccttcctgtccctgttgtgagaatgtaaacatggttcgtgcttgtcgagcacaaaagagctcgtcttcttgcggtttgtttctcttctggagttctagtaacctggatctgtccctgaatgttgatgaagccagctgttaatttctccatgcatcttttcttctcatgagtggtctcgagtctgaccgtgcatggctaagattagaaattttttctccttcttttgttagcagaatcggtagtgctccggttgctcagcgttgtttcagtttcagaaaaaaaaaaaaaaaaacgggcccctcgagggcccccatttcccccttaaggggggcgattttacccgcgcctccccggggcccccgtttttaaacctcccgggacgggggaaaacccggggggttccccaattaaatccccttggggaaaatcccccctttttcccccgggggggtaaaaaagaaaaaagggcccccccacaattcccctttctcaaaaattttgccccccccttggggggggaagagaaaaattttggcccctataattttttttaaaaacacccccgcaaatatttttttggaaaaaacactccctttttttttttcccc

SEQ ID NO: 80444 - protein, 101 aa, Zea mays
  misc_feature: Ceres CLONE 1565743
GAPRGGGRSRTSGSPGLQEFVSPLEKVLLANDLFGVKPPASAPPAARKPAKGGSVAEAPAAGSADAPPSGAAARGASRTAGWSSLPALLFLAAAASFLSLL

SEQ ID NO: 80445 - DNA, 1242 bp, Zea mays
  misc_feature: Ceres CLONE 1565746
  misc_feature (487)..(487): n is a, c, t, g, unknown, or other
taattttgtgcccccgtggaaaggaggtaacccccccccttactccccccttttcaccccaaaataaaaaaaactggagctccccgcggtggcggccgctctagaactagtggatcccccgggctgcaggaattcgtctcacccttagaaaaaaattgctgacgattctcctgcatctagattcggaggtatttcccaggcttcttcgaggaggttggtaggtagctgatcagaggaagggatctgttgtaatggcttcattgtacagaccgacaccttgatgcccctgtgatacctcaagagcggtaggactagtaccgcgacttcggagtttcttcgaaaagtctggttttcttctagaacaacaggttggggggttggttttttttcatgagtagagggggcggaaacgatcaaagacggggacctagatgttaaacagtgtggggagagttgagttttgtttgggaatggtgaggtggaccanaccccaaattcataaaccacaatgctggaggcttcatgttccagatggttagggaattgttggtccagacgtggcgaattttcgcattctaggatgggccctgcggggaaaggaatttgagtaccttgtatagttgaaaggcggatttgaaaagggctgccgagagattttaaaaacctggtttggaagggaaacttaaatcgggtggaaccaaaattagtgtgtcgcgagaaaccttcacagcttttgccgagggagtgttattgggagagactgaatgaggggatatagtggtaaggccgtgtgggagaacactcccctcaagggagggcttcgcgaaaataattgtgtttgtctgagccccccggtgattatgaggggtgaccgagtaaagactattattgctctctgatagtattgagatgcataccgcgtcgataagggtgagaggaccgccatgtgtgaataagacaatgtatgaccggtgtgttgctgtaagggggaattttcgttgccccgacgagaatgagtggagaattagttcaggcggacggtttagaataggatgcgtacgtgaggggagcacagagggtatttcagttgagacgcctatatattgtgtgatgagcgagaatggggttgtattcacaccagtggtgtttgtacaagagcgcctttacatggggtcttttcataagtgttgaggggatgagggaagcccatatagggtggttcgtagagaccctttataagcg

SEQ ID NO: 80446 - DNA, 893 bp, Zea mays
  misc_feature: Ceres CLONE 1565747
  misc_feature: Encodes the peptide sequence at SEQ ID NO. 80447
  misc_feature (641)..(641): n is a, c, t, g, unknown, or other
  misc_feature (645)..(645): n is a, c, t, g, unknown, or other
ctccccgcggtggcggccgctctagaactagtggatcccccgggctgcaggaattcgtctcacccctagaaaaaacaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaaagtcagtccaccccgttgcagccctacagcgaggtgttcggcctccagcggttccgcgagtgcgagctcatccacggccgctggggcatgctcggcaccctcggcgccctctcggtcgaagggctccaccggcgtcacctggcaggacccccgcaagttggaactggtngacngggtcctcctatctggggcaagccgctgccggtttctcatttggacgttaatttgggattgagggggccccggaaatcggttactttaagtttccaggcaaacccccgaattttaacccgggagaaaaagaggttttcccccggggggtctctaattttaaacccctttgggcttgggggggcaaacctcttaaaaaaaaggaccgttcctccttggggagaaaaaaaaaaaccggcccccccttcca

SEQ ID NO: 80447 - protein, 258 aa, Zea mays
  misc_feature: Ceres CLONE 1565747
  misc_feature (63)..(245): Pfam Name: Chloroa_b-bind Pfam Description: Chlorophyll A-B binding protein
  misc_feature (175)..(175): Xaa is any aa, unknown, or other
  misc_feature (176)..(176): Xaa is any aa, unknown, or other
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSESQSTPLQPYSEVFGLQRFRECELIHGRWGMLGTLGALSVEGLHRRHLAGPPQVGTGXXGPPIWGKPLPVSHLDVNLGLRGPRKSVTLSFQANPRILTREKKRFSPGGSLILNPFGLGGANLLKKRTVPPWGEKKKPAPPS

SEQ ID NO: 80448 - DNA, 806 bp, Zea mays
  misc_feature: Ceres CLONE 1565752
  misc_feature: Translation starting site: 209
  misc_feature (421)..(421): n is a, c, t, g, unknown, or other
tggagctccccgcggtggcggccgctctagaactagtggatcccccgggctgcaggaattcgtctcacccctagaaaaagcgttcccaacctacccctgcaagccattgccctcgcctatcgcctcgtgcaagtccaagctcccacgactccaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgcccgtcaggttacatcnaccctatggcaaatactgtgcatcataatgaaaatgctacaacggggcagtttgcattcaccacttcagaagctggaaactacccttgcatggttctggatagacagcttggagaaaggatcaagaacatttctaattcttgattggaaaatagggattgctgccaaggactggggatacttttgctaaaaaaaagaaaaattgaggggcttagaacttgaacttttgggaaactttggaacttggcggcccgaagcccatcccccccaaaaaacttgggggggtttcctcaaagccaaggggaaaaccttgaaatttgggaaaaagggtggggcggaggaaaaaccaaaatttttcagaggtgtgtccccggggtttacacaac

SEQ ID NO: 80449 - DNA, 893 bp, Zea mays
  misc_feature: Ceres CLONE 1565753
  misc_feature: Encodes the peptide sequence at SEQ ID NO. 80450
ctccccgcggtggcggccgctctagaactagtggatcccccgggctgcaggaattcgtctcacccctagaaaaaaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctcctattcgaggtcatggagtaccatctcctcaccttggtgtgccactgtctcatcctctcgctgggcatcctcttcctgtggtccaatgcctccactttcatcaacaagtccccacccgaacattcctgaggttcaaatccctgaagatgtgcctgttaatggttgccctgtccctgaaatatgaaatcaacaggggcctggctaccttaagggaaatggggcatggcccttgatcttaaaaaattctaaatttgttttggggggcccggggtttctttaagttttcgggggatggggggaattttccgaacactgttttatttgggtttttggggcctgtcacccggacccattttttttttaaaaaaaatgggggaaaggtgttggtcttttttgtgggagaggggtttctccctcccccaaaaaaatttttgcccctttttgagggaaa

SEQ ID NO: 80450 - protein, 138 aa, Zea mays
  misc_feature: Ceres CLONE 1565753
  misc_feature (72)..(138): Pfam Name: Reticulon Pfam Description: Reticulon
MADHKEEPVPESVMDKITEKFHGGDSSSSSSDSDDEKKGSSLASAAEAMKAKIYRLFGRERPVHSVLGGGKPADLILWRNRKISGGVLAGATAIWLLFEVMEYHLLTLVCHCLILSLGILFLWSNASTFINKSPPEHS

SEQ ID NO: 80451 - DNA, 775 bp, Zea mays
  misc_feature: Ceres CLONE 1565755
  misc_feature (304)..(304): n is a, c, t, g, unknown, or other
  misc_feature (316)..(316): n is a, c, t, g, unknown, or other
  misc_feature (412)..(412): n is a, c, t, g, unknown, or other
ccccgcggtggcggccgctctagaactagtggatcccccgggctgcaggaattcgtctcacccctagaaaaagcgtactccgccaccaaccgcttttgcttgccgctactcgccgcctgccaaaagcagccgtcctccctagctcgcccgcccgaagcgacgcctgacttcgcatctgtttcgttccacccgccccgcgagaagcttctagaagggggagacccgccggagccatgccggaggaggagtcgacgtcgatcccgcttcaggcagggcgcgggagccgtcgaccccgaggacccangcaagtcggcgncgcgacccagtttgcccaccaacttcaaaggaaaggcatgcttgtgcttgttcttcaaagttgggccttaagaaaaattatgactgggaggggaanccctttttcttggttggagccccgttcttcaaaaccggggggggttaattcaatttgggggggggggtttttccagcccccctttttgccaaaatttgggaaccaaacaattttggggccgggggttttttgaaccctccccgggggataaaaattttccgggggggggaaaattttttttttttttccggggggggggggggtacccccccttttttggggggggggggagagggggtttttttaaaaaaaaaaaagcccctttctttggaggggggataattattttttccgccgcccaaaaaaaagaagggaccccccccccgggatttttcttccccccaagaaaaaaaataaaaaaag

SEQ ID NO: 80452 - DNA, 884 bp, Zea mays
  misc_feature: Ceres CLONE 1565756
  misc_feature: Translation starting site: 122
  misc_feature (626)..(626): n is a, c, t, g, unknown, or other
  misc_feature (627)..(627): n is a, c, t, g, unknown, or other
  misc_feature (828)..(828): n is a, c, t, g, unknown, or other
  misc_feature (840)..(840): n is a, c, t, g, unknown, or other
tccccgcggtggcggccgctctagaatagtggatcccccgggctgcaggaattcgtctcacccctagaaaaactcgctcgccaggagaagcagccgccgttgctgctgccgcgtccacagaatggggggtttcgtgaagactcataagaccaatgcgtatttcaaacgtttccaagtgaaattcaagagaacgcgggctggcaagacagactacaggggccaggataaggctgattaaccaagacaaaaactagtaccacacacccaaatacagactttgttgtgcgatttacggacaaggacatcactgcacaaatcgtatctgctattaaagcgggggaattggttcttgcttctggctactcccaagaaattgcacgaaaagggctttgaatttgggcttaaccaatgtatgcaatttgcctcacggcctgggaattttttgttggcccccccccggggggaaaaaaaccccgggggttttggtaaaaggggatttttaggggaaaatttttgaggcccccctggggggggagactttttttttttttaaccccccctttattaaaaaaggggggccccttcccccggggtttcctctggggggggagtgggggggttttttnnggggggggcacaaaagcggagaaaccccgtgtttttttttgtgcgccccccccaccgggggggatttttttttgtgggggggcgcccccctttattttcttccctccccccccccaaaaaagaaattgtttttttttttttttttttaaagagagggggacacccccccccgcggggggggggtgtggtttataaacactnccccccccccgnggggttggtttttttttttggtggggcggcgctttttttttttt

SEQ ID NO: 80453 - DNA, 893 bp, Zea mays
  misc_feature: Ceres CLONE 1565757
agctccccgcggtggcggccgctctagaactagtggatcccccgggctgcaggaattcgtctcacccctagaaaaactcccgctcccgctcaagggcagcaaagaaagcagctgagcgctgactgtggatctcatccgtatcgcgtatatacgtcgtcctgtttggatccaccgcgttttgctaattcccttcgaaccggccggaggcctacgttctcccaccaggcctgtctgtctgctgtatccgccagagcttccatggattccaccctcttcatcatcggcgtcataggcaacatcatctcagttctcgtcttcatatagcctatcaagacgtactggaggatcgtgcgtggcgggactacggaagagttcgagccggcgccgtacgtgtagacgctgctacacgcgctgctgtggctctactacgagctcaccaagcccgacggcctccatcgtcgacatcgtcaatgggctttggggctgtcctgggatgccatcgacgtcgacctcttcaatcgttaacgctgacaaccatgcccaaaggggtttaatacccaaaagctgggcaccagctttgggactacgtggggaatacggaatcctggtttgaggggcccccaaatccccaatttttgaaatttgaaattgaaaaattaggggcaaggaaaaaaaaggggcccccccccaaaggggccaagaaagggggccccccctgggtttttttaaaaaaggggttaaaaaaaaaagggggggggagaaagggcctttttttctttttttttttcccccaatttttaggggggggggtggggggaaaaccaccgggggggttgaacccaaaatattttttgtgggtttctccccggagaagggggtcttttttttccccc

SEQ ID NO: 80454 - DNA, 889 bp, Zea mays
  misc_feature: Ceres CLONE 1565759
  misc_feature: Encodes the peptide sequence at SEQ ID NO. 80455
ctccccgcggtggcggccgctctagaactagtggatcccccgggctgcaggaattcgtctcacccctagaaaaagagcaacgtcacctatcctttctgcctccctcactttcccatgtcagcaacagcaacccaacccacatccaccggaagatgagagctccagcttcagctgctcctattcccgcgctgctctcccgctgctcctcgcctccctcctcggccccgcgccgcctcctctcctcctcccgcacgccagccgcctgctgcccgcctccggcagtcgtccgctctgtctccgtcgatttgctggcggtcgccggggagccggctgtcgcgggcgccccctccgcaacgccgtgccgtcgcctcatcctcctccgtcacggggacagcgccaccgggggccgcttcaccagagatcatgacagacctctaagcaaggctgggagagctgacgcaatcagcgtctctaataaactccaacagatgggatgggtacccgagcttatttctctgcagtgatgccatgcgcacaaaggacactctttaaagatctggcagagcatgtccatggattgtctgaaacagtagtgcactttatcccaagttttctactcaaattgcggcaatggatgggcaaactgcagaacatttgcaaaaggtgaatttgggaaatatccagggagaaaaatcttactgggaaggggcaggggcccaaaaaaaggagggggaaaaacccccccctatagttttcgggggatttaatttttttcttaaaaaatgaaacccttcttttctaaaaaacgggggggaaaatggggggtggggcgcttttttttggcggggcccgggaggaaggaaaaccccccgggatttttaaacaccca

SEQ ID NO: 80455 - protein, 123 aa, Zea mays
  misc_feature: Ceres CLONE 1565759
MRAPASAAPIPALLSRCSSPPSSAPRRLLSSSRTPAACCPPPAVVRSVSVDLLAVAGEPAVAGAPSATPCRRLILLRHGDSATGGRFTRDHDRPLSKAGRADAISVSNKLQQMGWVPELISLQ

SEQ ID NO: 80456 - DNA, 789 bp, Zea mays
  misc_feature: Ceres CLONE 1565765
  misc_feature: Encodes the peptide sequence at SEQ ID NO. 80457
ctccccgcggtggcggccgctctagaactagtggatcccccgggctgcaggaattcgtctcacccctagaaaaacactgcattccctctgagcgccgccactccctgacatcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggacatacagatgatgctcgcggccgacgtccacctcggcaccaagaactgcgatttccagatggagcggtatgtctttaacgtcgcaccgacgcatctacatcatcaactgggcaagacatgggataagctcagctcgcgcgagggtattgttgccatgagaaccccaagaatcatcgtcagtcggcccgccctacggccagcgtgctgtcctcaagtcgcgcagtacactggcgcccatgccatcgctgggagggacacccctgttaccttcaccaatcagctccagacctctttagcggagccctgcctggtccatccttacggaccccaggactgacgatcgcccaattaagggattctgcttcgggggaaacatcccaaacattttgcttttggggaaaatgaaatctcccagggggggaagttcaaaaatcggggttccccgaccaaaaacaaaggggggaggaacaacactttgggaaggcccggttccggggttttttggccccaaaaaaggtcttcccccaaaaaaa

SEQ ID NO: 80457 - protein, 130 aa, Zea mays
  misc_feature: Ceres CLONE 1565765
MAASAGGGAVRALSQKEQDIQMMLAADVHLGTKNCDFQMERYVFNVAPTHLHHQLGKTWDKLSSREGIVAMRTPRIIVSRPALRPACCPQVAQYTGAHAIAGRDTPVTFTNQLQTSLAEPCLVHPYGPQD

SEQ ID NO: 80458 - DNA, 873 bp, Zea mays
  misc_feature: Ceres CLONE 1565767
  misc_feature: Encodes the peptide sequence at SEQ ID NO. 80459
ggagctccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaaagcctgtcgctcctgccgccgcgtcgcccaagccccgcgggcgcccctcccaaggtcgccaagaactcccgccaggccctccccccgccaaggcagcccaagaaaggcggcttgctcctggcaaagaaaggggaaaggcagccggccggcttcttaagaaaggttggcaaccccccaaagaaaagcttgcctga

SEQ ID NO: 80459 - protein, 222 aa, Zea mays
  misc_feature: Ceres CLONE 1565767
  misc_feature (54)..(124): Pfam Name: Linker_histone Pfam Description: linker histone H1 and H5 family
MSTEEAVVAEVPVTEVPAEVPAAQVAEAPKAKKAPKEKKAPKEKKLSAAKKPAAHPPYAEMIVEAIAALKERKGSSSVAISKYVEGKHGGKLPTNFRKQLTVQLKKLAAAGKLTRVKNSFKLPATDAKPKAAKPKAPKAAPKPKPSPKAKAKTAAKPKAASPKPKAKAKAKACRSCRRVAQAPRAPLPRSPRTPARPSPRQGSPRKAACSWQRKGKGSRPAS

SEQ ID NO: 80460 - DNA, 931 bp, Zea mays
  misc_feature: Ceres CLONE 1565770
tccccgcggtggcggccgctctagaactagtggatcccccgggctgcaggaattcgtctcacccctagaaaaaaacccaaacaccacaatccccttcaacaaacgcaccgcactccacggcagccagaaaacacaatccacagagtctccgtgaggtctgagcgaggtaggactagctctgagcgagttcttccgtcttccaggtataatcctagcaactctcactatcctcttcgcatcgctcgtctctttttgagaccagttggatttctcttatttttccttggatcctactacctaatagaacagagctccggagccttttagtttctggtctctgatctactcattttcttttcttccccttttggtgacataggtaggtctagttaagatctgtcgtgcctgttctttgattttagctaagaacaggcgatttagtcttctttctccttacaaaaaaatccccagaaaaaaaaagtggtgagtagtataatccttgtaccatttggagggcggctgctataaatctcccccgggccccgcgagggatcttaatgcaaacaatggaatccttcatgcaagaggaagccccatccccctctgggcatgccgccggggccctttttttccagggggcccaagcccaggggggcccattacccggggaaacccccttaagcccgggcccaaaatgaatttttttaaggggccacttccccccttgaagggaaaaccgcgggttggggcccccggggggccccccccataaaaacccccccttcccaaatgcccccggggccggggggccccaagggggtgtgtgaaaaattttcaccggggggggggggggccctttctttggggaaaagtggggggggcaaaaaatatgttttctcccccaaaaacaccccgccccgttgtggggggg

SEQ ID NO: 80461 - DNA, 1333 bp, Zea mays
  misc_feature: Ceres CLONE 1565771
  misc_feature: Encodes the peptide sequence at SEQ ID NO. 80462
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (699)..(699): n is a, c, t, g, unknown, or other
  misc_feature (722)..(722): n is a, c, t, g, unknown, or other
  misc_feature (1152)..(1152): n is a, c, t, g, unknown, or other
  misc_feature (1217)..(1217): n is a, c, t, g, unknown, or other
tcttattcgctgcccgactaaacagcgaaatagacaaaatttaatactactnnnnnnnnnnnttataannnnnaataaaagaagctccccgcggtggcggccgctctagaacagtggatcccccgggctgcaggaattcgtctcacccctagaaaaagcatcccatctgctatccttggttgccgcttcctccaaagccactccaaacccccgcttccagaaccttctcgaaactctccgcctcctcctctactcgctccgatggcgaaggaaccgatgcgcgtgctcgtcactggcgccgcagggcaaattggatatgctcttgttcccatgattgctaggggagttatgcttggtgcagaccagcctgttattctgcacatgcttgatattccgccagcagctgaagcccttaatggtgttaagatggagctcgctgatgcggggtgtggggctgctgaagggagtccttgctacaactcacccccccccaaccatacaactgtcgtgaaatgtggccgccacgggtgggtggactccccccctgaaggaggggaacgggaaaggaagaaatggccatggtcctaaaaaaaggtttctggttccataaaaaccccaagccaatcgtgtttgtgtgagaggcccagaaaccgtgccacccccaaagtagcatagggggtctcaggggtgtggttggcnccaaacacaccgtggcgaaaganccgccaagaggggtagagctaggctctttgaatcaaggaaagatctcatgacgcttccgcaaatgagaaatactgtcccccggaggcatataggacgggcgcacgcccgtctcattattatgccgcctctcgactagtcacctctcctcagcatctgtaggggaaccctcgcgatgtatcgtcaccccgggagagagagttctccgatgggagcgcgcgctgtcacgccgatgatgagttgtgcacgcatacgagcgatatcccgcccctccacggtgtgccgcgccgcgagcttagcgcacggccggagacatgcacagcttcatacataaaaaacatgaggtcatatatagcgatcgaacgatagcgacgcgcgtccagttaaaacggcgcgatcacgacgacatagtcgacgctcgtcgtgctcgtnacgcgagactcaccagtttaaactacgcgcccacgcgcgacgccgctcatcacttattcaatggntcatccacggaacagacgcccgccgcagtaaaatgctgtctttcctccgcgcaatgcgcacgcgtgattcgaattgtagccgacactacacctcgagttcccatccgatattatcc

SEQ ID NO: 80462 - protein, 108 aa, Zea mays
  misc_feature: Ceres CLONE 1565771
  misc_feature: SWISSPROT Homolog: EC 1.1.1.37 Malate dehydrogenase
MAKEPMRVLVTGAAGQIGYALVPMIARGVMLGADQPVILHMLDIPPAAEALNGVKMELADAGCGAAEGSPCYNSPPPNHTTVVKCGRHGWVDSPPEGGERERKKWPWS

SEQ ID NO: 80463 - DNA, 1320 bp, Zea mays
  misc_feature: Ceres CLONE 1565775
  misc_feature: Encodes the peptide sequence at SEQ ID NO. 80464
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (773)..(773): n is a, c, t, g, unknown, or other
gcaaaaagggagattatatccccccccccatccccctttccttcatcccccccataaaatannnnnggtnnnnnnnnaaaaactggagctcaccgcggtggcggccgctctagaatagtggatcccccgggctgcaggaattcgtctcacccctagaaaaacgctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacaaaagcgcgggggaagtccccccccggttcaagatcttctcccaaaaccctccagctgggtccgcttccccccaccgcaaaaaggcctcttcctaccgccccggggaaacgaaccgtcttcccgggaccttgagccctggggcagggaatttcccgtgcgggatcccgggcttttggggggccacccccacaaaaacttggtctccccggcccacgctcttgttacaccgggggaaaatcccacctccgacgattgatggtgtgggtacagccctctaagcctaatgtgagttgacacctgaccgtccgcggggganagacgcactaatataaacagacccttgcgtctatataactcggagaagcgcgcagaatatcgatcctatatattatattgtttatggtacacggcctcccccccccccctcgctggggataaaaacacaaagacacaccccggatgaggatttttcccccgcctagtcattgagtgagtgatcacttacatgttcgcggtacgtgttggcgaaaccctctctgtatatattacacaagcaactgaatctgttggagtgtgagtacgacacgcgctaatattaaagatgaggtgcgcagaaagacataagtatcgcgcctacagcgagatgtatgatgactcgatcgccgacagagagtgtcgacctctaccgctgcgatttatttctctcttagtacgattcgacactacgcataggctcggctcgctatacacgtctaagtgtttagtcctccatgagacagccccgcccccccattactaatctcatactatgctaccactcgcggacgcttactcagcgtatcgtcatagcgcgccggtaggtg

SEQ ID NO: 80464 - protein, 162 aa, Zea mays
  misc_feature: Ceres CLONE 1565775
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFAVRYGKSYKSAGEVPPRFKIFSQNPPAGSASPHRKKASSYRPGETNRLPGTLSPGAGNFPCGIPGFWGATPTKTWSPRPTLLLHRGKIPPPTIDGVGTAL

SEQ ID NO: 80465 - DNA, 830 bp, Zea mays
  misc_feature: Ceres CLONE 1565776
  misc_feature: Encodes the peptide sequence at SEQ ID NO. 80466
  misc_feature (268)..(268): n is a, c, t, g, unknown, or other
  misc_feature (303)..(303): n is a, c, t, g, unknown, or other
  misc_feature (307)..(307): n is a, c, t, g, unknown, or other
  misc_feature (308)..(308): n is a, c, t, g, unknown, or other
  misc_feature (316)..(316): n is a, c, t, g, unknown, or other
  misc_feature (344)..(344): n is a, c, t, g, unknown, or other
tccccgcggtggcggccgctctagaatagtggatcccccgggctgcaggaattcgtctcacccctagaaaaaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccccgctgcgttctgcgccacgccaccacctcnggccgcgtcaccatgtccgcgggagtggatgcccngggnnagccccgnccccggcccaccttgacgggttcttcgnccaaggtgaatccgggctttcaaccccccttggggcctgggcccaccgggtggccggaaaaaatttttcaaaccgggttttaaagggaattccggaaagggggtaccccctttgcccgggggggggcccaatttttggcccctttcccgggggggtttctttgttccccaaaaaaggcccttggggggggttggggggaaaatctgggtgtaaaaaagcccccccaaggaagtgggggggggggccccctcccccccggggggggggggggggcgcacacatatatttgtggggggcccccccccgggggtgcccgcggggggggaaaaattttttttcaaaaaaaaatttcctctttgggggggggagaaaaaatttttgtgggggaaaatttttttctttttttccgggagaaaaaccacacccccggcccttttggtggtgaggaaaaagacgcccccccccccccaaaaaaaaaaaaaaaat

SEQ ID NO: 80466 - protein, 64 aa, Zea mays
  misc_feature: Ceres CLONE 1565776
  misc_feature (44)..(44): Xaa is any aa, unknown, or other
  misc_feature (56)..(56): Xaa is any aa, unknown, or other
  misc_feature (57)..(57): Xaa is any aa, unknown, or other
  misc_feature (60)..(60): Xaa is any aa, unknown, or other
MAMASSSSGLRSCSALGVPSLLAPSTSSSSRSGPAAFCATPPPXAASPCPREWMPXXSPXPGPP

SEQ ID NO: 80467 - DNA, 849 bp, Zea mays
  misc_feature: Ceres CLONE 1565777
  misc_feature: Encodes the peptide sequence at SEQ ID NO. 80468
  misc_feature (476)..(476): n is a, c, t, g, unknown, or other
ggagctccccgcggtggcggccgctctagaactagtggatcccccgggctgcaggaattcgtctcacccctagaaaaaacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaanctttcgggctaccgcaccgccgtgagcccgctgctgcggggcgtcaaggtcggcctcgcgcacgggtacttcctcggggggcctttcgcgctcagggccggttccaaacacgcccgtacggccaaggccggggcgtttggggccccccggctttttccccttcctaaggtttgccctacctgggaagggggcccccccttaaaagggggggacctttccgggggccccttttttcgcttccccgggggaaaaaagggggccaaaaaatttaaaaccctccagggttggggcaaattccccggggggattttttttctgggggggattccgggggggtttgggggcgattttttccccatggggggccaccccc

SEQ ID NO: 80468 - protein, 199 aa, Zea mays
  misc_feature: Ceres CLONE 1565777
  misc_feature (44)..(195): Pfam Name: PsaL Pfam Description: Photosystem I reaction centre subunit XI
  misc_feature (75)..(75): Xaa is any aa, unknown, or other
MASQVMKSSLVVHSRPRGLSGAAALTRRPGRFTVKAIQPEKATYQVVQPINGDPFIGSLETPVTSSPLVAWYLSXLSGYRTAVSPLLRGVKVGLAHGYFLGGPFALRAGSKHARTAKAGAFGAPRLFPLPKVCPTWEGGPPLKGGDLSGGPFFRFPGGKKGAKKFKTLQGWGKFPGGIFFLGGIPGGFGGDFFPMGGHP

SEQ ID NO: 80469 - DNA, 863 bp, Zea mays
  misc_feature: Ceres CLONE 1565780
  misc_feature: Encodes the peptide sequence at SEQ ID NO. 80470
  misc_feature (451)..(451): n is a, c, t, g, unknown, or other
  misc_feature (480)..(480): n is a, c, t, g, unknown, or other
  misc_feature (604)..(604): n is a, c, t, g, unknown, or other
ctccccgcggtggcggccgctctagaactagtggatcccccgggctgcaggaattcgtctcacccctagaaaaagcgcaaaacacctcgccttttgtactcttgcgtctctgccctcgcgttatcgccttcgtcacgctcgctcgcctggctggcttgtgccttgccttgctcggcgtacgcgaacgcagcgagagggaggagcaaggaaatagagagagacagagagagagagagaaaaaatcaagtcatccccctttcctctgagctcgttccatggagaactcttctcacaagcgggcgcgggaggcgggcgacctcgtcgccggcggctgcggagaggagggctcgccgcaggccgacgccaagaggctgcggccgcaggacctgctcgacatgctggaggacgacaccgacgcggccgcggccggcgacctagcgtcggtcatgcngagccctggagaggagatagccagcttcnacgaagccgcggaggcgccggcgccggcgccggagctgggcttccctgctcgaggccctcgaaccacaagctgggggctgccgccggccttcctctttggaggaggaggaaggccgggcccccngggggccccctttcccccccgcgctcaaaggccaaaatttgggggtttccaggaaaaaaaatcttggacggagggggggttttggggggttactccccggaaggcccgggccccggcccttttccttccccccccccccccccggggaaaaaaaaaggtttttgggcccgggccttttttccttttgggggggaaaaaaaccgggggccgccccaagaaatttggggccctctccccacaaaaaaattccccccctttt

SEQ ID NO: 80470 - protein, 196 aa, Zea mays
  misc_feature: Ceres CLONE 1565780
  misc_feature (59)..(59): Xaa is any aa, unknown, or other
  misc_feature (69)..(69): Xaa is any aa, unknown, or other
  misc_feature (110)..(110): Xaa is any aa, unknown, or other
MENSSHKRAREAGDLVAGGCGEEGSPQADAKRLRPQDLLDMLEDDTDAAAAGDLASVMXSPGEEIASFXEAAEAPAPAPELGFPARGPRTTSWGLPPAFLFGGGGRPGPXGAPFPPRAQRPKFGGFQEKKSWTEGGFWGVTPRKARAPALFLPPPPPRGKKKVFGPGPFFLLGGKKTGGRPKKFGALSPQKNSPPF

SEQ ID NO: 80471 - DNA, 1205 bp, Zea mays
  misc_feature: Ceres CLONE 1565781
  misc_feature: Encodes the peptide sequence at SEQ ID NO. 80472
  misc_feature (492)..(492): n is a, c, t, g, unknown, or other
  misc_feature (1205)..(1205): n is a, c, t, g, unknown, or other
atatgttttttgtgtcctccccttcgcaatacactttaaatcaattaaaaggaaactaaaaacacaactcaccaacaaaccaggagtccaccgcggtggcggccgctctagactagtggatcccccgggctgcaggaattcgtctcacccctagaaaagcgcaaaacacctcgccttttgtactcttgcgtctctgccctcgcgttatcgccttcgtcacgctcgctcgcctggctggcttgtgccttgccttgctcggcgtacgctaacgcagcgagagggaggagcaaggaaatatatagagacagagagagagagagaaaaaatcaagtcatccccctttcctctgagctcgttccatggagaactcttctcacaagcgggcgcgggaggcgggcgacctcttcgccggcggctgcggaaaggaaggctcgccgcagggcgactccaagaggcttcggcctcaagacttgcccccacctcttaaagaanacaccgacatggaccccggacggcgaacctaatctttccgtacatgctgaagcccctgggaggaaggaaataagcccatccttcgactgaaggcccccggaagaggggccgggcatcccgggggccgggaaagcatgggggccttcccttggcttcaagaggccttccgggacccaccataaagattggggggggatggaccgagtccacggatccttaatctctttttttggaaaaggaaaaggaaaggataaggctctctgggggcctcccctcctgtgtaggggtggcgcgccccgatttatttcacagatcgccacaggtctgttttttttgtgaaaccagagttctcagaaaaatctcttcgagggggggcctttatttccctgggggagacacataaatcatattccttctgaggaaatacaggggaaggggcacgggctttattaggatgggagggtctatatactttcatcccaggagaataggagtacgagtcggtctctcccccggagccgctcgcctttcccccttccgataacgagtatctatctacgatcctatgtatgtgggagagagataaataataacgggtcgattttgtggatggcagtgggtgtcttttcttatcatctgatactatgggaggtgagataatcacatcgcgcggaggagtggggccacagactggcggataaataatatggagn

SEQ ID NO: 80472 - protein, 54 aa, Zea mays
  misc_feature: Ceres CLONE 1565781
  misc_feature (45)..(45): Xaa is any aa, unknown, or other
MENSSHKRAREAGDLFAGGCGKEGSPQGDSKRLRPQDLPPPLKEXTDMDPGRRT

SEQ ID NO: 80473 - DNA, 789 bp, Zea mays
  misc_feature: Ceres CLONE 1565784
  misc_feature: Encodes the peptide sequence at SEQ ID NO. 80474
  misc_feature (439)..(439): n is a, c, t, g, unknown, or other
  misc_feature (440)..(440): n is a, c, t, g, unknown, or other
ctggagctcaccgcggtggcggccgctctagaactagtggatcccccgggctgcaggaattcgtctcacccctagaaaaaatctcccacctcgatccctgcgctgcaagcaacaaagttctactctgtccacccgtccatctagctcccaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagcccccgacacgcccttcanncccgtcgaggtgagcgacctgctgagcagcctccgccgccaagtggccgaccctggggtggcccgtccaacaacggggctgcgccttctgggggccaccaaatggggaaaaaaaagggcaacctgggccaacccaaattttttttaaaaaagaaaagggggtaattttcaagggccggggttgggccctccccgaaacaagatggggggaaactcctcgggggcccctttaacctctcccccgggggtttaaagccccccaaagggggggggtataaaaaaacccccttggggaccccccaaaatttagagggggggcgccccacatccccccaccaggaggaggccca

SEQ ID NO: 80474 - protein, 139 aa, Zea mays
  misc_feature: Ceres CLONE 1565784
  misc_feature (28)..(140): Pfam Name: Ribonuclease_T2 Pfam Description: Ribonuclease T2 family
  misc_feature: SWISSPROT Homolog: EC 3.1.27.1 Ribonuclease T(2)
  misc_feature (85)..(85): Xaa is any aa, unknown, or other
  misc_feature (86)..(86): Xaa is any aa, unknown, or other
MAAARRLSLPLVLLVVLAVAGRAAAQDYDFFYLVLQWPGAYCDTKQSCCYPKSGKPAADFGIHGLWPNRDDGTYPQNCSPRHALXXRRGERPAEQPPPPSGRPWGGPSNNGAAPSGGHQMGKKKGNLGQPKFFLKKKRG

SEQ ID NO: 80475 - DNA, 857 bp, Zea mays
  misc_feature: Ceres CLONE 1565785
  misc_feature: Encodes the peptide sequence at SEQ ID NO. 80476
  misc_feature (83)..(83): n is a, c, t, g, unknown, or other
  misc_feature (85)..(85): n is a, c, t, g, unknown, or other
  misc_feature (86)..(86): n is a, c, t, g, unknown, or other
  misc_feature (658)..(658): n is a, c, t, g, unknown, or other
ctggagctccccgcggtggcggccgctctagaactagtggatcccccgggctgcaggaattcgtctcacccctagaaaaaccnannaaaaaaaaaaaaaaaaaaaaaaaaaaaaaaaaaaaaaaaaaaaaaaaaaaaaccttctcacgcccgcctgcccaaagcctctgcatcatccaacaacagcgacaccacgggactcgcgccatcttcagccagcgcaaacacatggcgaggatactcgtcaaagcgcccgcaggctcgggctcgccggaggactccatcaactcggacatgatcctcatcctcgccggcctgctctgcgcgctggtctgcgtcctcggcctgggcctcgtcgcccggtgcgcgtgctcgtggcgctgggccaccaagtccggccgggcgcagccggacgccgccaaagccgcaaacaggggcgtcaagaaggaggttctgcgctcgctcccaaccgtcacgtacgtctccaacagcggcaaggcggcggcggccgcggagggaggggccaacaagtgcgccatctgcctcgccgagttcgagggaggccaggccgtgcgcgtgctgccccagtgcggccacgcgtttcacgccgcctgcgtcaacacgtggttgcgcgcgcactcctcctgcccgtcttgccnccgggtgctgggcgttcaacctgccccccgccgagcggtgccgccgtctgtggcccgcgccccgggtgcgggcatcagcgccgctctggaaagccgcccacgcccttgcaacgcaaagggggcaaactttcttgggcgaaatgccgtgcgccctcccatatacggaaatggaaccgaccccccagtctcaagtgatgaa

SEQ ID NO: 80476 - protein, 210 aa, Zea mays
  misc_feature: Ceres CLONE 1565785
  misc_feature (102)..(143): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature (144)..(144): Xaa is any aa, unknown, or other
MARILVKAPAGSGSPEDSINSDMILILAGLLCALVCVLGLGLVARCACSWRWATKSGRAQPDAAKAANRGVKKEVLRSLPTVTYVSNSGKAAAAAEGGANKCAICLAEFEGGQAVRVLPQCGHAFHAACVNTWLRAHSSCPSCXRVLGVQPAPRRAVPPSVARAPGAGISAALESRPRPCNAKGANFLGRNAVRPPIYGNGTDPPVSSDE

SEQ ID NO: 80477 - DNA, 812 bp, Zea mays
  misc_feature: Ceres CLONE 1565787
  misc_feature: Translation starting site: 209
  misc_feature: Pfam Name: ATS3 Pfam Description: Embryo-specific protein 3, (ATS3)
ggagctccccgcggtggcggccgctctagaactagtggatcccccgggctgcaggaattcgtctcacccctagaaaaagccaagtccggagcaacagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgtcctctccgtcgtctcattcccgcacctgtccctccccgcctcgtcccatccgctcccgcaggaagctgctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgacggtgacgccgcggcgcgggttcgagcgctgcgccacggacacgttccgcgtcgccgggccctgcggctacggcgtctgctacctctacatgcgccggtcgggccgcgccgccgggtggacgcccgagtgggtcagggtgtacgagccggcgttcggcggcgccctccaccttctactacggcgaaccgctcccccgacgcgtctgggacggcttcgaccgctgcgtcaagggcggggcccggcgcctctgcccaagcatggggccccgggcgcgaaccctt

SEQ ID NO: 80478 - DNA, 1270 bp, Zea mays
  misc_feature: Ceres CLONE 1565790
  misc_feature: Encodes the peptide sequence at SEQ ID NO. 80479
  misc_feature (738)..(738): n is a, c, t, g, unknown, or other
  misc_feature (1270)..(1270): n is a, c, t, g, unknown, or other
cagttttactcagaaaaaataagtgaaaaggacgagagcagcagcgatgtgtcatcctgcccacctgttatatcccagctggagctcccgtgggtggcggcctctctagactagtggatcccccgggctgcaggaattcgtctcacccctagaaaaaaaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaaccaaaagagggtatagacctccagtgcctgatgctgccagaatgcaattctcttgagtgtatgaacatcagcttctgttccttgcctgggttaagcacatgccaaccgctgcaaaatctgccatgtgttccgttgcactacgttattttaaaaaaattggagccccacactcccaaccttacattcgtttgggtttgaaccaagttaagaaatttccatttggtgcttgggcgggaattttctggaggcggtaaatggagagcccaaagttgtcaaacctggtttgaccttaaaggaactcccccttttataggggggaaatagatcgtggggaatagtaccttcgcatcaactggaaggcgattaactaggacatgactgcactggtctcatataaggtgtgtccgcccgcaaacccggtcttcggnaatatatctccccatagatggcgcagcatcgtgcctggtcgttcttcgttcacgatgggtaatgcccggcgcgctcggaacgataaggtagggggttgttgttatcatgtctacgaaaagagagcctcctcacagatctacgttagtgaaggttttattctcagtctacgaaaagactccgagagtagtgcggcgtgtctagggcagaaacaaagtgggaggaagagtttgcgggcccgcttgcctattatatggaggtgtggggtaaacacgcctataggttcccacatcgctctctgtttgtggggggagtatatatacatgtcccaattgggaatatccagaccccacacaatggattgaaatatggagggacttatcccatcattttgtagaaaagataatttgttgaaaatgcggccagcgtataaaaaaaggtcagcagagtgtattgccgctattattttgtgtgtgagcggggctcctcccaagacgttgacacttatgtcttgccacgtacgcacatgaaccn

SEQ ID NO: 80479 - protein, 68 aa, Zea mays
  misc_feature: Ceres CLONE 1565790
MAKPKEGIDLQCLMLPECNSLECMNISFCSLPGLSTCQPLQNLPCVPLHYVILKKLEPHTPNLTFVWV

SEQ ID NO: 80480 - DNA, 771 bp, Zea mays
  misc_feature: Ceres CLONE 1565791
  misc_feature: Translation starting site: 163
  misc_feature (367)..(367): n is a, c, t, g, unknown, or other
ggagctccccgcggtggcggccgctctagaactagtggatcccccgggctgcaggaattcgtctcacccctagaaaaaccaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaaccggcgagttnccccggcgactatggggtgggacaccgcggggcctctcggccgacccgggagaccttcgcgcgcaaccggggagctaggaggtgatcccccctccccggtgggcgaatgctgggggccctggcctgcctgtcccggaaatctggcttaaaccggcttcaattcgcaaggcggggtggtccagggcgcgcccaaattttccggaggggggctgagatactggggacccccaacctgtggccccccaaaaaataccgggccttttggggggtgcccagggggggtccaggggtttctcccaaggggtaaacccgtttttgggggggggccccccctgggggaaagggtctcccacaaggggttttccccccgggggggggccttttttaaaccccggggggggccc

SEQ ID NO: 80481 - DNA, 1007 bp, Zea mays
  misc_feature: Ceres CLONE 1565794
  misc_feature: Translation starting site: 368
  misc_feature (410)..(410): n is a, c, t, g, unknown, or other
ctcaccgcggtggcggccgctctagaactagtggatcccccgggctgcaggaattcgtctcacccctagaaaaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgaggggcaagtacgacggcgacctgccgcccgcgcacgcgtcgctgctggccgcgcacctggcgcgcatgaaggagtcgggtgagctggtctttctccacaacaactacntctgcgccgacgcgcccgacccgccgtcgaaacgcgggcgcgggccggcccccccaaggcgccgggacccccgccccgccgggggtcctcccccatccggggccccggggccccgggcccccccccccaagcccccaaggaacccccttgggaccccccccctgtaaaacaagggcccccccccgggggcttgccccaagggggccccgggggccccccccctctccaaaaaaagggccaaaaaaacccgaggggggggggggggtgtctccccggggccccccgcgcgggggaaaagaggtttccccccccccgctaaaaaagggggggggcggcggggccccccccccacacaggggaaaaccccccctctttgggccccaaaaaaaaagaacgccccccgtttttaaggaaaaccctcccccatgggggggtatattggataaagaatttttctcccccccccccccccaccacggggggatatttttttgagcccccttctttctcccccccaaaaaagggggcgcaagaacaccccccccccgccctttttttattgggacaaaggagggggtttttattgtttttttcttc

SEQ ID NO: 80482 - DNA, 841 bp, Zea mays
  misc_feature: Ceres CLONE 1565795
  misc_feature: Encodes the peptide sequence at SEQ ID NO. 80483
gagctcaccgcggtggcggccgctctagaactagtggatcccccgggctgcaggaattcgtctcacccctagaaaaaaaggacagagaaagagagacgaacgcgcacgagctagctagctagctcgctcgatcgacagagtcatggcgcccagcttcgcccgctccatctccttcccactcagcccgtccaggtcatcaacgtcgtcgtcgggcaccaagccccgcgcggcggcggcctccaccgccgcggcgtaccacgcgcgctccgtcagcctgccgtgccgctcgcacccgatcctcgcgcacctccacgcgcacatcggcgccgtgcgcgcctgggcgcaggacccgccggccacctccgccctcggcgccgccgcgggcctagcgcgcgtggacgcgctccacggcgcgctcgccgacctgctcgacctccccgaggcgcgggccgcgctctcgctctccggcaccggcgaccgcctcctggacgccttcctccgcctggccgacgcgcacggcagcttccaggaggccgtggtggagctgaagcgggacgtggccgaggcgctggccgccgcgcgccgccgcgacggcgcgcgcctcgcgtccgcgctcaggtcgcagcggaaggccgccaaggacctcgcccggctcgccgcctgcgcggcatctggcggcggcaggccctcgcgcctcggcctcggcctcggcggcgcggcggaggtcgaggtggccgggctgctggccgagggcgccgctgccacggccgccgcgtcggccgcgctgttcggcgccgtcgcgccatgtccgcgtcggcctccgcgtgctcctgcaagagga

SEQ ID NO: 80483 - protein, 233 aa, Zea mays
  misc_feature: Ceres CLONE 1565795
MAPSFARSISFPLSPSRSSTSSSGTKPRAAAASTAAAYHARSVSLPCRSHPILAHLHAHIGAVRAWAQDPPATSALGAAAGLARVDALHGALADLLDLPEARAALSLSGTGDRLLDAFLRLADAHGSFQEAVVELKRDVAEALAAARRRDGARLASALRSQRKAAKDLARLAACAASGGGRPSRLGLGLGGAAEVEVAGLLAEGAAATAAASAALFGAVAPCPRRPPRAPARG

SEQ ID NO: 80484 - DNA, 856 bp, Zea mays
  misc_feature: Ceres CLONE 1565797
  misc_feature: Encodes the peptide sequence at SEQ ID NO. 80485
  misc_feature (460)..(460): n is a, c, t, g, unknown, or other
  misc_feature (478)..(478): n is a, c, t, g, unknown, or other
  misc_feature (489)..(489): n is a, c, t, g, unknown, or other
  misc_feature (552)..(552): n is a, c, t, g, unknown, or other
ggagctccccgcggtggcggccgctctagaactagtggatcccccgggctgcaggaattcgtctcacccctagaaaaagtgcccagcctccgtccctctccttcccttacctcgcctcgtctcctctccttgagatctccagggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttatttggtgatgttcaagtcgggtcaggagcttccattttggtatgggtgcgtctttagaggggatgcnaacatcatacaaattggnatctgggaccnatatacaagacaattctcttatacatgtggctaaatctaatctaagtggggagggtctttctnacaccatttggtatacgtcacagtaggtcatagtgctgtgttacaaggatgcaccgttgaggattaaggttttggttggcatgggggcaccctataaaaggggggtgtttttttaaaaaaaccccaaaggggggctgctggaaaccccctacggcaaaaactaaggatcccttttggaaaagaatttggggggaggggaccccctcccaaattttttaggaaaccctcccaaatgaaaagaaattcatttttttttggggaaaaaaactggcgccccatttttccaattgtttgtccagggggg

SEQ ID NO: 80485 - protein, 69 aa, Zea mays
  misc_feature: Ceres CLONE 1565797
MAGLGKAMYAVGFWIRETGQALDRLGCRLQGKYFFHEQISRHRTIMNIFDKTPHVHKDAFVAPSASLIW

SEQ ID NO: 80486 - DNA, 752 bp, Zea mays
  misc_feature: Ceres CLONE 1565798
  misc_feature: Translation starting site: 287
tggagctccccgcggtggcggccgctctagaactagtggatcccccgggctgcaggaattcgtctcacccctagaaaaagtcgccccagtctagtccgattcaaacccgcccgttccccgtgtccgagccacgcaagccgagctcaatccccagaggccagagccagctgctcggtgagcgccgcgcccttcgcccccctcaggccctcacgcttcgttgcttgatcgtctgatttctctgacgggtggtttggtttggatctgggcggaccaggcgctccacgcgatggcgcagaaggagaccaatggcagcaacggcgagcacatctccacccgcccgccgccgaccccgtcgcccctccgctttctcaagttcttcccaggctaacctgcggatcctggtcactggtgggggcgggctcatcggctcgcaactcgtggacagctcttggagaacgagagcacgaggtcatggtgctgataacttttcaccggtcaaagataacctgaggaatggatcgacacccagatttaagctcatcgccatgatgtcctgagccccttccttgggaaggtggaccagaacttatacccttgttggcccgggttaccaaatttttaaaaagacaaatcctggtaaaaccctccaaaacaaaggtttttggggaccccgaaaaaatgcggggagatttcaaaaaaagattgggggcccggggaattttttttaaccccaacccttgggaagttttttg

SEQ ID NO: 80487 - DNA, 1090 bp, Zea mays
  misc_feature: Ceres CLONE 1565799
  misc_feature (61)..(61): n is a, c, t, g, unknown, or other
  misc_feature (73)..(73): n is a, c, t, g, unknown, or other
aggggggggggttgtaggcccccccacgcacccaccacacattcctctccgaatgatggtncggagcgccccntaaaaactggagctcacgtcggtggcggccgctctagaactagtggatcccccgggctgcaggaattcgtctcacccctagaaaaaaacagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgatcgttcgtgagtaggcggccggcacatatggcagcgcactccatgctcatgtcgaaccagagtcaagggcggccgcgcgctgccgtctcttcaggccgtccggccggctccatacccgccgctaccgctgccgtcgtcatcatcctcggcaggctccccccccctccagtccgtctccgcgaaagactcccgccccgtgtgggcaaatccaagggtcaaggacccgcgccgggcgaaaaaaaggctgcctgcgcccccaaaaccccaaacccgaaaaggtttgaaggaatgggttattcctttcgggcaaacgtcccccgccccgggggaaccggggttttccccccaaccgggaaaaaaacaaaagcctggtgtttcagtccccggccctcccccgtttgggcccaaaggggccttggggccctttattttcccccgcacaattccgccttagaaccttggtgggccagaaagaggcccctatattatacccgcgcgggaaaagagggggcaagcccccactggtgcccccgaggcttggaaaaaccctcccccgaaaaacaggggagaatttctcccccattgttttacaccaaaggggcgggaaaacccccccgcccccaccccctgggataacatgagaaacctccgagtacacacccaccgccttttgggggcgccccatcggggagcccttttttatgggtgaaaacccagcggagcacccttttttatggggatgaggggggggggtccccggcgcccctc

SEQ ID NO: 80488 - DNA, 849 bp, Zea mays
  misc_feature: Ceres CLONE 1565801
  misc_feature: Encodes the peptide sequence at SEQ ID NO. 80489
  misc_feature (809)..(809): n is a, c, t, g, unknown, or other
tccccgcggtggcggccgctctagaactagtggatcccccgggctgcaggaattcgtctcacccctagaaaaagctagcggtaaccgtcgcctcacttccgcagcaccggcgcggcgactattagctatagccgagtaggcgcagccgcgcacggcgcacccctcgtgttcccttttcgtccttgttcctcaacgtcgccggtgcgcccgcctcctgcctctctccccctgcgagcgatcgtgaggggatcgggatggcctcccaccattccgagcccctcgaccccgccgacactgacgacccctcagataacaacccagaattaccatgcccctcctatcatatcgttaccaaacctggtcaactcccagtcgagtttcttgaaccctcagctgcccagaagttggtaattggatttgactgtgaaggtgttgatctctgccgcaatggtgctctctgtattatgcagcttgcattccctgatgctgtttacctagttgatgctattgagggtggaaaagaacttattcaagcttgtaagcccgcacttgagtctgatcatatcaccaaagttattcatgattgtaaaagggacagtgaggctttgtattttcagtatggcataaaactgcataatgtgatggatacacagattgcttattctctgatagaagagcacgagcaggaaggacaaaagatgacatctgatgattatagttacatatcttttgtcagccttcatgctgataaacgatactgtggcatactatatgctgcacaagaagatgtccgtaccccttctagggcnaggaccctaactttttgaacagttatgcccatgatctgat

SEQ ID NO: 80489 - protein, 190 aa, Zea mays
  misc_feature: Ceres CLONE 1565801
  misc_feature (29)..(180): Pfam Name: 3_5_exonuc Pfam Description: 3'-5' exonuclease
MASHHSEPLDPADTDDPSDNNPELPCPSYHIVTKPGQLPVEFLEPSAAQKLVIGFDCEGVDLCRNGALCIMQLAFPDAVYLVDAIEGGKELIQACKPALESDHITKVIHDCKRDSEALYFQYGIKLHNVMDTQIAYSLIEEHEQEGQKMTSDDYSYISFVSLHADKRYCGILYAAQEDVRTPSRARTLTF

SEQ ID NO: 80490 - DNA, 822 bp, Zea mays
  misc_feature: Ceres CLONE 1565802
  misc_feature: Encodes the peptide sequence at SEQ ID NO. 80491
  misc_feature (766)..(766): n is a, c, t, g, unknown, or other
  misc_feature (793)..(793): n is a, c, t, g, unknown, or other
  misc_feature (794)..(794): n is a, c, t, g, unknown, or other
  misc_feature (822)..(822): n is a, c, t, g, unknown, or other
ccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaaccccaacctggtgcacgcgcagagcatcctggccatctgggcgtgcccagtggtgctcatgggcttcgtcgagggctaccgcgtcggcggcggcccgctcgggaagggctcgacaagtgtaccccggcggcgccttcgacccgctggggcttcgcgacgaactggacacgccgccgaagctcanggtgaggagctcaagacggcccgcttnngcatgtctccatgtttcggcttcttcgn

SEQ ID NO: 80491 - protein, 222 aa, Zea mays
  misc_feature: Ceres CLONE 1565802
  misc_feature (59)..(222): Pfam Name: Chloroa_b-bind Pfam Description: Chlorophyll A-B binding protein
  misc_feature (204)..(204): Xaa is any aa, unknown, or other
  misc_feature (213)..(213): Xaa is any aa, unknown, or other
  misc_feature (214)..(214): Xaa is any aa, unknown, or other
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACPVVLMGFVEGYRVGGGPLGKGSTSVPRRRLRPAGASRRTGHAAEAXGEELKTARXXMSPCFGFF

SEQ ID NO: 80492 - DNA, 816 bp, Zea mays
  misc_feature: Ceres CLONE 1565804
  misc_feature (269)..(269): n is a, c, t, g, unknown, or other
  misc_feature (340)..(340): n is a, c, t, g, unknown, or other
ggagctcaccgcggtggcggccgctctagaactagtggatcccccgggctgcaggaattcgtctcacccctagaaaaacgtcgtcgagcaaccaccagcaggtggtggtgatgattcaaccgtccacacgtcggacgacgaagctgtcgtcgtctacaggttgacggcagcctcccgcttcctcgtcagcgacgacgtgagcacggcgaccttggctccctttgtgagtctggcgctccagcctatcgctgcctgtccgcacgccctgngtatctccgcgtggttccggcaggagcagcacgagccgtccccgtatgggctggcggttcgccagaccccnacgatctggggacatgctgacgacgtaaacgccttgctgaaccaaggcatggccgcgggacagccgctccctcatgccaattgtgcctaagggagtgcggccagacgttttcgtgggatcgactcgtttgtttgactttcggggtgggccatggggggcccccccccccccaattgcggccgcctttccccccccttaagggggagggggggtttacctccccccacgtttttccccgggggccccctttgaatgggaaaagggcatttttttcccgggggaattttttgttgaagaaattttcccccgggggagaccgccgtgtttccccccaaaaaaaaacttctcatttaaaagggggggggggaaaaaaataaggtggggtccccaaaatttttttggagaaaatttttggggggggaaccctttttttttcctcccccggaaaaattagatggggggggagaaaaaaaata

SEQ ID NO: 80493 - DNA, 802 bp, Zea mays
  misc_feature: Ceres CLONE 1565805
  misc_feature: Encodes the peptide sequence at SEQ ID NO. 80494
ctccccgcggtggcggccgctctagaactagtggatcccccgggctgcaggaattcgtctcacccctagaaaaaagccaggccggccccggccacgagcccacgacaatgaagccgcccgcgtcgtccaccgccacctcctacctcctcctggccccgctcgcgatcctcctgctcgtcttcgtgctaccgtcgctccgcccttggtcccgcgtaggctccgactccgacggcctcggcatcctctgcgcccgccgcaccggcggcttcgtcgacgtcgccgccgacgcgccggcgccgccaccgggccagacgacacgggcggcggagttcagcctactggtgggcgtgctgaccgtgccgggccggcgggagcggcgcgacatcgtgcgcacggcgtacgcgctgcagccggccgcggagggcgcgcgcgtggacatgcgcttcgtgttctgccgcgtgacggacccccgtggacgcggcgctgctggcggtggaggcaaggcggcaccggggactcctggtgctggacggctgcccccagaacataacgacggcaagacgtacccgtacctgtcggtcgggccgcgcctctttcggggcggaaccttacgacttccttatgaaaggcgacgacaacccgtaccctgcccctgggcggcccttggcggggcgaccttgcggggaaagccccccccccaccgggaacctggggctaacggtaacccccatgggccggggcaccccaaatcccctttttgtcccgggatggggggaaaccgggtgtttctggggaacaaggg

SEQ ID NO: 80494 - protein, 231 aa, Zea mays
  misc_feature: Ceres CLONE 1565805
MKPPASSTATSYLLLAPLAILLLVFVLPSLRPWSRVGSDSDGLGILCARRTGGFVDVAADAPAPPPGQTTRAAEFSLLVGVLTVPGRRERRDIVRTAYALQPAAEGARVDMRFVFCRVTDPRGRGAAGGGGKAAPGTPGAGRLPPEHNDGKTYPYLSVGPRLFRGGTLRLPYERRRQPVPCPWAALGGATLRGKPPPHREPGANGNPHGPGHPKSPFCPGMGGNRVFLGNK

SEQ ID NO: 80495 - DNA, 861 bp, Zea mays
  misc_feature: Ceres CLONE 1565808
  misc_feature: Encodes the peptide sequence at SEQ ID NO. 80496
  misc_feature (644)..(644): n is a, c, t, g, unknown, or other
gagctccccgcggtggcggccgctctagaactagtggatcccccgggctgcaggaattcgtctcacccctagaaaaagtgcgtccccttcttaaaccttggcagtgcaagcccaggcagcctcatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccagggacccaccgtgagcgtggccatcgtggagcagtccgtgtccccgggccgcggcgcgtggctgggccggcagctgttctcggcccatggtggtgcgcaggnccggcgcactgttccctgaccagctgggcgtgggctacgacgaggcccaggactacgtggtggtcaagcacgcggcgctgttcacgttcaacgtgatgagccgggctctggccgcgcccaacgtgaagctgttcaacgccggtggcggtggaaggactgaatcgtgcgggcgggggcccttctgcggggtggtcaccaactgggcgcttcgtgtcat

SEQ ID NO: 80496 - protein, 77 aa, Zea mays
  misc_feature: Ceres CLONE 1565808
  misc_feature (6)..(6): Xaa is any aa, unknown, or other
MVVRRXGALFPDQLGVGYDEAQDYVVVKHAALFTFNVMSRALAAPNVKLFNAGGGGRTESCGRGPFCGVVTNWALRV

SEQ ID NO: 80497 - DNA, 650 bp, Zea mays
  misc_feature: Ceres CLONE 1565812
  misc_feature: Encodes the peptide sequence at SEQ ID NO. 80498
  misc_feature (619)..(619): n is a, c, t, g, unknown, or other
tccccgcggtggcggccgctctagaactagtggatcccccgggctgcaggaattcgtctccccctagaaaaaagcagcagcagagggcacaggcagcagctaccatccctcactcactctcggtacctgacctgaccacgagagcaacatgggcggaggacacgacatgcacgggcagcactacggccacaacggcgggcgtgaaagggctttctgggtccaaacccttttcccccggggggggggggggggccctggggcctgggaaagggtcccccccccctgggcccttaaaaaaaccgtcccccccccaggggaaaaggggggtttaaaggggggggcccccccgaaaatcacccccccccccccccccccccccgggggggtgttttcccccccccccccccgcggggggggggggatatcccctccccccccccccccggggggggcgccccccgagagtagaacccccttcttcctcccccgcccgaaaaaccacccccccccccccacttttttgggggggaaaaaaaaaaaaggggagaaggcgcgggggggggggggttctttttttccccccccccccaaccaacaaaaaattttttaatttgtaatngggggggggggggggccacccccccccccac

SEQ ID NO: 80498 - protein, 109 aa, Zea mays
  misc_feature: Ceres CLONE 1565812
PAVAAALELVDPPGCRNSSPPRKKQQQRAQAAATIPHSLSVPDLTTRATWAEDTTCTGSTTATTAGVKGLSGSKPFSPGGGGGALGPGKGSPPPGPLKKPSPPQGKRGV

SEQ ID NO: 80499 - DNA, 887 bp, Zea mays
  misc_feature: Ceres CLONE 1565814
  misc_feature: Encodes the peptide sequence at SEQ ID NO. 80500
  misc_feature (629)..(629): n is a, c, t, g, unknown, or other
  misc_feature (883)..(883): n is a, c, t, g, unknown, or other
ctccccgcggtggcggccgctctagaactagtggatcccccgggctgcaggaattcgtctcacccctagaaaaagtccttccctccgcctccgcctccgcccccgcccccgcccacgcccactcctcgctgccaccactcctgtcacctcttcccgcgccgacgcagccgccatggaccccgtcgccacatgggggctaaccccgctcgcgggcgccgacccggagatctacgacctcctggagcgcgagaagcggcgccagcgtcgcggcatcgagctcatcgcctccgagaacttcacctccttcgccgtcatggaggcgctcggctccgcgctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaaagagatctccgccacctcgatcntacttgagagcctgccgtacaaagtgagcgccgcaacgggggtacatcgactacaagaagctcgaggaagaaggcacttgacttcccgccccaagctcatcatctggcgggggcagtgcgtaccccgaggggactgggaatacgcacaagttcaagggccgtcgccgaacaagggtcgggggcccttgtcttgctctgcggaaatggcggcacaattaacggggcttccttcccccccccagggaaggctgccnaata

SEQ ID NO: 80500 - protein, 238 aa, Zea mays
  misc_feature: Ceres CLONE 1565814
  misc_feature (12)..(237): Pfam Name: SHMT Pfam Description: Serine hydroxymethyltransferase
  misc_feature: SWISSPROT Homolog: EC 2.1.2.1 Glycine hydroxymethyltransferase
  misc_feature (153)..(153): Xaa is any aa, unknown, or other
MDPVATWGLTPLAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKEISATSIXLESLPYKVSAATGVHRLQEARGRRHLTSRPKLIIWRGQCVPRGDWEYAQVQGPSPNKGRGPLSCSAEMAAQLTGLPSPPQGRLPN

SEQ ID NO: 80501 - DNA, 830 bp, Zea mays
  misc_feature: Ceres CLONE 1565816
  misc_feature: Encodes the peptide sequence at SEQ ID NO. 80502
  misc_feature (630)..(630): n is a, c, t, g, unknown, or other
  misc_feature (643)..(643): n is a, c, t, g, unknown, or other
  misc_feature (644)..(644): n is a, c, t, g, unknown, or other
  misc_feature (681)..(681): n is a, c, t, g, unknown, or other
  misc_feature (682)..(682): n is a, c, t, g, unknown, or other
  misc_feature (694)..(694): n is a, c, t, g, unknown, or other
ggagctccccgcggtggcggccgctctagaactagtggatcccccgggctgcaggaattcgtctcacccctagaaaaacccgtccgtatctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcagtggggatgatctcctgaagggcatattctttgaggtaaagaagaagtttgagacagctcttggtgttcttaaaaaggaaaagatcactattgatccagatgacccagcggcagtttctcgttatgcccaagtcatgaagactgtaagggaaaaggcggatcttctctctgattctcaaaggattaaatataccattgagaccttcaccaagggcatccctgatgcacggacttacttgaatactctttcacagctcagaaataagagtggtcttatagatcatcttggaaatgagcctttgatgatggaaaagctctgagagatngagaaggacattnnagaaacactttttgaggagcgacaagaagaacatggnnccacctcttggncagagtttgacaagattaacaaaaagcttggctttcggaagggaggatccttcccccagatcgagaagagcttgaattggaaaattgccaaagtgagctgactggacttaagaaggaatgccttgaaaacatggga

SEQ ID NO: 80502 - protein, 150 aa, Zea mays
  misc_feature: Ceres CLONE 1565816
MALAARLVSRSRQLYSVQATLGNGGVTQVRSFAKDAAPADRPPVSGDDLLKGIFFEVKKKFETALGVLKKEKITIDPDDPAAVSRYAQVMKTVREKADLLSDSQRIKYTIETFTKGIPDARTYLNTLSQLRNKSGLIDHLGNEPLMMEKL

SEQ ID NO: 80503 - DNA, 1196 bp, Zea mays
  misc_feature: Ceres CLONE 1565820
  misc_feature: Encodes the peptide sequence at SEQ ID NO. 80504
  misc_feature (58)..(58): n is a, c, t, g, unknown, or other
aaggttgatatatggaacgcttcgcgcgtatgaacactcctactctgcccccctagtnaccgacctaaacaaacttggactccccgcgggggcggccgctttataatagtggatcccccgggctgctttaattcgtctcacccctagaaaaaagtgcccagcctccgtccctctccttcccttacctcgcctcgtctcctctccttgagatctccagggtacgagcgcattcgcgattttggccgcctccgccgccgtccgggaagatggcgggtctgggaaatgctatgtacgcggtggggttctggatccgggagactggccaggccctcgaccgcctgggctgccgcctgcagggcaagtacttcttccacgagcagatttcaaggcattcgcgcctcatgaatatctttgaaaaaaccccctctgggcaaaaaagacccatttgttggttcaaggggattcccttattgccccacccctcaaatttggggtcagggaccttttcattttgggaaggggggccgtccttcaaagggggaggggaagcggtcgctctaagagttgcatttgtgggccccaatattccttgaacaaattaccctctatacaaggttggggtctaaatcctaattccccacttggggggaggggtctttttccccagaaaatctatttgggaagaataatacgctgcccaaatatacgcgcccccacaaaagcctttgttgcgtttaataaggggaaggggcccccgcggttgtagaagggattcgacacgctcttttttttggcttttgtgtccctttggagcggggcgtacctcaccctacttttttattacaaaggcggcggtataattgtttatttcttaaaaaaacaattaccgcggatattgtcggcgggcgctttttattatagaatggctcactctctctaaacgcgggcggaaacgatttcctcgagggagttcccccattgtcatatacgcacgccttatttcgtcgtgtaggggcaaaaccaccatcccgtaagtataccttctgaggggagagcctcctccgcattatacgaaaaaaaaactacgttctcagtgtgggggggaagtcacactgggttccatataattttcaacgcgattgcaaaagggcaccacaactggtgtaaaataaatttataaaccctcccttacaaag

SEQ ID NO: 80504 - protein, 108 aa, Zea mays
  misc_feature: Ceres CLONE 1565820
MAGLGNAMYAVGFWIRETGQALDRLGCRLQGKYFFHEQISRHSRLMNIFEKTPSGQKRPICWFKGIPLLPHPSNLGSGTFSFWEGGPSFKGGGEAVALRVAFVGPNIP

SEQ ID NO: 80505 - DNA, 900 bp, Zea mays
  misc_feature: Ceres CLONE 1565822
  misc_feature: Encodes the peptide sequence at SEQ ID NO. 80506
tccccgcggtggcggccgctctagactagtggatcccccgggctgcaggaattcgtctcacccctagaaaaattcctcggagaggagaagccgccgtcgcagcaatcacagcagcccggagaacggccaggtccgacaagatgcagatctttgtgaagacgctgacaggtaagaccatcaccctcgaggtcgagagcagcgacaccatcgacaatgtcaaggccaagatccaggacaacgaagggatcccgccggaccagcagcggctgatctttgccgggaagcagctggaagatggccgcaccccttgccgactataacttcaaaaagagtctacgcttcacctcgtgctcaaggctcgccgtggggattcatgagaccctcgcttgcagggctctcttctcaaattcaaccccggacaagatgatcttcccccaagggaaaaatggtggaagggggtttttttccaaaaaaaccacgggcccccaaatagggtttttggatcccccaaataaattttccccccttttttatttttgtcccccggtgcccccccaggggggaccccaagggtttttttccgggggggtccccccccgggggggttaacccacccccccaaaaaaaaaaagttggtgttcccccccaacccccccttatgggcgcccacaaaaaaaaaatccaaaaaaccccgggggggtggggtccccaacctaagttttttttggaaaaaaaatatgtgtttggtttgttttaaaaccccccttgttttttttccaacacgagaattttttttttggggggggggaaacaccccttttttttttcccacccaaatatggggcccgctcgtttaggtttttttccccgggggggggagaagaaaaaaaaaaaaataaa

SEQ ID NO: 80506 - protein, 59 aa, Zea mays
  misc_feature: Ceres CLONE 1565822
  misc_feature (6)..(60): Pfam Name: ubiquitin Pfam Description: Ubiquitin family
MQIFVKTLTGKTITLEVESSDTIDNVKAKIQDNEGIPPDQQRLIFAGKQLEDGRTPCRL

SEQ ID NO: 80507 - DNA, 679 bp, Zea mays
  misc_feature: Ceres CLONE 1565824
  misc_feature: Encodes the peptide sequence at SEQ ID NO. 80508
  misc_feature (512)..(512): n is a, c, t, g, unknown, or other
ctccccgcggtggcggccgctctagaactagtggatcccccgggctgcaggaattcgtctcacccctagaaaaaatttgcactgcatcgtatatatccaacaaaacggcagctagagatgatggcatcctccctcctctttgttgtcgtcctcctcgcagcgctgtcatcgccgccgccgtcagccgtcctggcggcggacgacgacggcaccacgcacctgcacttcttcatgcacgacgtggtgaccgggagcaacccgacggcggtgcaggtgatcaagggcgcggggtcgtcggtcgtcccggggctggcgttcggcgacaccacggtgatcgacgacgcgctgacggagacgtcgtcgcccacgtccgccgccgtgggccgcgctcagggcttctacatgatgtcgtcgcagtcgggcatcgtgctcatggtgtgcgccaacctgctgctcaccgcggggggaccacacggcagcacgctcgcggtgggtgggccgggacgacgtcnccggcggacgtgcggggagctctccgttcgtcggcgggcacggggcggggttcagggatggcaaccgggctacgttgctgttggaagaacttcccagcatggaacggggccttggaagcctacccgttcgaaagctttaaacgtggccacctttgaaggaccgggcc

SEQ ID NO: 80508 - protein, 187 aa, Zea mays
  misc_feature: Ceres CLONE 1565824
  misc_feature (10)..(182): Pfam Name: Dirigent Pfam Description: Dirigent-like protein
  misc_feature (132)..(132): Xaa is any aa, unknown, or other
MMASSLLFVVVLLAALSSPPPSAVLAADDDGTTHLHFFMHDVVTGSNPTAVQVIKGAGSSVVPGLAFGDTTVIDDALTETSSPTSAAVGRAQGFYMMSSQSGIVLMVCANLLLTAGGPHGSTLAVGGPGRRXRRTCGELSVRRRARGGVQGWQPGYVAVGRTSQHGTGPWKPTRSKALNVATFEGPG

SEQ ID NO: 80509 - DNA, 869 bp, Zea mays
  misc_feature: Ceres CLONE 1565825
  misc_feature: Encodes the peptide sequence at SEQ ID NO. 80510
  misc_feature (396)..(396): n is a, c, t, g, unknown, or other
tcaccgcggtggcggccgctctagaactagtggatcccccgggctgcaggaattcgtctcacccctagaaaaatcctttccttatcccctcccacttcgtctcccttcctggcttcctttcttcgccatggcaaccatgtccctccgctccctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtccacatggaagctggggagtttgagggaggtgctancctccacgccgccagggtgaaggggcagtacgctggcggtggagccgcccgaaggaggcccaaggtctaccgtgggggaacccttcccctacgaacgttcaacggaggaggggacttcgccgcaaaaatctttccgacccagggccggggggtacctcccagggtccccccgaaggttttttctttccaaccgaaaaaaaaacttgggccccaaaaacccgggggggtttttggggttttttgttttacccacggaaaccccccggtgtttaaaggaaagccttttaaaaaaaaaggccatttggaaaaaatgtttccaacaccccccctaaggaaaaattttaaggcggggggaggggtttttctggagaaaaggttgaaaacacaggggggggacttctttctttttgagggggggcaccctcccccctcttggggaaaaaaaacccccctcctaagagaaacacaaaatt

SEQ ID NO: 80510 - protein, 247 aa, Zea mays
  misc_feature: Ceres CLONE 1565825
  misc_feature (90)..(90): Xaa is any aa, unknown, or other
MATMSLRSLAMAMADTALPPAHKLLPTVSLPLLSSSTRAAPLLLFARRRLPLAPLVTSSDAVEAKSADEEEEKAGEPVHMEAGEFEGGAXLHAARVKGQYAGGGAARRRPKVYRGGTLPLRTFNGGGDFAAKIFPTQGRGVPPRVPPKVFSFQPKKKLGPQKPGGVFGVFCFTHGNPPVFKGKPFKKKGHLEKMFPTPPLRKNFKAGGGVFLEKRLKTQGGDFFLFEGGHPPPSWGKKTPLLRETQN

SEQ ID NO: 80511 - DNA, 863 bp, Zea mays
  misc_feature: Ceres CLONE 1565826
  misc_feature: Translation starting site: 192
  misc_feature: SWISSPROT Homolog: EC 6.3.2.19 Ubiquitin--protein ligase
  misc_feature (547)..(547): n is a, c, t, g, unknown, or other
  misc_feature (610)..(610): n is a, c, t, g, unknown, or other
  misc_feature (629)..(629): n is a, c, t, g, unknown, or other
  misc_feature (668)..(668): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (724)..(724): n is a, c, t, g, unknown, or other
  misc_feature (765)..(765): n is a, c, t, g, unknown, or other
ctccccgcggtggcggccgctctagaactagtggatcccccgggctgcaggaattcgtctcacccctagaaaaacccgattccaagctgctctcgtccctagaaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgaccttcccccagaactatcccaacagcccgccatcagtaagatttactttctgggatgtggcatccgaatgttttatccggatgggcgtgtttgcatttctattcttcatccacctggtgaagatcccagtggttatgagcttgcaagcgaacggtggacaccagtgcacacngtttgaaagtatagttctgagcatcatttcaatgctctctagtccgaatgacgagtctccagncaatattgaagctgccaanggatggagagagaagcgggatgagttcaagaagaaggtnaggcaatgtgtcccgcagtctcaggaaatgctgtgaaggaggaacatgnnnggagntgaatgagtctggcaatcggtgtgctgcaattcacaccaantatctcatgtcagcattcttttgcttttccccgtatattttttcaccgatgtcactccctaaagggggtggtgggtctctttagacaaactcgggacg

SEQ ID NO: 80512 - DNA, 1259 bp, Zea mays
  misc_feature: Ceres CLONE 1565827
  misc_feature: Encodes the peptide sequence at SEQ ID NO. 80513
  misc_feature (917)..(917): n is a, c, t, g, unknown, or other
  misc_feature (1187)..(1187): n is a, c, t, g, unknown, or other
  misc_feature (1188)..(1188): n is a, c, t, g, unknown, or other
tattattttttttattttcctttcgttttatatgtcgtcgccgatttgcgctccatcttctgtattctaaaaaatggggctccccgcggtggcggccgctctaaactagtggatcccccgggctgtttgattcgtctcacccctagaaaaacccgattccaagctgctctcgtccctagaaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgataggagaccgtcttccagtgggtggggtaagcgtcattcggccccgcccgaaccccctttttgaatggaggcctccctccagtgcgggaaatagacctttccccgcggtagggggcccccccccagcccgggcgtaaaattaaaacattttcccctcccaggggatagttgggatgttccgaaaggttttaatactcggaattggggtgtgcgttttggcgtttttgaaaaagatgcttagggccatcctcctggaggaaaacgaagcgctccgctgggggttatatttgagtttttggtggagctctgaaacgtggtcggtgtgccacccacctgggggatattaacggctctccgagacaagaattacttatttttttctcgccggaccgagcccacgaagtgcatgatggagtagtcgttaagttgacgtatagaccgaagtattgaagcaggagaatgactcacgcatcaatttagtaaataattattctctacatgagcgttcttctcgcgcgcgacggaatgattcgcgtcagcagaactanaaaacacgtgcctctgaccttagaagtatgctttctcacgtcacaagaacagatgttataagacgtataaatcgccttccccgccgtgtgaagatagtaccagatgtgatgatgaggatctcggttgtaatcaagaaggattcagcgccctcgggtgggggacgatgtatttagaaagaattcagcttgataatagtaaggtggattccgcacagagacggtgtctcagcacgtcgacattgttcaccctctagtactatcacgaaccanngattttcgcgcacggctaaaccccgagaagtggagtatagccagccggccaaaggacagtgctgccatcat

SEQ ID NO: 80513 - protein, 54 aa, Zea mays
  misc_feature: Ceres CLONE 1565827
MAGTPSQASLLLQKQLKDLAKNPVDGFSAGLVDDRRPSSSGWGKRHSAPPEPPF

SEQ ID NO: 80514 - DNA, 842 bp, Zea mays
  misc_feature: Ceres CLONE 1565828
  misc_feature: Encodes the peptide sequence at SEQ ID NO. 80515
ctccccgcggtggcggccgctctagaactagtggatcccccgggctgcaggaattcgtctcacccctagaaaaacccgattccaagctgctctcgtccctagaaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgaccttcccccagaactatcccaacagcccgccatcagtaagatttacttctgggatgtggcatccgaatgtttatccggatgggcgtgtttgcatttctattcttcatccacctggtgaagatcccagtggttatgagcttgcaagcgaacggtggacaccagtgcacacggttgaaagtatagttctgagcatcatttcaatgctctctagtccgaatgacgagtctccagcaaatattgaagctgccaaggattggagagagaagcgggatgagttcacgaagaaggttaggcaatgtgtccgcaggtctcaggaaatgctgtgcaggaggaacatggggggagttgaatgagtctgcaatcggtgtgctgcaattcaccaccaaatatctcatgtcagcattctttttgcttttcccctggtatatttttttcaccgatgtcactccgaatagtggggggtgggg

SEQ ID NO: 80515 - protein, 178 aa, Zea mays
  misc_feature: Ceres CLONE 1565828
  misc_feature (11)..(162): Pfam Name: UQ_con Pfam Description: Ubiquitin-conjugating enzyme
  misc_feature: SWISSPROT Homolog: EC 6.3.2.19 Ubiquitin--protein ligase
MAGTPSQASLLLQKQLKDLAKNPVDGFSAGLVDDSNVFEWQVTIIGPPDTLYDGGYFNAIMTFPQNYPNSPPSVRFTSGMWHPNVYPDGRVCISILHPPGEDPSGYELASERWTPVHTVESIVLSIISMLSSPNDESPANIEAAKDWREKRDEFTKKVRQCVRRSQEMLCRRNMGGVE

SEQ ID NO: 80516 - DNA, 810 bp, Zea mays
  misc_feature: Ceres CLONE 1565831
  misc_feature: SWISSPROT Homolog: EC 4.1.1.39 Ribulose-bisphosphate carboxylase
  misc_feature (331)..(331): n is a, c, t, g, unknown, or other
  misc_feature (343)..(343): n is a, c, t, g, unknown, or other
  misc_feature (413)..(413): n is a, c, t, g, unknown, or other
  misc_feature (426)..(426): n is a, c, t, g, unknown, or other
gagctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagaacgctgtcgtnacctgcccgccngctgtcgacggacgacctgctgaagcaggtggactacctgctgcgcaacggctggataccctgcctcgangtcagcaaggtcngcttcgtgtaccgcgagaactccacctccccgtgctactacgacgggcgctactggaccatggtggaagctgcccatgttcggctgcaacgaccccacccaggtgtacagggagctgcaggaggccatcaatccttacccggaagcctttcacccgcgttaatggggtttcaaaaaatcaaagcaaaaccagtgggtcaacttcattgccctaaaagcccccggggaaggaaataaaaccggccccgccggggcggccccccgcccgggaaaaaaagataaacaaaacccccggggggaagcaaaaaacaaaggggccaaagggcccccctctttggcgtttggggtttgtgttttggggggacccccttgaacccttttgttg

SEQ ID NO: 80517 - DNA, 823 bp, Zea mays
  misc_feature: Ceres CLONE 1565833
  misc_feature: Translation starting site: 255
  misc_feature: SWISSPROT Homolog: EC 4.1.2.13 Fructose-bisphosphate aldolase
  misc_feature (449)..(449): n is a, c, t, g, unknown, or other
  misc_feature (649)..(649): n is a, c, t, g, unknown, or other
  misc_feature (671)..(671): n is a, c, t, g, unknown, or other
  misc_feature (676)..(676): n is a, c, t, g, unknown, or other
  misc_feature (718)..(718): n is a, c, t, g, unknown, or other
  misc_feature (726)..(726): n is a, c, t, g, unknown, or other
ctggagctccccgcggtggcggccgctctagaactagtggatcccccgggctgcaggaattcgtctcacccctagaaaaaaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcnaacgcgacgtgcgggaagcggctggcgtccatcgggctggagaacacggaggccaacctggcaggcgtaccgcacgctgctggtcacggcgccgggcctgggccagtacatctccgggcgcatcctcttcgaggagacgctgtaccagtccgccgtcgacggccgcaagatcgtggacatcctggcggagcagggcatcntgcccggggatcaaggtggacnagggncttgtccggctcgccggctccaacaacgagtcgtggtgccanggcctggnacggctggcgtcccgcgaggccgcctactactagcaagggcgcgcgggtcgcccaagtggcgcaccgtcgtcagcatcccttaacggcccctccgag

SEQ ID NO: 80518 - DNA, 761 bp, Zea mays
  misc_feature: Ceres CLONE 1565834
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (53)..(53): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (100)..(100): n is a, c, t, g, unknown, or other
  misc_feature (104)..(104): n is a, c, t, g, unknown, or other
  misc_feature (117)..(117): n is a, c, t, g, unknown, or other
  misc_feature (128)..(128): n is a, c, t, g, unknown, or other
  misc_feature (133)..(133): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (152)..(152): n is a, c, t, g, unknown, or other
  misc_feature (155)..(155): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (188)..(188): n is a, c, t, g, unknown, or other
  misc_feature (221)..(221): n is a, c, t, g, unknown, or other
  misc_feature (424)..(424): n is a, c, t, g, unknown, or other
  misc_feature (611)..(611): n is a, c, t, g, unknown, or other
  misc_feature (695)..(695): n is a, c, t, g, unknown, or other
  misc_feature (696)..(696): n is a, c, t, g, unknown, or other
  misc_feature (705)..(705): n is a, c, t, g, unknown, or other
nnnnnnnnnnnnnnnnnnnnnnnnnnnnnnnnnnnnnnnnnnnnnnnnaaaanaaaaaaaaaaccccaanannannnggggggnnncnnngggaaaaccncccnaaaaaatccaaanacagaacaaanaaacncccagcnnnnnnnngaganaanannnnccaaaaacctggggacctccaccccggntggcggcccgctctaaaactagtggaatccccncgggctgcaggaaattcgtctcacccctagaaaaaacgatcacacaccactccacagcagtagcaagagggatagagcaaggccacacacacacacacaccactaggctaggttagccttttaatcgtcgtcgagaagcaagaaagcgcgcacgcaagcaggcaagcaagaagagagcccgatcgaccgaggagctagcacgnccatggccaaggtctttccaaaattaatgggtgggccggcaagcctccttcctgggccctttgggccccttgggccccttgttccaacccccccccaaaaagccccaaggaaaaaactttctcaaagaaaccccccccaaaaacaaaaaccggaaaaaaaaaaaaaaaggggaccccaaaccccccntttttggggtttttaaaaccccccccaaaaaaaaaacctttttcccccccccccccttttttaaaaccccccccctttttcccnncccggggcnggggggcccccttttccccccccgggggggtttttttgggggggggggcgcccttc

SEQ ID NO: 80519 - DNA, 802 bp, Zea mays
  misc_feature: Ceres CLONE 1565835
  misc_feature: Encodes the peptide sequence at SEQ ID NO. 80520
  misc_feature (614)..(614): n is a, c, t, g, unknown, or other
ctccccgcggtggcggccgctctagaactagtggatcccccgggctgcaggaattcgtctcacccctagaaaaagcaccacagtagctagctagctatctttgctacggcggctctgtaatctggtccactagcgctccattcgaccccacccacagccatggctgccgtgaccgcggcggccgtctctctgccctcctcctcctcctcccctgccgccgccaaggccaaggcgtccgcgtccgcgtccccgtcgtctccatgcggccacctccagttcccgcggcggcacggcggcccgcgcgcggtgcggctgcgcgtgcaggtgtccaccaccgagaccgcggaggcggagccggtcaagaagctggagaaggtgtccaagaagcaggaggaggggctcgtcaccaacaagtacaagcccaaggagccgtacgtcgggaggtgcctgctcaacaccaggatcaccggcgaccaagcgcccggggagacgtggcacatggtcttcagcacagaaggcgaggtcccctacagagagggccagtccatcggcgtcatcgcggatggcgaggaacagaacggcaagcccgcacagctcaggctctactccatcgncagcagcgccctcggagatttcggcgactccaagacggtgtctctgtgcgtgaagaagcttgtctaaccaacgattcagggggaggtcgttcaaggagtcttgtccaaaatcctcttgtggaattaaaccaagcccctaaaatgaaaaaaaaaagggcccatggggcaaggaaaactccttgcccaaa

SEQ ID NO: 80520 - protein, 173 aa, Zea mays
  misc_feature: Ceres CLONE 1565835
  misc_feature: SWISSPROT Homolog: EC 1.18.1.2 Ferredoxin--NADP(+) reductase
  misc_feature (152)..(152): Xaa is any aa, unknown, or other
MAAVTAAAVSLPSSSSSPAAAKAKASASASPSSPCGHLQFPRRHGGPRAVRLRVQVSTTETAEAEPVKKLEKVSKKQEEGLVTNKYKPKEPYVGRCLLNTRITGDQAPGETWHMVFSTEGEVPYREGQSIGVIADGEEQNGKPAQLRLYSIXSSALGDFGDSKTVSLCVKKLV

SEQ ID NO: 80521 - DNA, 846 bp, Zea mays
  misc_feature: Ceres CLONE 1565837
  misc_feature: Encodes the peptide sequence at SEQ ID NO. 80522
  misc_feature (533)..(533): n is a, c, t, g, unknown, or other
  misc_feature (572)..(572): n is a, c, t, g, unknown, or other
  misc_feature (707)..(707): n is a, c, t, g, unknown, or other
agctccccgcggtggcggccgctctagaactagtggatcccccgggctgcaggaattcgtctcacccctagaaaaactctctctgaccttatccccttgcggcaaaaccttgcgcgcaacaatggccgcctccctcccgaccaccgccgcgcgcctcgcggccccggccttcgcctaccggtcgcccaaggctccctccgccaccgccctcccgcgtgccgccgccttccctgcaatcgccgtcgcggcggcgcccctgcgcccgcgccgcgcgccgaggccggtggcggcccgggccgggggcgaggagcgggagacgatactgctccccgggtgcgactacaaccactggctgatcgtcatggagttccccaagggacccgcgcccacccgcgagcagatgatcgacacctacctcaacacactcgccaccgtcctcggcagcatgggaggaagccaagaagaacatgtacgcattcagcacgaccaccctacaccggggtcccagtgcaccgtggacgaagagacgctcngagaagttcaagggtctgcctgggggtgctgtgggtgcntccttgattccctacatcgacgtgaagaacagggacttaccgaggtgacaagtacgtgaacggcgagatatccccctgcacgtacccgacgtaccagccgaggaagcggaggacgtcccagtaccagagcaggcngtacaagagggcggaaagatgggccacccggcgcccagcagaaacccaggcagcaggcatcagctcagactcagaacgagtcggcgtcttcgtgacaagcttggcaggcattttgtccacgtactaccctacctagaac

SEQ ID NO: 80522 - protein, 169 aa, Zea mays
  misc_feature: Ceres CLONE 1565837
  misc_feature (138)..(138): Xaa is any aa, unknown, or other
  misc_feature (151)..(151): Xaa is any aa, unknown, or other
MAASLPTTAARLAAPAFAYRSPKAPSATALPRAAAFPAIAVAAAPLRPRRAPRPVAARAGGEERETILLPGCDYNHWLIVMEFPKGPAPTREQMIDTYLNTLATVLGSMGGSQEEHVRIQHDHPTPGSQCTVDEETLXEVQGSAWGCCGCXLDSLHRREEQGLTEVTST

SEQ ID NO: 80523 - DNA, 834 bp, Zea mays
  misc_feature: Ceres CLONE 1565839
  misc_feature: Encodes the peptide sequence at SEQ ID NO. 80524
ctccccgcggtggcggccgctctagaactagtggatcccccgggctgcaggaattcgtctcacccctagaaaaaatccgtcccgacccgaccagctttgagatcgcgatggcggacggccgctgctgcaccttcctggagatcctcttcgccatcatcctcccgcccctcggcgtcttcctccgattcggctgctgcagaatagagttctgcatctgcctgctgctcaccatccttggctacgtccccggaatcatctacgcgatctatgtccttgttgctctcgactctgaccagcacgagagggaatactacacccttgcttagagcatctggttgtgccaggcgggcctgcacagttgagtcgaaatcagtattttttttctcatgtggattgtctgacatggcataagcggcaatgggtaaccaagtgttgtggtctatatctctgttacccaacttgtgagctctcttttatgtgctcccagttattcatctgtaattgtgatactacagagaatagatgcgcatgtaaagccccggatcaagagcaatggcgctcgccaagccaaagagatcgttgcctccgctcccctcggcgtcttcaggaaaaatttcctgtccttttctgggtcccgggggaaaccattttttcaaaaaactctcgaagccaacctacaagggccctttgaatttggaaaaaggggaaattgggtgggggccttaaaccctcccaataggcccctttaaagggggtgggaactgggaacaaaaagaaaactttctcccacaagaggttttttttctcacagggggggggaagaaacttttttgg

SEQ ID NO: 80524 - protein, 72 aa, Zea mays; identical to SEQ ID NO: 51501
  misc_feature: Ceres CLONE 1565839
  misc_feature (7)..(58): Pfam Name: UPF0057 Pfam Description: Uncharacterized protein family UPF0057

SEQ ID NO: 80525 - DNA, 813 bp, Zea mays
  misc_feature: Ceres CLONE 1565840
  misc_feature: Encodes the peptide sequence at SEQ ID NO. 80526
gagctccccgcggtggcggccgctctagaactagtggatcccccgggctgcaggaattcgtctcaccatcgagaccaccacttctgagataatcaggctcagagaatccgagctatttccccagcttcttgagctgattgctggcttgatgagcatgtggaggggtatgtacgagtgccatcaagttcagacccacatcgtgcagcagctggagtacctgaacaatgctcggaataccaatccgacttccaatgtccaccggcaagcagctcttcagctcgagatagaggttgacaggtggtattcagccttctgtagtctggtgaaatcccagagagactacgtctactcattgaccggctggcttcgtctatcgctgttctgccaccacgacccactgactaaagctcagaactcagatatctatggcttgtgtgaggaatggcagctagccatcgacagaatcccagataaggtggcctcggaagggatcaagactctcctgacagtgattcatgctgtcgtcattcaacaagctgaggagcataagcagaagaagaggtcggagtctgcattcaaagagtttgagaagaaagcagaggagctgagagtcctggagtcaaatatgtcgggcgctgaaagttacagaggaatgtcacgaaaatcatcggtagctgacaggcgggcaaaggtttgagctcttgagaagccctgcctcaccaggagagatcaaattcgagaagagcatcgggggtcaccaaaggcatgaaccctgaataacttggcaaactggctttcctttacgtttttccg

SEQ ID NO: 80526 - protein, 182 aa, Zea mays
  misc_feature: Ceres CLONE 1565840
  misc_feature (1)..(134): Pfam Name: DUF632 Pfam Description: Protein of unknown function (DUF632)
  misc_feature: The sequence is a functional homolog of SEQ ID NO 206 in the 10/666,642 US patent application
MSMWRGMYECHQVQTHIVQQLEYLNNARNTNPTSNVHRQAALQLEIEVDRWYSAFCSLVKSQRDYVYSLTGWLRLSLFCHHDPLTKAQNSDIYGLCEEWQLAIDRIPDKVASEGIKTLLTVIHAVVIQQAEEHKQKKRSESAFKEFEKKAEELRVLESNMSGAESYRGMSRKSSVADRRAKV

SEQ ID NO: 80527 - DNA, 749 bp, Zea mays
  misc_feature: Ceres CLONE 1565841
  misc_feature: Translation starting site: 187
  misc_feature (292)..(292): n is a, c, t, g, unknown, or other
  misc_feature (367)..(367): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
ctccccgcggtggcggccgctctagaactagtggatcccccgggctgcaggaattcgtctcacccctagaaaaaccgcactctctctcaactcattggcagcagcaaccgcagccgcgagggccaagcaggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcnggcgggctcgctcatcgagtcccaccaaacaagaacctcatcttcaacgttcaccctggtcttatgcttatcggntattggtatatcggcggtgagctataatggtgtacagggtacttccacatcgaatcatgacccacttagctgatccatctaatctcccggggattgcctttgtctttggggcgttgggaaatactttgctttcaaaatcccaatgggggggggattgcccatcttttcaggccgccctgggtggaagaaaatcttttggggtccgaaagtcccttcgccagaggtcgcctgctctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 80528 - DNA, 1940 bp, Zea mays
  misc_feature: Ceres CLONE 1565842
  misc_feature: Encodes the peptide sequence at SEQ ID NO. 80529
ctcccgctcccctcatcgccttcgtggcctggcctgcccgtcgtgtgcgcctctgcgcctctccctccctccctccctcccccgatcgtaaccgccgcctccgatcgatcgccacgatgcggctcttctgacgaaccgccgggcgcgtcaccgtcaccgaccgagacccgcgcccctcgcctggactccatggccgcgtcctccccgatggtgctgtcgctgctcctcttggcgtcgctcacggcgctgctggtcctcgcgccgcgcctgtccccgccgcagccgccgacgggcgagcaggcgccggcggcccccggtggtggtggcggcgaggaggaggaggaggccgacgacctccgcctgttccgccgcgcggctctggagtcgtcggcggcgggcggccctcccaaggtggccttcctgttcctgaccaactccgacctcaccttcgcccctctctgggagcgcttcttcgcggggaacgaggcgcggctgcgggtgtacgtccacgccgacccggccgcgcgcctgcgcctgccgcccacgccctccttccggggccgcttcgtggccgccaggcccacgcggcgcgccgacgccagcctcatcgccgccgcgcgccggctgctggcggccgcgctgctggacgacccggccaacgcctacttcgcgctgctgtcgcagcactgcgtgccgctccactccttcccgcgcctctacgccgcgctcttcccgacaccggcggcggcggcggcggccacgcgtgcacgcagctacatcgaggtgctgaagggcgagccgcagatggcgtcgcgctacgcggcgcgcggcggcgaggagggcatgctcccggaggtgccctacgagcggttccgcatcgggtcgcagttcttcgcgctggcccggcgccacgccgtgctggtggtccgggagcgccggctgtggcgcaagttccgcgcgccctgcgtccccgagatggcgcaggactcgtgctaccccgaggagcactacttcccgacgctgctggacatggcggaccccggcggcgtggcgcggtacacgctgacgcgcgtcaactggacgggcagcgtcgcgggccacccgcacacgtacgccgcgccggaggtctcgccgaggctcatcgcagacctccgcgcctccaaccacacccacccccacatgttcgcgcgcaagttcgcgcccgactgcctcggcccgctcctcgccatcgccgacaccgtcatcttcaaggactgatggcgggcggctccatccaggtacgggtgtgaaagagcagaattcagttgtgttcatttccatatgttgcctgctcagccctgctctttgccgaaagagcagaacagagtgatgaagtcgtagtcgtagattttctgagttgacaacgatatcccaacctccacgcccactaagagatctcgagttctcggctaacaaaaagcgtctaacaataatcggtactggccacaccagttcgcttgatcatatctttgcgtgcggattaggtttcgtctggactggactggactggttaggttggtttcgtcccggtccgtgctcaaatcaatcaaaggcgctcgcaacgtcaactaacaataacaacccccgttcggaccatcctcgcaggtactacttactagttactactcggcagcagagggctggggctagtcaaggccgccgacgacggacggcgcggcagcggaagcagtgctctcccgtttcgaccccctccccctgcagcgtcatgttcatcagctccagtgcttctgtgtagtagattaggggtgcagagaagaagaggaggacgacgacgacagcacgcggcgacctaatgcgaagcggcaggttgtggttgtggttgcgaacgtggacgcgtcctcgatcgttcgtcgtccatccgggaaaaaaaaaaaaaaaaa

SEQ ID NO: 80529 - protein, 355 aa, Zea mays
  misc_feature: Ceres CLONE 1565842
  misc_feature (50)..(345): Pfam Name: DUF266 Pfam Description: Arabidopsis protein of unknown function, DUF266
MAASSPMVLSLLLLASLTALLVLAPRLSPPQPPTGEQAPAAPGGGGGEEEEEADDLRLFRRAALESSAAGGPPKVAFLFLTNSDLTFAPLWERFFAGNEARLRVYVHADPAARLRLPPTPSFRGRFVAARPTRRADASLIAAARRLLAAALLDDPANAYFALLSQHCVPLHSFPRLYAALFPTPAAAAAATRARSYIEVLKGEPQMASRYAARGGEEGMLPEVPYERFRIGSQFFALARRHAVLVVRERRLWRKFRAPCVPEMAQDSCYPEEHYFPTLLDMADPGGVARYTLTRVNWTGSVAGHPHTYAAPEVSPRLIADLRASNHTHPHMFARKFAPDCLGPLLAIADTVIFKD

SEQ ID NO: 80530 - DNA, 757 bp, Zea mays
  misc_feature: Ceres CLONE 1565846
  misc_feature: Encodes the peptide sequence at SEQ ID NO. 80531
  misc_feature (511)..(511): n is a, c, t, g, unknown, or other
  misc_feature (512)..(512): n is a, c, t, g, unknown, or other
ctccccgcggtggcggccgctctagaactagtggatcccccgggctgcaggaattcgtctcacccctagaaaaaatttgcactgcatcgtatatatccaacaaaacggcagctagagatgatggcatcctccctcctctttgttgtcgtcctcctcgcagcgctgtcatcgccgccgccgtcagccgtcctggcggcggacgacgacggcaccacgcacctgcacttcttcatgcacgacgtggtgaccgggagcaacccgacggcggtgcaggtgatcaagggcgcggggtcgtcggtcgtcccggggctggcgttcggcgacaccacggtgatcgacgacgcgctgacggagacgtcgtcgcccacgtccgccgccgtgggccgcgctcagggcttctacatgatgtcgtcgcagtcgggcatcgtgctcatggtgtgcgccaacctgctgctcaccgcgggggaccacaacggcagcacgctcgcggtggtgggccgggacgacgtcnncgcggacgtgcgggagctctccgtcgtcggcggcacggggccgggtcagggatggcaccgggctacttgctgtgggaaaaccttccaacatgaaaggggccttgacccttcccgcccaaatcttcaaaggtgccctgggggggcgggccaaaaaacccccgcccccacggggggggggggccccccccggggggggccctcttttctcgggggggggggccccccttctccttaattaaaggagc

SEQ ID NO: 80531 - protein, 209 aa, Zea mays
  misc_feature: Ceres CLONE 1565846
  misc_feature (10)..(159): Pfam Name: Dirigent Pfam Description: Dirigent-like protein
  misc_feature (132)..(132): Xaa is any aa, unknown, or other
MMASSLLFVVVLLAALSSPPPSAVLAADDDGTTHLHFFMHDVVTGSNPTAVQVIKGAGSSVVPGLAFGDTTVIDDALTETSSPTSAAVGRAQGFYMMSSQSGIVLMVCANLLLTAGDHNGSTLAVVGRDDVXADVRELSVVGGTGPGQGWHRATCCGKTFQHERGLDPSRPNLQRCPGGAGQKTPAPTGGGGPPRGGPSFLGGGGPPSP

SEQ ID NO: 80532 - DNA, 850 bp, Zea mays
  misc_feature: Ceres CLONE 1565847
  misc_feature: Encodes the peptide sequence at SEQ ID NO. 80533
  misc_feature (657)..(657): n is a, c, t, g, unknown, or other
  misc_feature (674)..(674): n is a, c, t, g, unknown, or other
  misc_feature (696)..(696): n is a, c, t, g, unknown, or other
ctccccgcggtggcggccgctctagaactagtggatcccccgggctgcaggaattcgtctcacccctagaaaaaacctccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgcccgcatctgcgacggcatcctcgccctgctcgactcacacctcgtcccatccgccggcggcgccgagtcccaggtcttctacctcaagatgaagggtgactaccacaggtaccttgctgagttcaagtctggtgcanagaggaaagatgctgcngagagcaccatgaatggctacnaagctgctcaggacatttgctctgcagatctgggctcaacccaccccatcaggcttggccttgctctcaaacttctcagtgtttctactacgagatcctgaaactcccctgatcgcggctggcacctttggcaaaacaggccttccaagaaggg

SEQ ID NO: 80533 - protein, 195 aa, Zea mays
  misc_feature: Ceres CLONE 1565847
  misc_feature (8)..(196): Pfam Name: 14-3-3 Pfam Description: 14-3-3 protein
  misc_feature (150)..(150): Xaa is any aa, unknown, or other
  misc_feature (163)..(163): Xaa is any aa, unknown, or other
MSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESQVFYLKMKGDYHRYLAEFKSGAXRKDAAESTMNGYXAAQDICSADLGSTHPIRLGLALKLLSVSTTRS

SEQ ID NO: 80534 - DNA, 869 bp, Zea mays
  misc_feature: Ceres CLONE 1565849
  misc_feature: Translation starting site: 219
  misc_feature: SWISSPROT Homolog: EC 1.2.4.1 Pyruvate dehydrogenase (acetyl-transferring)
  misc_feature (437)..(437): n is a, c, t, g, unknown, or other
  misc_feature (460)..(460): n is a, c, t, g, unknown, or other
  misc_feature (461)..(461): n is a, c, t, g, unknown, or other
  misc_feature (670)..(670): n is a, c, t, g, unknown, or other
acccgcggtggcggccgctctagaactagtggatcccccgggctgcaggaattcgtctcacccctagaaaaaatcacagatacacaccacgctaagccaaatcgagcaacgcctatcatcatattataatttcccctcattcatctcacagtcccaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcagcagacccttctgtttttctgatgggagaaagaggtggcgaaataccaggtgcatancagatatccaaggggtttgcttnngacagtatggccccggataggggtctcgataactccgatcactgaggcggggcttcactggcattggtgttggtgcccgcttaccatggtctttcgacctattggagaagtcatggactttaacttttcgaaggcggcaatggatcacctaattaattcgctggccaggccaaactaaatggtttgtggggaaaaaaccggtcccaatngcctttaggggtccacatgggggttccctcctggaattgggcgcccaaaacctccaaaggctttgcaccttgggtatgccacaggtcccggggaatgaaaagttttccctcccaatttctctgaaaaaaatcccgaggtgtttctaaaaaaccaatcgggggacccaaacccggggggttcccttaaaaaaaaaacttt

SEQ ID NO: 80535 - DNA, 864 bp, Zea mays
  misc_feature: Ceres CLONE 1565851
  misc_feature: Encodes the peptide sequence at SEQ ID NO. 80536
ctccccgcggtggcggccgctctagaactagtggatcccccgggctgcaggaattcgtctcacccctagaaaaattccttcagctgtccgcccgcggcccacccctccgtcgtctccaccattccgccgttcccaccacgccactcgccagttcgtcactccctcctgtctccccccttgccgagacggcgcggacgccccgtcgcccaccccgatggcttccactctcctccacgccgccaccgcctcgctccagagctcctcccagcccgcacgcgcgggcgccgccaccgcctttcaccccctcgcgtccaccccatccatacgcctcgcgcgctcctcgttctcgtccaatcgccgcctcgaggtttcactcccgggcggtttcggccggtcaccggttcgcgggggaggggagcaccccggggcccgccgcgtcgtcgcccgccctagcaggggagcaaactgaggggtcagaggtggggcgatgacaagggataacagcaacggggaagataaagccccgaggaggctcaggaaagcttggaaaggtaatgcttggaccatttcaaggctgaaggccctttcggatgcaagcccctgtccaattgcaggggttttgaatgtctacctccaaaaagggggcaaggggaaggctttttcttggaaaacccctttttgaaaaactttaaaaaaatccgggggggaaaaaagcccccagaaggggcccccccccgtgggggatccccccccccccggggttttttctccgggggggaacggggaaaatttcttgtggggagaggggaactttttgaaaattcccctcccaaatatttgtattgggggggtttttcttccccc

SEQ ID NO: 80536 - protein, 84 aa, Zea mays
  misc_feature: Ceres CLONE 1565851
MASTLLHAATASLQSSSQPARAGAATAFHPLASTPSIRLARSSFSSNRRLEVSLPGGFGRSPVRGGGEHPGARRVVARPSRGAN

SEQ ID NO: 80537 - DNA, 872 bp, Zea mays
  misc_feature: Ceres CLONE 1565853
  misc_feature: Encodes the peptide sequence at SEQ ID NO. 80538
  misc_feature (655)..(655): n is a, c, t, g, unknown, or other
  misc_feature (857)..(857): n is a, c, t, g, unknown, or other
gagctccccgcggtggcggccgctctagactagtggatcccccgggctgcaggaattcgtctcacccctagaaaaaatcgctcgctgagcttccgttgttgcacagcacatcgatcgacgacgatatcgggaagcaatatggggttggccttgtcgcggctggaggagattaggacgcagtaccgcatggcagcggaagacggcgaggctgacagtccggcaccggcgccagtgccgccgaccggtgctgctgctgcttccggcggcggcactgaaaagaagaagcaggcggacgactcgtcgtcgtcgtcaaagacgacagaatgggttcctcataagttctctgagatcgtcggtcaaagacgacctggtgaggatatgttccgagggatctaccttccacgatcggatcagcagccgaaaacaaagaagtactgggtagatgggagaaatgccaactgcttcatgctgttccctaaaggattcagcatcacctggggttcggacgaaaggtactggagttggcgcaagctcacacaagaagagaaaagagggatcgacgacgaggaggccaacatggaggtggcgtaccttcaggacgtgtgctggctggagatccgtgcgaagctggagatgtcccacctcactccggggnatcactacgtcgtcgccttttgtagccaagctcgaaccgaaacgctacggcctggtccgagccgggtcgaccttccagatcaagtggtccgggcgacatcgacgggaagccttcgtcagcagccggaaaggagagtctattggaagaccgttggacgggaaaaaagtggacggaccttcaatgtccgggaagggtaaaagcngaaagcccggtcaaa

SEQ ID NO: 80538 - protein, 237 aa, Zea mays
  misc_feature: Ceres CLONE 1565853
  misc_feature (173)..(173): Xaa is any aa, unknown, or other
MGLALSRLEEIRTQYRMAAEDGEADSPAPAPVPPTGAAAASGGGTEKKKQADDSSSSSKTTEWVPHKFSEIVGQRRPGEDMFRGIYLPRSDQQPKTKKYWVDGRNANCFMLFPKGFSITWGSDERYWSWRKLTQEEKRGIDDEEANMEVAYLQDVCWLEIRAKLEMSHLTPGXHYVVAFCSQARTETLRPGPSRVDLPDQVVRATSTGSLRQQPERRVYWKTVGREKSGRTFNVREG

SEQ ID NO: 80539 - DNA, 879 bp, Zea mays
  misc_feature: Ceres CLONE 1565855
  misc_feature: Encodes the peptide sequence at SEQ ID NO. 80540
  misc_feature (500)..(500): n is a, c, t, g, unknown, or other
ctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaaagctgcccatgtcngctgcaacgacgccaccccagtgtacaaggagctgcaggaggccatcaaaatctaccccggagccttttcacggggtcatcgggttcgacaacttcaagaaaaccagtggggtagtttattcgctaaaagccccgggaagaggaataaaccggccccgcgggcccccccccgcgggtaagtaaaaccccccggcggagccaaaaaacaaaaaagggcctgggccccttccttgtctttcgggttggctttggggggcccccaaaccccttgggggggggggggcccccccccccctttcccctttttttttttttctttccccgcggcggggggtcttttgtttttcaaatttttctcgggcggggggggaagatccca

SEQ ID NO: 80540 - protein, 180 aa, Zea mays
  misc_feature: Ceres CLONE 1565855
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (122)..(122): Xaa is any aa, unknown, or other
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKAAHVXCNDATPVYKELQEAIKIYPGAFSRGHRVRQLQENQWGSLFAKSPGKRNKPAPRAPPRG

SEQ ID NO: 80541 - DNA, 885 bp, Zea mays
  misc_feature: Ceres CLONE 1565856
  misc_feature: Encodes the peptide sequence at SEQ ID NO. 80542
  misc_feature (883)..(883): n is a, c, t, g, unknown, or other
  misc_feature (885)..(885): n is a, c, t, g, unknown, or other
ctggagctccccgcggtggcggccgctctagaactagtggatcccccgggctgcaggaattcgtctcacccctagaaaaaagtggcagtgggtggccacccaatcgtctgtctcgttcgtcatctacctctccctcctccaacccaagctaagctaaacagtcttacagctcgctccgccatcaccgtatcgagagagacagacaccggctatcgagggaatggagaggatgctggacaggctgatgcagcagatgagcttcatgcaccatgtcggtctcatcagcacagaggagcgatcgacccgctgcaggccgccggggccaattggggactacccgttgatcttgtcgcaccggccggagcagcagccccctgcccgacttccgtcgttctgccaggggctcaacaatcgggaactaccggctttgcctgtttatccgggaaggaccccaatggtgggaatttaaacaaggggacccgaaggggggcggccccccgcggggggttgccaaagatccgagtttccttgaaagggggcctttccggggggaaaaaccaaacccggggggaattcccatttcggggaaaaaaaccgtaaaaaaaaggggggggtcttttttctcccccgcgaaagaaaccggtttaaaatagggccccccaccctgggggaaaaaaagtgggggttccggggggtgggggggttttttttgggggggggccctcccaaaggggggttttaaaaacacttttggctttccccaaaaaggggggtttataaaaaaaaccttttgggggggaggggggggggggtggaaaaatatggtggggggtttttttgggggaaaacaaaaaaagggggtggtgggtgttgtgcagccacncn

SEQ ID NO: 80542 - protein, 82 aa, Zea mays
  misc_feature: Ceres CLONE 1565856
MERMLDRLMQQMSFMHHVGLISTEERSTRCRPPGPIGDYPLILSHRPEQQPPARLPSFCQGLNNRELPALPVYPGRTPMVGI

SEQ ID NO: 80543 - DNA, 750 bp, Zea mays
  misc_feature: Ceres CLONE 1565859
  misc_feature: Encodes the peptide sequence at SEQ ID NO. 80544
  misc_feature (468)..(468): n is a, c, t, g, unknown, or other
agctccccgcggtggcggccgctctagaatagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttncccgagctgctctcccgcaacggcgtcaagttcggcgaggccgtctggttcaaggccggctcccagatcttcagcgagggcggggctggactaccttggcaaccccagcctgatccacgcgcagagcatcctcgccatctgggccctgccaggtcgtgctcatgggccgccgtcaagggctaccgtattgcgcggcgggccgctctggcgagttcgtcaaccccctgtacccctggcggagctttcgacccccctcggcctgggcgacgaccccaaagccct

SEQ ID NO: 80544 - protein, 200 aa, Zea mays
  misc_feature: Ceres CLONE 1565859
  misc_feature (56)..(195): Pfam Name: Chloroa_b-bind Pfam Description: Chlorophyll A-B binding protein
  misc_feature (106)..(106): Xaa is any aa, unknown, or other
MAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVXPELLSRNGVKFGEAVWFKAGSQIFSEGGAGLPWQPQPDPRAEHPRHLGPARSCSWAAVKGYRIARRAALASSSTPCTPGGAFDPPRPGRRPQSP

SEQ ID NO: 80545 - DNA, 1314 bp, Zea mays
  misc_feature: Ceres CLONE 1565860
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (62)..(62): n is a, c, t, g, unknown, or other
  misc_feature (68)..(68): n is a, c, t, g, unknown, or other
  misc_feature (740)..(740): n is a, c, t, g, unknown, or other
  misc_feature (1314)..(1314): n is a, c, t, g, unknown, or other
gtttttggcgaatttaacatatatactaaatatattgttatatacnaacaaaannacaccanttattntaaaagctggagctccccgcggtggcggccgctctagaatagtggatcccccgggctgcaggaattcgtctcacccctagaaaaaagtgccgcgcagtgcgcacagggttttaggaagggggcgacaccggtatcggcattcgtcagccatggaatccgcaacggcggccgtccgcagcgcgtcgttagcccgggcccggcccgcgccgctcgtccacgggcgcgcgcgcggggcgggtcgcgtattgggcgctgggctcgccgcgcgcgcccggcggagggcgctcgtcgccgtagcctcccaccaggagcaccacgagccgctcccgacgcgcgcgcaagagggcggcgccgaggctgtggcgacccacgctgacgaggcggaggtccatgctaatgacgctccccccactgctgctgaaaccctcaactccccaactggcctgctggcaaaaacagtggcgggtttccaatttgtgcctgaaaaaggccgttgcaacgtttcagggcccgaagcgttcgggcctttgttcgggcgaaaaaaacaccttgggcctccgggtccctcttggggaaattttggtcggagaaacccgcgtttttcccccttttgaaaagaggggggggggggaaaaaaaacctcacaaaaaacctgtggaaactccttcttgngaggggaaaaaagaagatatcttgtgcgcaactgggcgcgcacaaaaaaaaaaaggcggtcaccccaatatgtgggaagaggtttttctaaaaacagggtgcctgctctttgtgggggctatctcacaacgaggagaaattttgctccctccacccgtgggggcaaaagaggttttgttcgcatatatctttgcgccccccgggagaggtgggaggagccccccaaaaataacaaaaaaaacatctctttttcttcctaacaacacaggggttgagaagaaccaccctcccccgctacaaaaaccacccagtttggggagtgtgggttgtgctttccacaacaaatatgtggcgggatatatattgtgtcacacaactaatctcctgcaaaaagatattctcttaagaaataaagtggggtgggagaaggcggcgcgcctcgtgcccgcggaaatataaaacaaacaacctgtgtgttggttccacacttttaaaggcctggaaagacccgggaaggagaataatatttttttaaaaaactagaagagcgccccgcgcggaataaaattttcgn

SEQ ID NO: 80546 - DNA, 964 bp, Zea mays
  misc_feature: Ceres CLONE 1565864
  misc_feature: Encodes the peptide sequence at SEQ ID NO. 80547
aatccgatggcaatgaggcaatcaaagctgagagcagtgtcggcaaggccgtggttgttactcctttgcctcgcgctagcagccaccgccggcgtaatgcaagctcgcgcccagcctaacagcatcggtttcatcagcatcgactgtggtttcccggggacgacgagctacgtggacgacgccacgacgctgccgtacgccccggacgctgcgttcaccgacgccggcgagaaccacaacgtctcgtctgagcacgtcacgccggagctcccgaggatctaccgcgacgtgcgcagcttcgtggacggcgcgcgtaactgctacacgctcccgtcgaccctcgcggtggggctcaacaagtacctcttccgcgccgccttcatgtacggcaactacgacggcctcaaccggccgcccgtcttcgatctctacataggcgtcaacctctggaagacggtgaacctgtcgtcgtcggacccggccgccccagtcatcgcggaggccatcgttgtcgtaccggacgacttcgtccaggtttgcctggtgaacaccggcaccgggacgccgttcatctccgggctggagctgaggcctctcaagaactccatctacccgcaagtgaatgcgacacaggggctggtcctgcaaagcaggcgcaacttcggcccgactgatatgacagacattatcaggtgagcacctgatctcttctcccgaagatttatatctacgctagaggagttattaagcagtttaattcttgccagtatgctgttgagggctagtcggctagagatgcagatgagtcagcctacgagccatgtgtataggttcagaggatctatctggccaatgtttatttggcattataaatctatctagattatataatataatttagttcagaactaagtgctaattcaaataaagttagattatataatgagaaaaaaaaaaaaaaaaa

SEQ ID NO: 80547 - protein, 229 aa, Zea mays
  misc_feature: Ceres CLONE 1565864
  misc_feature: SWISSPROT Homolog: EC 2.7.11.1 Non-specific serine/threonine protein kinase
MAMRQSKLRAVSARPWLLLLCLALAATAGVMQARAQPNSIGFISIDCGFPGTTSYVDDATTLPYAPDAAFTDAGENHNVSSEHVTPELPRIYRDVRSFVDGARNCYTLPSTLAVGLNKYLFRAAFMYGNYDGLNRPPVFDLYIGVNLWKTVNLSSSDPAAPVIAEAIVVVPDDFVQVCLVNTGTGTPFISGLELRPLKNSIYPQVNATQGLVLQSRRNFGPTDMTDIIR

SEQ ID NO: 80548 - DNA, 866 bp, Zea mays
  misc_feature: Ceres CLONE 1565865
  misc_feature: Encodes the peptide sequence at SEQ ID NO. 80549
ctcaccgcggtggcggccgctctagaactagtggatcccccgggctgcaggaattcgtctcacccctagaaaaaacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggacaggccggcgcgctcggcgccgccggcctcgtcgccatcctcagcgtcttgcttaccatggacggggtcgcctccttcaacgaaggggacccgttccagggggcccttcggtacgcttaccgggaaggaagaaaggaggccgaaaaagcttgcgaaccttccaacggcttgggccaagttccacccgggggaatcctttctttcgggcggtaattttcgggggtggctcttggggcccaactatatctccctttagcgttggtctcga

SEQ ID NO: 80549 - protein, 187 aa, Zea mays
  misc_feature: Ceres CLONE 1565865
  misc_feature (44)..(156): Pfam Name: PsaL Pfam Description: Photosystem I reaction centre subunit XI
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVLLTMDGVASFNEGDPFQGALRYAYREGRKEAEKACEPSNGLGQVPPGGILSFGR

SEQ ID NO: 80550 - DNA, 856 bp, Zea mays
  misc_feature: Ceres CLONE 1565867
  misc_feature: Encodes the peptide sequence at SEQ ID NO. 80551
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
ctccccgcggtggcggccgctctagaactagtggatcccccgggctgcaggaattcgtctcacccctagaaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggcgctccatccagatgaacgacccgagatacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 80551 - protein, 144 aa, Zea mays
  misc_feature: Ceres CLONE 1565867
  misc_feature (65)..(135): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKALHPDERPEIR

SEQ ID NO: 80552 - DNA, 904 bp, Zea mays
  misc_feature: Ceres CLONE 1565872
  misc_feature: Translation starting site: 280
  misc_feature: SWISSPROT Homolog: EC 4.1.1.35 UDP-glucuronate decarboxylase
  misc_feature: SWISSPROT Homolog: EC 5.1.3.2 UDP-glucose 4-epimerase
  misc_feature (613)..(613): n is a, c, t, g, unknown, or other
  misc_feature (614)..(614): n is a, c, t, g, unknown, or other
ccccgcggtggcggccgctctagaactagtggatcccccgggctgcaggaattcgtctcacccctagaaaaagtcgccccagtctagtccgattcaaacccgcccgttccccgtgtccgagccacgcaagccgagctcaatccccagaggccagagccagctgctcggtgagcgccgcgcccttcgcccccctcaggccctcacgcttcgttgcttgatcgtctgatttctctgacgggtggtttggtttggatctgggcggaccaggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcacccggtcaaaagataactgaagaaagtgatcggacacccaagatttgagctcatccgccatgatgtcactgagccacttcttgtggaggttgaacagatctatcaccttgcttgccctgcttcacnnatctctacaagcacaatcctgttaagaccatcagaacaatgttattgggacctttgaacctgcttgggacttgcaaaaaaaagttgaagcccggaatttgttgaacaccacatctggaaagttatgggggatccacctggagaatcctaaaaaccggggcctattggggggaaggttacccccattgggagccggggtgtttattaagaggggggaaaagtttgtaaaaaaaaaccctcttttttccccttttacggggggcggtggggttttaaaaccccaaaaatccg

SEQ ID NO: 80553 - DNA, 811 bp, Zea mays
  misc_feature: Ceres CLONE 1565873
  misc_feature: Encodes the peptide sequence at SEQ ID NO. 80554
  misc_feature (498)..(498): n is a, c, t, g, unknown, or other
  misc_feature (548)..(548): n is a, c, t, g, unknown, or other
  misc_feature (613)..(613): n is a, c, t, g, unknown, or other
ctccccgcggtggcggccgctctagaactagtggatcccccgggctgcaggaattcgtctcacccctagaaaaagtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttancagctcctcggaggccttgccgtccgcagggcttgctatggtgttcttcngtatgttatggaagagtggtgccaaggggtgtgaggtgattgttgagtgaaaagctcagggcccnaagagccaggtccatgaaagttcagggatggctacatgatctcatctggtcagccccgtgaacgaagtcacttgactccgcttggaaaaaccgttcttctccgaaagggggtgtcccgggtatccaggggaaaaatcatgccttgactgggaacccaaaaaggcaagggttgggcccaatatctcctcttttgggaaa

SEQ ID NO: 80554 - protein, 134 aa, Zea mays
  misc_feature: Ceres CLONE 1565873
  misc_feature (45)..(102): Pfam Name: KH_2 Pfam Description: KH domain
  misc_feature (107)..(107): Xaa is any aa, unknown, or other
  misc_feature (124)..(124): Xaa is any aa, unknown, or other
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRXQLLGGLAVRRACYGVLXYVMEEWCQGV

SEQ ID NO: 80555 - DNA, 808 bp, Zea mays
  misc_feature: Ceres CLONE 1565877
  misc_feature: Encodes the peptide sequence at SEQ ID NO. 80556
  misc_feature (502)..(502): n is a, c, t, g, unknown, or other
  misc_feature (516)..(516): n is a, c, t, g, unknown, or other
  misc_feature (517)..(517): n is a, c, t, g, unknown, or other
  misc_feature (566)..(566): n is a, c, t, g, unknown, or other
  misc_feature (609)..(609): n is a, c, t, g, unknown, or other
  misc_feature (701)..(701): n is a, c, t, g, unknown, or other
ctggagctccccgcggtggcggccgctctagaactagtggatcccccgggctgcaggaattcgtctcacccctagaaaaattcggtccacgcacccacccagccccaccagcggcagctccgcggcgccggcgtccagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgacctcgtctgcgccggcagcgtcaacccggagcacttcgacttccgccgctacgacacgctcgactcgtacgtcgacgacctcctcgccatcctcgacgcgctccgcatcgcgcgctgcgccttcgtcgggcactccgtctccgccatgatcggnatcctcgccctcanntcgcgccccgagctcttcgccaagctcgtcctcatcggcgcgtcgcccnagttccctgacgacacgactaccacgggcgggtcgagctgccngagatccagcaggtgttcgacgcgatggcgggcaactactcggcgtgggcgaccggttacgccccccctggcggtgggcccggaacgtgccngcggggggtgcaggagttcagccgcaccctgttcaaaatgcgggcggaaatcttcttccccgggggggccccaccgtgtttcaaaaccgaaccttccggggggttgg

SEQ ID NO: 80556 - protein, 218 aa, Zea mays
  misc_feature: Ceres CLONE 1565877
  misc_feature (121)..(121): Xaa is any aa, unknown, or other
  misc_feature (138)..(138): Xaa is any aa, unknown, or other
  misc_feature (152)..(152): Xaa is any aa, unknown, or other
  misc_feature (183)..(183): Xaa is any aa, unknown, or other
MVGGGAAAGSGGAPSGAKLLQILNVRVVGSGDRVVVLSHGFGTDQSAWSRVLPYLTRDHRVVLYDLVCAGSVNPEHFDFRRYDTLDSYVDDLLAILDALRIARCAFVGHSVSAMIGILALXSRPELFAKLVLIGASPXFPDDTTTTGGSSCXRSSRCSTRWRATTRRGRPVTPPLAVGPERAXGGCRSSAAPCSKCGRKSSSPGGPHRVSKPNLPGGW

SEQ ID NO: 80557 - DNA, 930 bp, Zea mays
  misc_feature: Ceres CLONE 1565878
  misc_feature: Encodes the peptide sequence at SEQ ID NO. 80558
  misc_feature (403)..(403): n is a, c, t, g, unknown, or other
ctccccgcggtggcggccgctctagaactagtggatcccccgggctgcaggaattcgtctcacccctagaaaaaacaaaccacaacttacgccgccgctcgctccaccgcgcaagagtctgctgctgccgctcacccacccccgctcgcgcagaaggccgccgcagctctcactactggtgccctaaacgccgatatccctcttcgcctccctttccccacccaaaaccccggccttcagggttccggcaccatgccgcagggagatcacatcgagctgcaccagaagcgccatggcaagcgcctggaccacgaagagcgcaagcgcaagcgcgaggcccgcgaggtgcacaggcgctcgaaggatgcccgcaatttgattggtgctaagggcaacaccctcnccaagaaacgctatgctgagaaggcacagatgaagaagaccctgacaatgcacgacgaatcaaataaacgacagaaggttgatgatgatgtccaagaaggtgctcttccctcgtatctgctggatcgtgatcagacacggcgcgctaaagttctcagcgacccaattaagcaaaagagggaggaaaaagctggccaaatgggatgttccccttgcaaaggtcaggccctgtagctgaagaaaaaaattttaaagggttctacaaactgggcaagccaaaaaccaacctgtggaaaaaaaatggttaccaaaacccccccttttttggggccggggtttttccgggaaaccccccaaagttttaacgggttctttttgggccaatgggggcttgcttttccccaaaaacccctgggtgcctccccccgaagctggaagtggcccttttcaaacccgtagaaaaaattttctggggaagaaaaaccaccacaaggggcgacaatagaaccaaccttttctctggtgggg

SEQ ID NO: 80558 - protein, 127 aa, Zea mays
  misc_feature: Ceres CLONE 1565878
  misc_feature (1)..(127): Pfam Name: Ribosomal_S8e Pfam Description: Ribosomal protein S8e
  misc_feature (51)..(51): Xaa is any aa, unknown, or other
MPQGDHIELHQKRHGKRLDHEERKRKREAREVHRRSKDARNLIGAKGNTLXKKRYAEKAQMKKTLTMHDESNKRQKVDDDVQEGALPSYLLDRDQTRRAKVLSDPIKQKREEKAGQMGCSPCKGQAL

SEQ ID NO: 80559 - DNA, 870 bp, Zea mays
  misc_feature: Ceres CLONE 1565880
  misc_feature: Encodes the peptide sequence at SEQ ID NO. 80560
  misc_feature (356)..(356): n is a, c, t, g, unknown, or other
ctccccgcggtggcggccgctctagaactagtggatcccccgggctgcaggaattcgtctcacccctagaaaaagactcagcgtcatatttctgagttctcgcttctcacttgtgcccagatgccggccctttccttttcgggatctcctcggtgacctagatcggatggacccgccgccggcgacgcgcgcggcgtccaggcggcgggaccgccgacggcgcctgcggcagcggcagcgcgcagctgcagccacgaaaacgaaggtcggtgcggccgtgctggccgtggagccgcagagcgcagcagtcacaaccccggtgggcttcgatcggtcctgctgccacgccggcgtcnaggggcaggaaacggcggaggcctcgtagacggcgtggccggaacgcgggcgccggctggggtgtcggacgaaccaccgggctgcgtcccccgttccccgttccagatgccccgcaagcaagtttgcattttggaaagcatggcatcacgtcttgaagcgaaatgtggctgcaaactatgaccgagaaagataatgagggtcagataaaacaagccaagagaatttttccgcacggaaatgaggcgctaaaagaatcttgttgcctgaaggtgcttccctgctctttctctttggccggtcgtgaaactttctaccccaagaaaaatggagccctcccgggagtagaattcctttagaagatccaatggtgaaatccccccctttgaaagttgcccctgaaacaagggaactgggatttgggtttttccccccaagaatgaagagggcccattttcttggggaaccctcgaaaaaatgtccccccggaaaaaaaaaactttttctttggttttt

SEQ ID NO: 80560 - protein, 72 aa, Zea mays
  misc_feature: Ceres CLONE 1565880
  misc_feature (64)..(64): Xaa is any aa, unknown, or other
MDPPPATRAASRRRDRRRRLRQRQRAAAATKTKVGAAVLAVEPQSAAVTTPVGFDRSCCHAGVXGQETAEAS

SEQ ID NO: 80561 - DNA, 864 bp, Zea mays
  misc_feature: Ceres CLONE 1565886
  misc_feature: Translation starting site: 170
  misc_feature: SWISSPROT Homolog: EC 1.2.1.12 Glyceraldehyde-3-phosphate dehydrogenase (phosphorylating)
  misc_feature (504)..(504): n is a, c, t, g, unknown, or other
ggagctccccgcggtggcggccgctctagaactagtggatcccccgggctgcaggaattcgtctcacccctagaaaaaaccgtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtcccaccggtgtcttcactgacaaggacaaggctgctngcacatctgaaggtggtgccaagaaagttgttatctctgcccccagcaaagatgcgcccatgttttgttgttggtgtcaatgaggacaagtacacctccgatgttaacaatgtttccaatgctagctgcaccacaaactgccttgctcccccttgctaagggtctttcatgacaacttttggcattattgagggctttgatgaacactgttcatgccatcactgccacccagaaggactggtgatgggaccttcagccaaggactggagaaggtggcagggctgccaactttaacatcattcccagcagcacccgtgctgcccaaggctttccggtaaggtctttctggaatggatggca

SEQ ID NO: 80562 - DNA, 850 bp, Zea mays
  misc_feature: Ceres CLONE 1565889
  misc_feature: Encodes the peptide sequence at SEQ ID NO. 80563
  misc_feature (519)..(519): n is a, c, t, g, unknown, or other
  misc_feature (532)..(532): n is a, c, t, g, unknown, or other
ctccccgcggtggcggccgctctagaactagtggatcccccgggctgcaggaattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaagaccccgccgtgagcatcgccatcgtggagcagtcggtgtcncccggcggcggcncgtggctgggcgggcagctgttctcggccatggtggtgcgcaagcggcgcacctgttcctggagagctgggcgtggcgtacgaccagccaaggacacctgggcatcaagcacgccgggctctcacgtccacggtaatgaacctgctcctggggggccccacgtaaagctgttaaacccccgggcgcggggagaacctcttcctcggggaggggccctttggggggtttttcccaacatgggggctttgggttcatgaacacaaaaaccaatttctggtgggacccccacctctttgggggcccagagcttgggtaaac

SEQ ID NO: 80563 - protein, 113 aa, Zea mays
  misc_feature: Ceres CLONE 1565889
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKTPP

SEQ ID NO: 80564 - DNA, 932 bp, Zea mays
  misc_feature: Ceres CLONE 1565890
  misc_feature: Encodes the peptide sequence at SEQ ID NO. 80565
ggcggccgctctagaactagtggatcccccgggctgcaggaattcgtctcacccctagaaaaaaggttaaagagacgccgccgccgcaagccgtccgccttgcccctcgaaggcttggtcctccttgtatcccgacctcctccgccacagacccgtttccccgctagagttatcgttcctctgcagcgatggcgatcaagcggaccaaggcggagaagaagatcgcgtacgacaagaagctgtgcagcctgctcgatgagtacaccaaggtgctcatcgccctcgccgacaacgtcggctccaagcagctccaagacatccgccggggcctcaggggcgactcggtggtgctcatgggcaagaacacgctcatcaggcgctgcatcaaggtctacgccgagaagaccgggcaaccacacccttttgacccgctcatggaccctgctcgtcggcaacgttggcctcatctttcaccaagggaagacctcaaggaggtgccgcgaggaggtcccccaagtacaagggtgggggctcctggctccgtgttggggctggttgctccctggttgatggttgtccgtgccccccgggcaacaactggggctgggaaccccttcccaaaaacctcttttctttccagggggggtttaacaatcccccccccaaggatttaaccaaggggtacttgggggaaaaataattccccccttggtggaaggctgaataaaaaaaggggggagaaaaggggggggttctcgtcaaaatttggccccgtgcttgcccaagggtgggggaattccgcccccctttttcttataggggtcttccggggggcacccgcggtttctaaaaaagaaaggggtcttgtttttttcacccccgcggggggtggtgtggacccttttctggggggaggggaccctctattggga

SEQ ID NO: 80565 - protein, 161 aa, Zea mays
  misc_feature: Ceres CLONE 1565890
  misc_feature (6)..(97): Pfam Name: Ribosomal_L10 Pfam Description: Ribosomal protein L10
  misc_feature: SWISSPROT Homolog: EC 4.2.99.18 DNA-(apurinic or apyrimidinic site) lyase
MAIKRTKAEKKIAYDKKLCSLLDEYTKVLIALADNVGSKQLQDIRRGLRGDSVVLMGKNTLIRRCIKVYAEKTGQPHPFDPLMDPARRQRWPHLSPREDLKEVPRGGPPSTRVGAPGSVLGLVAPWLMVVRAPRATTGAGNPFPKTSFLSRGGLTIPPPRI

SEQ ID NO: 80566 - DNA, 926 bp, Zea mays
  misc_feature: Ceres CLONE 1565891
  misc_feature: Encodes the peptide sequence at SEQ ID NO. 80567
  misc_feature (485)..(485): n is a, c, t, g, unknown, or other
  misc_feature (486)..(486): n is a, c, t, g, unknown, or other
  misc_feature (526)..(526): n is a, c, t, g, unknown, or other
  misc_feature (637)..(637): n is a, c, t, g, unknown, or other
ctccccgcggtggcggccgctctagaactagtggatcccccgggctgcaggaattcgtctcacccctagaaaaaaaacccaacccatcatcatctatctagactagagcaagctaagctcaagctcggctagcattccagaagctgcatctatcagctaccggcctctcgattcatcgcttgcgatcgaatggagaagatgaacgtggttgcgagcaggaagcagcccggcgactggagctgccggtcgtgccagtacgtgaacttctgcaagcgcgacgcgtgccagcgctgcggcgagggcaagctgggcgtggagcgcacggactacgcggcgctgggcggcgactgggacgtgaagcccggcgactggtactgctaccgctgcggcgtgaacaactacgcctcccgcgccagctgctttcagtgcgccgccgccaagaacgagtcccacggccgccgtcgcgcaggggctggggggtacanncgtcgccgggccagccggaaatgatgcccgggggactggnatctgcccaagaactgggttggcaacgtggcagacctaccccaacccgaacgaagtgctttccgggggccattttgcccaaatcaaacttacggtttaaagggggccccgncgccccgccccgggcaaatttctttccctgtgtggggccaacccccccccccaaaaggccttttttccccccccccaagaactctttaaaaagaggcccttaaatctctggtaggggtggggggcaacacccccccaggagaaattaaaaccctttttcctttttttttttttgtgccccccctccaaggggggggggggggggaaattttctccccctttttgggggcccctgtggtggttcttttggggggggggggggggtgttggaaaacacacccccacaaaag

SEQ ID NO: 80567 - protein, 106 aa, Zea mays
  misc_feature: Ceres CLONE 1565891
  misc_feature (57)..(86): Pfam Name: zf-RanBP Pfam Description: Zn-finger in Ran binding protein and others
  misc_feature (99)..(99): Xaa is any aa, unknown, or other
MEKMNVVASRKQPGDWSCRSCQYVNFCKRDACQRCGEGKLGVERTDYAALGGDWDVKPGDWYCYRCGVNNYASRASCFQCAAAKNESHGRRRAGAGGYXRRRASRK

SEQ ID NO: 80568 - DNA, 853 bp, Zea mays
  misc_feature: Ceres CLONE 1565892
  misc_feature: Encodes the peptide sequence at SEQ ID NO. 80569
  misc_feature (611)..(611): n is a, c, t, g, unknown, or other
  misc_feature (612)..(612): n is a, c, t, g, unknown, or other
  misc_feature (841)..(841): n is a, c, t, g, unknown, or other
ctccccgcggtggcggccgctctagaactagtggatcccccgggctgcaggaattcgtctcacccctagaaaaagtcccacccacaaacccttcttatcctatcgtcgcgcgcgcctgcctctcccacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaggcacacgctgcagccgcccgccgcagccgccgagtccgcaggggaggccaagtctgtgggtttcctggagaagtacccggccctggtcaccggcttctttcttctcatgtggtacttcctcaacgtcatattcaacatcctcaacaagaagatctacaactacttcccanntaccatacttgtgtccttgatccatctagtagtggggtgtcgtatactgcctcatcagctggagtgtcggtctcccccagcgagcgcctatcaatggcacgctcctcaagcttttctcttcagtcgccctggggcaatggtatgggtcacatcactagcaatgtgtccttccgctgctgttgcagtctcatttgctcaaactatcaaagctcttggagccctttcttanggcaacgggtac

SEQ ID NO: 80569 - protein, 215 aa, Zea mays
  misc_feature: Ceres CLONE 1565892
  misc_feature (135)..(135): Xaa is any aa, unknown, or other
  misc_feature (211)..(211): Xaa is any aa, unknown, or other
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGFLEKYPALVTGFFLLMWYFLNVIFNILNKKIYNYFPXTILVSLIHLVVGCRILPHQLECRSPPASAYQWHAPQAFLFSRPGAMVWVTSLAMCPSAAVAVSFAQTIKALGALSXGNGY

SEQ ID NO: 80570 - DNA, 1303 bp, Zea mays
  misc_feature: Ceres CLONE 1565895
  misc_feature: Encodes the peptide sequence at SEQ ID NO. 80571
  misc_feature (70)..(70): n is a, c, t, g, unknown, or other
  misc_feature (71)..(71): n is a, c, t, g, unknown, or other
  misc_feature (473)..(473): n is a, c, t, g, unknown, or other
  misc_feature (817)..(817): n is a, c, t, g, unknown, or other
  misc_feature (896)..(896): n is a, c, t, g, unknown, or other
  misc_feature (1303)..(1303): n is a, c, t, g, unknown, or other
gaatcaagttgagattgtatcaacccgcagcacccacaatcatacccccacccatcacttctaaccaccnncaaaaaggggctcacgtcggtggcggccgctttagaatagtggatcccccgggctgcttgaattcgtctcacccctagaaaaaatcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgtgtcaccatgtccgcggagtggatgcccggggagccccgccccgcccacctcaacggctcctcgtcaggtgacttccgcttcgaccccttgggtctggtcacggtgccggagaaccanccttggtgtcaaggagtcagaggtggaacactagccgggggggcccatgcttggccccagcccggggggtgcctggtcgcccgtaaggcgcttggggtctgtggacaacttggggtgaaaatgctgcctggtaggtgggggcgggccatctccccccggttgggttaagggcccacctataccctttttggaggcaccccgcgctgtggccgaggggggggaaaacgacctatcgccgaaatccacatctccgttgggccgggtatcaaaagatatttctatcgtgggacctagatttgggagccttatgcgagcttacgagagatgagtccgtctgcgtcggntacctcttctattttgtgctacgctacaatggtgtaatcccccctcgcgcctgctattgagatctagagaaaagaattnacgcccgctctcgcgggggctggtggtaagctgcacgacttgctgtagaaatttaaaacgtccttggtcgagatgttcttctccacgatagcgcgataacccctcagtgagttacataaggcctcctcggagggtgggggtctttcaccatccatatcatccaagcgaagataaatcacagactacggtatgcgagggtgttttctttctctctcaccgcttcttgtaatgtgcccctacagatcaataacgaggtatttcatgtcatgtaacttaggacgatgccggatagtgagtaatatttctcgggacgaaaaagtggtatctcgcccctgatacacaaagagtattctaagcacgcgctcgttccacatacgcggaataataaatgtagagtgcaatacaan

SEQ ID NO: 80571 - protein, 140 aa, Zea mays
  misc_feature: Ceres CLONE 1565895
  misc_feature (85)..(85): Xaa is any aa, unknown, or other
MAMASSSSGLRSCSALGVPSLLAPSTSSSSRSGRLPFCAHATTSGRVTMSAEWMPGEPRPAHLNGSSSGDFRFDPLGLVTVPENXPWCQGVRGGTLAGGAHAWPQPGGCLVARKALGVCGQLGVKMLPGRWGRAISPRLG

SEQ ID NO: 80572 - DNA, 906 bp, Zea mays
  misc_feature: Ceres CLONE 1565896
  misc_feature: Translation starting site: 130
  misc_feature (437)..(437): n is a, c, t, g, unknown, or other
  misc_feature (530)..(530): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (592)..(592): n is a, c, t, g, unknown, or other
  misc_feature (607)..(607): n is a, c, t, g, unknown, or other
  misc_feature (614)..(614): n is a, c, t, g, unknown, or other
  misc_feature (620)..(620): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
  misc_feature (685)..(685): n is a, c, t, g, unknown, or other
  misc_feature (879)..(879): n is a, c, t, g, unknown, or other
ctccccgcggtggcggccgctctagaactagtggatcccccgggctgcaggaattcgtctcacccctagaaaaaatcctctcgctcgctcaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgaatatggtcttgaagttggtctgaccaactatgcagctgcctactgcactnggacttctgttgggctcgccgtgtgctaaaagatccgtggtttgggataaggagtatgaggggcaatgttgaggcccactggtgagggacttnctctgttgagcccagctgatgagaggagggccattccgtgctnnnctctgggatgttggccnttatcaggactacancaggggnaaccgnttgtcttttggtgcccttcaggggaggctttgggatggggggccctggatattcctcacanncnnagaagaggttttgctggatttcaggaaggaatgacaaagccagtgggatgcctgaataccccaccgcagggtaacatctattgggtgggccatggttgctgactaacctgaaagacccttgccttgagagggagccccgaaagtacccggaagccccctttcgtgcggtacattttaaaaaaggggagtttaangctcgaaggaaaattgaagctctttga

SEQ ID NO: 80573 - DNA, 1169 bp, Zea mays
  misc_feature: Ceres CLONE 1565899
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
ggttttggagggggggcgcgcgtagccgattttttgttttttcgttttgttttatcctattattttcncnncacaaactggagctccccgcggtggcggccgctctagaactagtggatcccccgggctgcaggaattcgtctcacccctagaaaaaacgtcgatgtatgctctacctatcgttgtgaaggagagttcaccagagtgtgagattgttcacccaccaatgagtaacttgagctgggggtagacactcgtgagaccggttagttttaccctactgatgaccgcaccgcgattgtcattctacctagtacgagaagaaccgttgattcacacaagtggtcgtcgctcttggttgaaaagccagtggcgcgaatctaccgtgtgccagattatgactgaacgcctctaagtaagaattcgagctagctaccggcgcctctgatcggcgcccgccccgacccatggttaggcctacccgccccaaggggcccggggcctttggggtcacaccccccctggccaaaaagcgcccccggaggggggaggattcaaaaagctttccttttcctcaaacgggggcggggggggactttagatttccttttggtcgcaacgaaactttaaataacctccccacggggagggcctttttgtaaacctttggcccccgaaaaagggccccttttttgccctgcccacaactaattattccactttggaaggagattgtggaggcccttctcagaagatttgagggggggccttattctccttgggagggggtgggagccttgtgttaacaaaacccagggggcggggccccccaatattgtgagaaatggatttctctccattcggggcgccccggtttgtgggcctcaaaagaaaaaaaatattccttctccagtggcccctgaaagaaacccctcccaagagagacgaacacaccggccgtttcttttgtttctccctaaaaggggggaacccagcgaaaatagacctcccctttcccggcggcccctttctctttagggaaaaaaagagattcccttcgggggaggcgcccaagggacaataatgttttcgaccccccttttttttgggtttttggtttgggaaaacccgtgggattccctctgccttcttttacaaaggagaaaaag

SEQ ID NO: 80574 - DNA, 792 bp, Zea mays
  misc_feature: Ceres CLONE 1565902
  misc_feature: SWISSPROT Homolog: EC 4.1.1.39 Ribulose-bisphosphate carboxylase
  misc_feature (705)..(705): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
tccccgcggtggcggccgctctagaactagtggatcccccgggctgcaggaattcgtctcacccctagaaaaaaggacgacccaagcaagcaagctcgatctactactactactagctggtacacatactagccagcctgccagccagcttgccatggcgcccaccgtgatgataggcctcgtctgcaacagccgtcgccccgttacagggtcttaagtccgccgccagcctccccgtcgcccgacgcagcaccaggagcctcggcaacgtcagcaacagcggaaggatccggtgcatgcatgtgtggccggcctacggcaacaagaaagttcgagacgtctgtcgtacctggccgccgctgtcgacgggacgacctgcttgaagcaggtgggactaccctgcttgcggcaaacggctggatacccctgacctccgaagttcagcaaagcttcggggtttcttgtaacccggaagaaactccacccttcccccgggggctattaaccaaagggcccgttaatgggaccaatttgggaaaactgccccattggttcggggttgccccccaacggcccccccccaggggtgaccaaaagggaacttcccaggaagggccctttcccccccccttaatccccgggagaaagccttttttttccccccggggggtaaaatacggggtttttttaaaaaaaaaaaaattntnnnnngggggggggaagaaaaaaacaaaaagggggggggggggggaaaatttttttttttttctccccccacaaaaaaaaaaaacc

SEQ ID NO: 80575 - DNA, 719 bp, Zea mays
  misc_feature: Ceres CLONE 1565905
  misc_feature: Encodes the peptide sequence at SEQ ID NO. 80576
  misc_feature (308)..(308): n is a, c, t, g, unknown, or other
  misc_feature (666)..(666): n is a, c, t, g, unknown, or other
ctccccgcggtggcggccgctctagaactagtggatcccccgggctgcaggaattcgtctcacccctagaaaaaaggacgacccaagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaactggcggaaaaggatccccggtgcattgcanggtgtgggcggcctacggcaacagagttcagacgctgtcgtactgccgccgctgtcaagggacaactggctgagcaggtggatacctgctgggcacgggttgaaacctgccctaaatccacaagcccgggtccggtacccggaaaatcacctccccgggtaaaaaaaaggggccctattggaaaatgggaaacgtccccatgtttgggtggccccaaacccccccccggggttacaaaaaactttcgggaagggcctttttcccgcgtaacccgggagaacctttttcccccggggggtttagggggttttttaaaaaaaaaaattggggggggaaaaaaaaaccggggggggggggnaattttttttattttccccccacaaaaaaaaaaaaaccccccccccccgcggg

SEQ ID NO: 80576 - protein, 104 aa, Zea mays
  misc_feature: Ceres CLONE 1565905
  misc_feature: SWISSPROT Homolog: EC 4.1.1.39 Ribulose-bisphosphate carboxylase
  misc_feature (51)..(51): Xaa is any aa, unknown, or other
MAPTVMMASSATAVAPFQGLKSAASLPVARRSTRSLGNVSNWRKRIPGALXGVGGLRQQSSDAVVLPPLSRDNWLSRWIPAGHGLKPALNPQARVRYPENHLPG

SEQ ID NO: 80577 - DNA, 813 bp, Zea mays
  misc_feature: Ceres CLONE 1565906
  misc_feature: Encodes the peptide sequence at SEQ ID NO. 80578
  misc_feature (386)..(386): n is a, c, t, g, unknown, or other
ctccccgcggtggcggccgctctagaactagtggatcccccgggctgcaggaattcgtctcacccctagaaaaaatcacataacttcggcttctatcccttcgtaaacccttctctcttcttcccgcggcctgctcgttctatctgtccagcagacttgaggttccgagcggccggaaaccagcggcaaccgtcggcatggcgctcgtattgcattctggggctggaaacaaaaatgccttcaaggcacttattgctgcagaatacagtggggtcaaggttgagttgaccaaggattttgagatgggtgtctcgaaacagacccctgagttttctaagatgaacccccttggggagggtccctgtctggagactcctgatggcccntgttttgagagtaatgctattgcgcgctatgttgctcgcctgaaagaatgacaccctctttttcgggtcttcccgtattgaacaaccccacgttgaacattggattgaactttgctgcaaccgaaattgatccctggggttggaagggacttggatcccagggttggggaacctcccctttgccccccccactggggaaaaaccctttttgttcctttaaaaaattccttggggggtttgaaaacaccattttggccttagaacaatcccttgtgggaaattttgtgtctcccccccgaaactttttttggaccgcccccctcccccggggaaatttccgggatttttgaacaaaaatttcccctttggaattcccccccgggggaggggggatttttttggaaaccgggttaaaaccccacaaaaa

SEQ ID NO: 80578 - protein, 79 aa, Zea mays
  misc_feature: Ceres CLONE 1565906
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGAGNKNAFKALIAAEYSGVKVELTKDFEMGVSKQTPEFSKMNPLGEGPCLETPDGPCFESNAIARYVARLKE

SEQ ID NO: 80579 - DNA, 1176 bp, Zea mays
  misc_feature: Ceres CLONE 1565908
  misc_feature: Encodes the peptide sequence at SEQ ID NO. 80580
  misc_feature (70)..(70): n is a, c, t, g, unknown, or other
  misc_feature (782)..(782): n is a, c, t, g, unknown, or other
ttcttttttttatctgtacacatacacatgcaaattgagtattggcacatgagcctgcgacccaaaaaancaaccttgagctccccgcggtggcggccgctctagaacagtggatcccccgggctgcaggaattcgtctcacccctagaaaaaatctcgtcctcgctcacctacttctccgtccgcatgcgtcaatcagggtgcacccggtaggccgggaggaagcacatcggagaaggtgatctgatggaatggctcgattgtacatcggccacctggatccccgggtgaccgctcgggagctggaggacgagttccgcacgttcggggatcaactcaaaggctggggtggtcgtaaaccacctggctgtgcctatattgattttgatgatcagagggacgcagaggatgcaatccgtgagctacatggctagaatggatggagagttgagttatctcgtaatgacggcggtggtcccccacctctttgaccagcatgcgtgggtctgagtgccaaccgtttccactgggcgtgagactggccaacatttgcttcgtaagtgccgtattggaggaattggttcctgtgaggttccttgggaaacagaaagggcgccccaatgcccaggatcctgtggggctccacctcccccattgtcctggggtactctttccgggaaatcccccgttttttacgggatcagaaatgggaagccttagaaagaaacctctggttgggcccaacccctatacgtctctaaaaggggccgactgcagaaaantcgaaattcttcttcaacaaacagccttttggggtggggggaaaagccctccctgtatatatatcttaaaggggtctcatacaggcccgttgtaagaaataaagcgggtgcgccacccctttgcgaaaccaaaacctttccccgcggaatggccttaatagtgggtataccccggcccccccacattccaggtgagccttcctagaggccagggattccgttttggaaatccccaaaccaccacaatggtttttaattctttccctccaactatatggcgccacaaacctaagtggttaaaaaaaccctggggtcgaacggaaaccccttgagaccagagtttcttccaatattggggtaaaagggttcccctaagctctttgaataaaactcg

SEQ ID NO: 80580 - protein, 60 aa, Zea mays
  misc_feature: Ceres CLONE 1565908
MARLYIGHLDPRVTARELEDEFRTFGDQLKGWGGRKPPGCAYIDFDDQRDAEDAIRELHG

SEQ ID NO: 80581 - DNA, 839 bp, Zea mays
  misc_feature: Ceres CLONE 1565909
  misc_feature: Encodes the peptide sequence at SEQ ID NO. 80582
  misc_feature (468)..(468): n is a, c, t, g, unknown, or other
  misc_feature (477)..(477): n is a, c, t, g, unknown, or other
  misc_feature (809)..(809): n is a, c, t, g, unknown, or other
  misc_feature (837)..(837): n is a, c, t, g, unknown, or other
  misc_feature (838)..(838): n is a, c, t, g, unknown, or other
ggagctccccgcggtggcggccgctctagaactagtggatcccccgggctgcaggaattcgtctcacccctagaaaaagtcggagaccccaaacctctgtcgaaagtttcacctccggtcgctggtttcctccaatctccgtggtagttcagcgcgagcgggcggcggggtttgagctcgatggtcacttccggcgaacaatcggctggcggcgggtctgcggcgagggcgtcgaagctgcggtacccgctgcggtcggcgagcaaggggaaggcggcggtcgtttccccggcggctgatgctcctcccaccatctctgctccgcgacgggcaaaaccatcttcagatgtcagcaagagcatgtgtttagacctttctgtgaaggataattctgccaaacccccacggaggcactcaatactaaccaagccaggaagctagcccaaggccaacacctttctggaactngtgactccnggtgtcctgggggttcggtcaaagaggtcggaaagccacggggagggtttatatccccaaacatcagaagtgtccatgtccatctcaaagcgcgaggttcagacccctttcttttttttttcctacttggggaagacacaaatcagctggcagaggagggtttcttaaaaaaccgggttttcctggggtcttttaagctggttcttggacaaaaaaggagggccctcccttggaccggataaggggaagacttccagtccttcctttaccacggatggccctggcgaccaaaattggaggacccccctttaggagatttctccggcggttanatggaaaattttggaagaattttgaganna

SEQ ID NO: 80582 - protein, 86 aa, Zea mays
  misc_feature: Ceres CLONE 1565909
MVTSGEQSAGGGSAARASKLRYPLRSASKGKAAVVSPAADAPPTISAPRRAKPSSDVSKSMCLDLSVKDNSAKPPRRHSILTKPGS

SEQ ID NO: 80583 - DNA, 900 bp, Zea mays
  misc_feature: Ceres CLONE 1565911
  misc_feature: Encodes the peptide sequence at SEQ ID NO. 80584
  misc_feature (578)..(578): n is a, c, t, g, unknown, or other
  misc_feature (581)..(581): n is a, c, t, g, unknown, or other
ctccccgcggtggcggccgctctagaactagtggatcccccgggctgcaggaattcgtctcacccctagaaaaagcacaatccatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaaagtcgtcgatgactgcgaggccgcccctcacgagcagatcaacgtggagtacaacgcctcgtatgcataccacttccttctcggctacttcgaccgcgacacgtggctcttcaaagatttgccaaggttcttcaagaatcccacgacnaangaaagggagccaccctgaaaagctcatgggatcccaaaaacaacggggagggcggggggaggtcccaaatcaattggaaccccctttacccgagtttgaccccccctgaaaaaggaaaagccctttaaccctatgggaaaggggctctggcccccggaaaaacgtggtcaaagaaaaacgcgccaacccctccgggggggggggcaaagggggggaaattttccttccgggaaaaaattttttgggaggggggtttctccccgggggggagggggggggaggacaaaaaaaaaaatttcccggggtggccccccccaga

SEQ ID NO: 80584 - protein, 139 aa, Zea mays
  misc_feature: Ceres CLONE 1565911
  misc_feature: SWISSPROT Homolog: EC 1.16.3.1 Ferroxidase
  misc_feature (134)..(134): Xaa is any aa, unknown, or other
MLRVSPSPAAAVPTQLSGAPATPAPVVRVAAPRGVASPAAGAACRAAGKGKEVLSGVVFQPFEEIKGELALVPQSPDKSLARHKVVDDCEAAPHEQINVEYNASYAYHFLLGYFDRDTWLFKDLPRFFKNPTTXEREPP

SEQ ID NO: 80585 - DNA, 1174 bp, Zea mays
  misc_feature: Ceres CLONE 1565914
  misc_feature: Encodes the peptide sequence at SEQ ID NO. 80586
ggggggtgggcgcggcgcgaataagaaatatagagatgacattactagaagtatttaacattctacaattaaaaaaacaggaactccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacaacgaacgcgggcgctcctgtgtggaacgacaacaaggcgctgactgtgggggctcgcggtcccatcctgctggaggactaccacctgatcgagaaggtggggcacttcgcgcgcgagcgcatccccggaacgcgtggtgcacgcgcgcaggggctcccccaaaggtgtcttcgaggggacccacgaagtggacgtggcccacccctcccccaacattccggggggcgtccgggggggcggaccccccgagaatgggcgcttttcctaaatgggaatcacagaaagcgggggttccccggggaaacgaatccgccgaccacagggtgggttttcgcccatgataatttctaccacccccccggggggggaaataggggggacaaagcttgggggcaaaaaaaaaaattcccgcgggggttttttttccatgacccgcgaaagaggggccactcataagtttattcccccccaaccctgggaattctcactcgtgcgttgtttgaaggagacccataaacccgcggcccgaggtttatccataccacttagttcaagtggaggacacaactcctggtcccagagggttggatttctcacacaactataccccctggtcgaaggcagacctcctctcgcccccgaaaaagaagcgctggagaactaacaagcaacccaattctattttacccctctatagtaaacagaacataggtggggttatggtgatcccttcatagaacgtaacacattcctaacaaataattaatggggttttcgtctctttctgtaaaaaacccgactctcattttctcctatataaaaaatgaagggcgcgcgggaaagtgtattccaataatttcattcacataggttcacccgtgtgtaagaaaac

SEQ ID NO: 80586 - protein, 169 aa, Zea mays
  misc_feature: Ceres CLONE 1565914
  misc_feature: SWISSPROT Homolog: EC 1.11.1.6 Catalase
MDPTKFRPSSSHDTTVTTTNAGAPVWNDNKALTVGARGPILLEDYHLIEKVGHFARERIPGTRGARAQGLPQRCLRGDPRSGRGPPLPQHSGGRPGGRTPREWALFLNGNHRKRGFPGETNPPTTGWVFAHDNFYHPPGGGNRGDKAWGQKKKFPRGFFFHDPRKRGHS

SEQ ID NO: 80587 - DNA, 1166 bp, Zea mays
  misc_feature: Ceres CLONE 1565917
  misc_feature: Encodes the peptide sequence at SEQ ID NO. 80588
  misc_feature (67)..(67): n is a, c, t, g, unknown, or other
  misc_feature (68)..(68): n is a, c, t, g, unknown, or other
  misc_feature (71)..(71): n is a, c, t, g, unknown, or other
  misc_feature (904)..(904): n is a, c, t, g, unknown, or other
  misc_feature (908)..(908): n is a, c, t, g, unknown, or other
  misc_feature (1021)..(1021): n is a, c, t, g, unknown, or other
tggggatgggggggctcttggggaatggggggggctgtcctttgaaattaccatttttagtctcgtnnccnaaaactggagctcaccgcggtggcggccgctttacaatagtggatcccccgggctgtttgaattcgtctcacccctagaaaaaaacccccacagttccgctccgccctgtgtgacgttccgagtctcaaaccagagcgaggccgcactggccgcgagtcctccactctgagcgcacgatggctgcgctgcgcctggccttgttcaccctcagccccgccgctgcctcgggctccgcctcctccggcgcgaccccaggtgcgtccggctccatctccgtctcctctcgccgcgcggggcgcggggtgctatccctccgactggtcccgcctcgccgccacagggacctggccaggctccccgccgcggccgaggtcgtggcggagagctacgcttgagcaccccccggagggtggccgcggagaacgggacccttctagccaaccggcccccacctgtagaagctggagaaaggtcctctccggaataaggccggttggcacagttccttacaaaaaagcgccatccggcccacgcagcggaagaaagaagggcccgagggccccctcccattcaaaagatcctccaggaggccgattcccgaagcagggtcacgccgcgcggcgattttaaagaaaacctttttccctccaaaaggtaatgtttgtctttcaataacaaaactattttccgccaggcggaggggccaaaacctgtgtgtcccggagtacggaatattgttgcggcgccttaaaagtttgtacataagaagaggagggtggttaacaaattcttcggggcgctgccaggggatatactcccgaggggtgtcganaacnagtcccttccgaatgatataagagatgccgtgggcaaggtgtaatgggaagtcgtctgtgtgaaccctgggatccgaccacgaatatcttctcacatacgaaagtctttgtgnagtacaaatgtgaatcgtgggggtctcacataagatggctgtgcaaggtttaggtccgacggtgttcgcaagcccccggaggagaggtagatacgagtgcggttgaaccgcggggcgaatataggtttcttaacacaggagaact

SEQ ID NO: 80588 - protein, 72 aa, Zea mays
  misc_feature: Ceres CLONE 1565917
  misc_feature: SWISSPROT Homolog: EC 3.6.3.14 H(+)-transporting two-sector ATPase
MAALRLALFTLSPAAASGSASSGATPGASGSISVSSRRAGRGVLSLRLVPPRRHRDLARLPAAAEVVAESYA

SEQ ID NO: 80589 - DNA, 893 bp, Zea mays
  misc_feature: Ceres CLONE 1565923
  misc_feature: Encodes the peptide sequence at SEQ ID NO. 80590
acccgcggtggcggccgctctagaactagtggatcccccgggctgcatgaattcgtctcacccctagaaaaaaaaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagctgctcggcccggagctgcaggagatgcgcggcggcctgatccgcctctgcgccgacgcggaggcgctgctggaggcgcactactccgacctgctggcctccttcgacaaaccgctggagcacctgtcgctcttcccctacatcaacaactacatccttgcttaaccagctggagcacggcctgctggcgcggcacgtgtcggggccagcgccggcgcgcgtgggctttcttcgggttccggcccgcttccccctgaactcccttggggctcgcgggcgcgcccacttttcggggggccccccttctaaaaactaacaaatatttggcgggggagggccaccgaaccggggcgccggcggtctgggtggccccgggaaacgggggcgcttccaggggcgcgcaatgggggttttcccccaactctctcgaaacgtgtggggaaacttgaacccccggggaggttggggcgttccttacaaaagccccgcggttttccctgggg

SEQ ID NO: 80590 - protein, 143 aa, Zea mays
  misc_feature: Ceres CLONE 1565923
  misc_feature (38)..(144): Pfam Name: NAS Pfam Description: Nicotianamine synthase protein
  misc_feature: SWISSPROT Homolog: EC 2.5.1.43 Nicotianamine synthase
MVVMGKEQQHEEEEVQGKVVQEEVQVVQETVVPVPSEEDKEAEAALVHKISSLAAAIAKLPSLSPSPEVNALFTELVTACIPRSSVDVELLGPELQEMRGGLIRLCADAEALLEAHYSDLLASFDKPLEHLSLFPYINNYILA

SEQ ID NO: 80591 - DNA, 1077 bp, Zea mays
  misc_feature: Ceres CLONE 1565926
  misc_feature (696)..(696): n is a, c, t, g, unknown, or other
  misc_feature (1075)..(1075): n is a, c, t, g, unknown, or other
  misc_feature (1077)..(1077): n is a, c, t, g, unknown, or other
ccccgcggtggcggccgctctagaactagtggatcccccgggctgcaggaattcgtctcacccctagaaaaattcttctcgtacgcgatcgattgcgagttgcgcccctcgccctcgcccggtcgccccccccagtccccgaaactgctccgcctccacgcccgcgcccgctcgccctgaccacggcgatggccgccgccgccctccgctcctccgcacgccggctcctgcgcctcgccccggcagcctcgtcggctctgtccgctggttcccggcccacagccgggggtgtgccgctcacgcgccccatcgccgcgctctcaggtggcaacaatcctatctcatggaaactgagacgggtctacagttcaaatgaaaaacacttgtctgggagaccccatcccaaaaaaagaatcttgtttttaagggttttgttgggccgcccagttggaaagaactttcccaattttccttggtggccgggaagccaaaaaaaagcagcccctctaaaggcccccccattgaatagggtgttggggccaagaagggttttttaaaaaatggtttttttccttgccctccttgaggggctttgggtgagaaaatattttgggggggaacccttttggggttatccccccacagagagggggcgcctcttgggggggaagccctcttttggggggcgcccgcccnccgggcccgagaaaaattgggtgggcggccccctccttcccacgcgcgtgtagaatttgcgagagcggaggttcgttttataagagcctgcgccctatataagactcccgcctctcactggaggaaatatctcttgtggaggccctctatgtgggtggcccgggtgaggagaaagtctcatttcatatacaaaaaacatgggggtgcgtgacccttgatgtgtgcggggaccacataaaaagagacacacaccccccacaaacaggtgtaaggcgcaggcgccgttacagacgtttgcgaagagggagggagagagaacctcccccgcctcttgcgccccacccgagctggggcgaccgtgggctcgcttatgtgtgcngn

SEQ ID NO: 80592 - DNA, 785 bp, Zea mays
  misc_feature: Ceres CLONE 1565929
  misc_feature: Encodes the peptide sequence at SEQ ID NO. 80593
  misc_feature (632)..(632): n is a, c, t, g, unknown, or other
  misc_feature (641)..(641): n is a, c, t, g, unknown, or other
  misc_feature (642)..(642): n is a, c, t, g, unknown, or other
tggagctccccgcggtggcggccgctctagaactagtggatcccccgggctgcaggaattcgtctcacccctagaaaaagctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtcgtgctaactcccacgcatttggcaatagttatggaatatgctgctgggggtgagctatttgaaaggatctgcagtgcggggagatttagtgaggatgaggcaaggtttcttctttcagcaactgattttggggagtgagctaatgccatttcaatgcaagtattgccctaaagaatctgaaacttagaaaaccctcccccctaaaaaggggggggtgcccccccccccccgcgtctaaaaaaaaaaaggggggatattntttgggggnnatacaaccaaaaattttggtggggggcccccccaccaaaaaaaaaaaagtgtgtgggccccccccctatattttttttttgaaaggggtccttctttataaaaaaaaaaaaaacggggggggaggaggggttttttttttctt

SEQ ID NO: 80593 - protein, 111 aa, Zea mays
  misc_feature: Ceres CLONE 1565929
  misc_feature: SWISSPROT Homolog: EC 2.7.11.1 Non-specific serine/threonine protein kinase
MERYEVIRDIGSGNFGVTKLVRDVRTKELFAVKFIERGQKIDEHVQREIMNHRSLKHPNIIRFKEVVLTPTHLAIVMEYAAGGELFERICSAGRFSEDEARFLLSATDFGE

SEQ ID NO: 80594 - DNA, 805 bp, Zea mays
  misc_feature: Ceres CLONE 1565931
  misc_feature: Translation starting site: 191
  misc_feature (593)..(593): n is a, c, t, g, unknown, or other
ctggagctccccgcggtggcggccgctctagaactagtggatcccccgggctgcaggaattcgtctcacccctagaaaaaatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcagttcatcgaccgcaaggttggtgagtccgttgaggagatagaccgccgcgtccctccagtggtgaaggaagccccaaccttggcccgctcggctgcgaaggaggntcgcccagccgggcctggtgggcacggccactgggccttggcaaatcagccatcgcccgcgccgagccaaaggcccggggagctctacacccgctacgaggcctgtgggcaaagcggcgtggccgcagaggccctggggggccctgaaccgtcctccctcggggggccctcggggcaccaggggccgttcttccccaatggcggcaaaggtt

SEQ ID NO: 80595 - DNA, 882 bp, Zea mays
  misc_feature: Ceres CLONE 1565934
  misc_feature: Encodes the peptide sequence at SEQ ID NO. 80596
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
agctccccgcggtggcggccgctctagaactagtggatcccccgggctgcaggaattcgtctcacccctagaaaaaaacattaggtccagtccacccctccagccaacccaagtctccatccacaagagctcgagaacctggccacgagcccatgacggcaagaagcggtcatggccggtgatgaggaggaccacctagcagacgcgccgcgggtggtgggcgtcctctccgcgctcctggaacgtgtcgtggagcgcaacgacgcggtggccgatgagctcgccgccgggaccgagtccgcggcgccgccgtcggcgttccgggcgacggcgaggcccgacatctcggtgcgctcgtacatggcgcgcatcgcgcggttcgcagggtgcagcccggcttgctacgtcgtggcgtacgtctacctcgaccgcctccctgcgcgcgcccgcagcgcgcccgccgtggactcgtacaccgtgcaccgcctccctcatcacgccgtgctcgcggccgtcaagttcatggatgacgtatgctacaacaaccgctacttcgccagggtcggcgggatcagccttgtcgaaaagaactaccgggggggggacttctcttttcccctggggttcaaacctaaaggttccccggaaaaatttgggcccatattgaagggccccccggggccaaaatttttacccggaagtttgagggggccccccccccccccccccccaaaaaaattttccacggggggttttttttaaaaaaaaacacaaggggtgggacccccccccnnnntttttttttttaaaaaagaagagggagggggtttttttttaaaaaaaaaacatttgtataagggggtcccgccccccccccccccc

SEQ ID NO: 80596 - protein, 196 aa, Zea mays
  misc_feature: Ceres CLONE 1565934
  misc_feature (13)..(154): Pfam Name: Cyclin Pfam Description: Cyclin
MAGDEEDHLADAPRVVGVLSALLERVVERNDAVADELAAGTESAAPPSAFRATARPDISVRSYMARIARFAGCSPACYVVAYVYLDRLPARARSAPAVDSYTVHRLPHHAVLAAVKFMDDVCYNNRYFARVGGISLVEKNYRGGDFSFPLGFKPKGSPEKFGPILKGPPGPKFLPGSLRGPPPPPPPKKFSTGGFF

SEQ ID NO: 80597 - DNA, 815 bp, Zea mays
  misc_feature: Ceres CLONE 1565935
  misc_feature: Encodes the peptide sequence at SEQ ID NO. 80598
  misc_feature (543)..(543): n is a, c, t, g, unknown, or other
  misc_feature (548)..(548): n is a, c, t, g, unknown, or other
tggagctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcangaggncatcaaatcctacccgggacgctttccacgcgtcatcggcttcgacaacatcaagcagacgcagtgcgtcagcttcatcgcctacaagccccgggaaagcgactaaaacggggcccgccgggcggccccccggcggttaagtaagctagctagctcccggctggaacaaaaaactaaggcccaggggcccccccctgtgccgttcgggttttgctttcggggcaccgggggacccctttggcgggggggggggttctcccctctccc

SEQ ID NO: 80598 - protein, 170 aa, Zea mays
  misc_feature: Ceres CLONE 1565935
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (134)..(134): Xaa is any aa, unknown, or other
  misc_feature (136)..(136): Xaa is any aa, unknown, or other
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELXEXIKSYPGRFPRVIGFDNIKQTQCVSFIAYKPRESD

SEQ ID NO: 80599 - DNA, 675 bp, Zea mays
  misc_feature: Ceres CLONE 1565937
  misc_feature (593)..(593): n is a, c, t, g, unknown, or other
ctccccgcggtggcggccgctctgaactagtggatcccccgggctgcaggaattcgtctcacccctagaaaaagctccattcaccccacaccttcttcttcgtcgtcgtcttcccctgctgcggttagcctggccgtggccgcctcctgctcttcgatctcacgctgcgatggaagcggtacgaaggtgatcaaggaacatcgggcttcgggcaaacttcggggggggaaaaaaaaattctttcgggaactcggaccaggaactctcccttaaattttcaaaaggcaaaaaatgtaacttttccaagggaattttaaaaccggtccccaaaacccccaaaattttatttttacagggggggggggtaaccccccccctttttgtgaaaaattttttaaaaaatttcttgtgggggggggggcttttttttaaaaaaaaaccttctccccgcggggggggaaatatatttttggggggggggaaagggggggaggggttttttttttctccccacaaaaaatattttttttgggggggggaaaaaaaagaaacacccccccccccccccccgggggggggggtccccccccccntgtgttttgtttttaataaaaaaaaaaaaaaaccccccccccccgcgccggggggggggggggccccccccccccccccccc

SEQ ID NO: 80600 - DNA, 836 bp, Zea mays
  misc_feature: Ceres CLONE 1565939
  misc_feature: Encodes the peptide sequence at SEQ ID NO. 80601
  misc_feature (528)..(528): n is a, c, t, g, unknown, or other
  misc_feature (534)..(534): n is a, c, t, g, unknown, or other
  misc_feature (535)..(535): n is a, c, t, g, unknown, or other
  misc_feature (546)..(546): n is a, c, t, g, unknown, or other
  misc_feature (556)..(556): n is a, c, t, g, unknown, or other
  misc_feature (584)..(584): n is a, c, t, g, unknown, or other
  misc_feature (592)..(592): n is a, c, t, g, unknown, or other
  misc_feature (632)..(632): n is a, c, t, g, unknown, or other
  misc_feature (747)..(747): n is a, c, t, g, unknown, or other
  misc_feature (748)..(748): n is a, c, t, g, unknown, or other
ggagctccccgcggtggcggccgctctagaactagtggatcccccgggctgcaggaattcgtctcacccctagaaaaatctcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccaccccgccgcttcgtcggccacgagaaggacgtcatctcccgtcgccttctccgtncgacannacccgcagatnatgttctccncggcttccgggaacaggaaccataagtnctggaaanacttcagcggcagtgcagtacaccttcgcggcgacctcgncgcgcagggcaccaacgggtgggtctcccctgcgttaggtcttcccccacaccttccagcccacattttggtctcgggatcctgggaccgcccccctcaaagtctgaaacttaanncaactgcagctgcgcctgcactctggaatggcacccggtgcttattgtaaaacgccgtcctgtgaaacccccaaacggtccgctgtgc

SEQ ID NO: 80601 - protein, 174 aa, Zea mays
  misc_feature: Ceres CLONE 1565939
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature (128)..(128): Xaa is any aa, unknown, or other
  misc_feature (130)..(130): Xaa is any aa, unknown, or other
  misc_feature (134)..(134): Xaa is any aa, unknown, or other
  misc_feature (147)..(147): Xaa is any aa, unknown, or other
  misc_feature (149)..(149): Xaa is any aa, unknown, or other
  misc_feature (163)..(163): Xaa is any aa, unknown, or other
MAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDLSTGLTTPPLRRPREGRHLPSPSPXDXTRRXCSPRLPGTGTISXGXTSAAVQYTFAATSXRRAPTGGSPLR

SEQ ID NO: 80602 - DNA, 921 bp, Zea mays
  misc_feature: Ceres CLONE 1565940
  misc_feature: Encodes the peptide sequence at SEQ ID NO. 80603
  misc_feature (360)..(360): n is a, c, t, g, unknown, or other
  misc_feature (816)..(816): n is a, c, t, g, unknown, or other
  misc_feature (836)..(836): n is a, c, t, g, unknown, or other
ctccccgcggtggcggccgctctagaactagtggatcccccgggctgcaggaattcgtctcacccctagaaaaaactcatccattccatcatcccttgcaagtatagtctcggcggctctagaatacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacncggcgtgcggcggcgtgggggtgctgggcatcgcctgggccttcggcggcatgatcttcgtcctcgtctactgcaccgccggcatctcgggggggcacataaaccccgccgtcactttcggccttctcctgggcgcgcaaggtcttccctggtgcccgggcctgctctacatcgtgggcccatgtgcctctggggcatttttgggggggtcggccttttttaaggggttttcaaaaacgccctatttcaaaaggggaagggggggggggccaaaattcgttgcgccccggggtattcccccggggggaccgggcccttgggcccaaaaattttggggacccttttgtgttttttataacacggttttttcccccccccaccaccccaaagggagaggcccgcggaaacccccaagcggggggtttgggggccccccccccccacaggtttttcccngtttttgggggcgcccaggnaaccacctctcctctccggggggggggtgtaaacccccgggggggaaggggggggcccccccgctttttaaaaaaaaaaaaaaaa

SEQ ID NO: 80603 - protein, 264 aa, Zea mays
  misc_feature: Ceres CLONE 1565940
  misc_feature (34)..(196): Pfam Name: MIP Pfam Description: Major intrinsic protein
  misc_feature (78)..(78): Xaa is any aa, unknown, or other
  misc_feature (230)..(230): Xaa is any aa, unknown, or other
MGKDDVIESGAGGGEFAAKDYTDPPPAPLIDAAELGSWSLYRAVIAEFIATLLFLYITVATVIGYKHQTDASASGADXACGGVGVLGIAWAFGGMIFVLVYCTAGISGGHINPAVTFGLLLGAQGLPWCPGLLYIVGPCASGAFLGGSAFFKGFSKTPYFKRGRGGGPKFVAPRGIPPGGPGPWAQKFWGPFCVFYNTVFSPPHHPKGRGPRKPPSGGFGGPPPPQVFPXFWGRPGNHLSSPGGGCKPPGGKGGAPPLFKKKKK

SEQ ID NO: 80604 - DNA, 887 bp, Zea mays
  misc_feature: Ceres CLONE 1565943
  misc_feature: Encodes the peptide sequence at SEQ ID NO. 80605
ctccccgcggtggcggccgctctagaactagtggatcccccgggctgcaggaattcgtctcacccctagaaaaagtcggagaccccaaacctctgtcgaaagtttcacctccggtcgctggtttcctccaatctccgtggtagttcagcgcgagcgggcggcggggtttgagctcgatggtcacttccggcgaacaatcggctggcggcgggtctgcggcgagggcgtcgaagctgcggtacccgctgcggtcggcgagcaaggggaaggcggcggtcgtttccccggcggctgatgctcctcccaccatctctgctccgcgacgggcaaaaccatcttcagatgtcagcaagagcatgtgtttagacctttctgtgaaggataattctgccaaacccccacggaggcactcaatacaaaccaagccaggagctagcccaaggccaacaccttctggaactgtgactccggtgtctgggggtcggtcaaaagagtcggaaagccaggggaaggttgataccccgacatcagaagtgtccatgtccatctcaaggggcaagttcagcacgcttttctcaatcctcgactgaatgacccaaatcaggctggcagaggctggctccaaagcactcggttttcttgggcttccttaagcttgccctgagatcaaaaagggacctttgggacgggttaggggaaaaacttaggccctccttaccccgggttggccctgggcacaaaatttgggggcccccttttagggacttccccgggtttttaaatttttggggagatttgtgaaaacggaaaaattttttggaaaccccccccgcacccaaaaaaatttttaggggggtgttctcttttcccccaaataggtctcccaa

SEQ ID NO: 80605 - protein, 137 aa, Zea mays
  misc_feature: Ceres CLONE 1565943
MVTSGEQSAGGGSAARASKLRYPLRSASKGKAAVVSPAADAPPTISAPRRAKPSSDVSKSMCLDLSVKDNSAKPPRRHSIQTKPGASPRPTPSGTVTPVSGGRSKESESQGKVDTPTSEVSMSISRGKFSTLFSILD

SEQ ID NO: 80606 - DNA, 878 bp, Zea mays
  misc_feature: Ceres CLONE 1565948
  misc_feature: Encodes the peptide sequence at SEQ ID NO. 80607
  misc_feature (395)..(395): n is a, c, t, g, unknown, or other
  misc_feature (482)..(482): n is a, c, t, g, unknown, or other
  misc_feature (512)..(512): n is a, c, t, g, unknown, or other
  misc_feature (513)..(513): n is a, c, t, g, unknown, or other
  misc_feature (536)..(536): n is a, c, t, g, unknown, or other
ctggagctccccgcggtggcggccgctctagaactagtggatcccccgggctgcaggaattcgtctcacccctagaaaaagccattaagactagctaactagcgtgaaagagctcctccgacgactactagctctcgcttgctccgacgacccctgccggccgcctctggtacaacgtacgagaggaagagagacgatcgatggccggcgccaccgtgaccgtggacgaggtgaggaagggccagcgcgcgaccggccccgccaccgtgctggccatcgggacggcgacgcccgccaactgcgtgtaccaggccgactacccggactactacttccggatcaccaagagcgaccacctcaccgacctcaaggagaagtttcagaggatgtgcgancagtcgatgatccggaaagcgtacatgcacctgacggaggagttcctgtcggagaacccgagcatgtgcgcgtacatggcgccgtcnctgggacgcgcgcaggacgtggtggtgacnngagtgccaaaactggggaaggcnggggcccaaaaggcgattcaagagtgggggcagcccaggtcccggaatcccgcactggtggttctgcccacttcgggggggggaaatggcgggggcccaactaccagctgaaccaaggccctggggcttgccctttcctggaacccccctgatgatgtacccccacgggggtgtttcggggggggcaccgtttttcccggtggcccaagaacctggggaaaaaaaaccccgggggaggggttccttggggggtgtctcaaggaaaaaccgggcggtaaaatttccggggggccccaaagatcccctctggaactctctgggggggggggtcttttgcggagg

SEQ ID NO: 80607 - protein, 148 aa, Zea mays
  misc_feature: Ceres CLONE 1565948
  misc_feature (6)..(145): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (65)..(65): Xaa is any aa, unknown, or other
  misc_feature (105)..(105): Xaa is any aa, unknown, or other
MAGATVTVDEVRKGQRATGPATVLAIGTATPANCVYQADYPDYYFRITKSDHLTDLKEKFQRMCXQSMIRKAYMHLTEEFLSENPSMCAYMAPSLGRAQDVVVTXVPKLGKAGAQKAIQEWGQPRSRNPALVVLPTSGGGNGGGPTTS

SEQ ID NO: 80608 - DNA, 905 bp, Zea mays
  misc_feature: Ceres CLONE 1565950
  misc_feature: Encodes the peptide sequence at SEQ ID NO. 80609
  misc_feature (508)..(508): n is a, c, t, g, unknown, or other
agctccccgcggtggcggccgctctagaactagtggatcccccgggctgcaggaattcgtctcacccctagaaaaaaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacagggtggagaagaaggaccctgtcacgggcacctacatgccgtccccactcctcacgggnggctaccgcgtctggtcgtaacttgaaccccttccagcccacccccacaaggggaaagaattggtttttcttcctcctggtttccggaaggaagaaggggatcccccactttcggtccaaatttttccttggtccccccccaccgggaaaggggaaaatgggcaagggggggaaagggccaattttaaaaagtttaaaaagaggacccccttttaaatttttggggagaagctaattttgggggggccccccttggaaaacaaatttttaaagaggggggggccaaaaaggggggcccaaagttcttctttggggccccccccccgggggggacccggcgcccccccccaggggggtggggggaaaaccctccccaacaaatacaccccccctcctt

SEQ ID NO: 80609 - protein, 113 aa, Zea mays
  misc_feature: Ceres CLONE 1565950
  misc_feature: SWISSPROT Homolog: EC 4.2.1.92 Hydroperoxide dehydratase
MASSDHGSTTAPKDVPGSYGLPLVGAVRDRLDFYYFQGQDKYFESRVERYGSTVVRMNVPPGPFMARDPRVVAVLDAKSFPVLFDMDRVEKKDPVTGTYMPSPLLTGGYRVWS

SEQ ID NO: 80610 - DNA, 854 bp, Zea mays
  misc_feature: Ceres CLONE 1565952
  misc_feature: Translation starting site: 175
  misc_feature (669)..(669): n is a, c, t, g, unknown, or other
ctggagctccccgcggtggcggccgctctagaactagtggatcccccgggctgcaggaattcgtctcacccctagaaaaattttttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctggtgttgtggaggaggcaggccgtggatatctcacccctgaggagggtgaaccaggccatctacctcctcaccactggtgccaggggagagtgctttccggaacatcaaaaccattngccgagtgccttgcagatgagctgatcaacgctgccaaggggctcatcaacagttacgcccatcagaagaaaggacgagattgagcgtgttgccaaggccaacggtgaactgagcttgtatcctggtgcactctgcgctgggaacttttatgtcgctggcagtcgtatccgttcttggtttacca

SEQ ID NO: 80611 - DNA, 1148 bp, Zea mays
  misc_feature: Ceres CLONE 1565953
  misc_feature: Encodes the peptide sequence at SEQ ID NO. 80612
  misc_feature (689)..(689): n is a, c, t, g, unknown, or other
  misc_feature (732)..(732): n is a, c, t, g, unknown, or other
  misc_feature (916)..(916): n is a, c, t, g, unknown, or other
  misc_feature (932)..(932): n is a, c, t, g, unknown, or other
  misc_feature (948)..(948): n is a, c, t, g, unknown, or other
  misc_feature (1043)..(1043): n is a, c, t, g, unknown, or other
  misc_feature (1044)..(1044): n is a, c, t, g, unknown, or other
  misc_feature (1045)..(1045): n is a, c, t, g, unknown, or other
  misc_feature (1087)..(1087): n is a, c, t, g, unknown, or other
  misc_feature (1128)..(1128): n is a, c, t, g, unknown, or other
  misc_feature (1148)..(1148): n is a, c, t, g, unknown, or other
ttgttgtggttattgccccgtccacgctcagtcactgtttttagaataagggataaatattatgatatcaaacttataaactccccgcggtggcggccgctctagaacagtggatcccccgggctgcaggaattcgtctcacccctagaaaaaatttgcactgcgtcgtatatatcctacaaaacggcagctagagatgatggcatcctccctcctctttgttgacgtcctcctcgcagagctgtcatcgccgcagccgtcagacggcctggcgcgcggacgacgactgcaccaccgcagctcgcacttcgtcgtgcacgacgtggagaccgggagcaaccccacggtcgtgcaggtgatcaagggcgcggggttgtcggtcgtcccggggcgggcactttggctacaccaccgtgatcgacaacgcgctgaaccgaaacctccgagcgccacaacaacctccgtggtgacggcactgcggcccttctaccgttaaagatggtctttgagtcgggccacttgggactcaagggtgtgcctggcagaactttggctcgctcctccggcgggggggaaccaacaatacgccattacacggactcccaccggatgggattggggctccgggggaaaaaaaaggttgcgaactccccggaaatgaggaatattggaaaacccatcctctccgntttagacttaccgggactggggttacggtgtgtctccgcgganatataagcgtgataaagtgtgcgccccagtcgggcggagcatatttataccgcaaccccaacttctatttaaaaaaagaaatgtcttttcgacagcccagtgtggtgaaacagggcggggcggcccggtatagtctctactatttccatttgtcttaaacggcctcccgagctcacacatgagncgccgctcttattatngcggagagtgtgtttnataataaaaaacacctctatattctgtttccagagtgttggacagtggtatatccacgaaatgtgggacgggggcatatatataatatagtgggnnncccaccgagtgggtcacccaaaagacgtggagcggtgtaaanaccacggggtcggggtaggaaaatatagtgaggtgtaccgnttagatcacccgatttattn

SEQ ID NO: 80612 - protein, 99 aa, Zea mays
  misc_feature: Ceres CLONE 1565953
MMASSLLFVDVLLAELSSPQPSDGLARGRRLHHRSSHFVVHDVETGSNPTVVQVIKGAGLSVVPGRALWLHHRDRQRAEPKPPSATTTSVVTALRPFYR

SEQ ID NO: 80613 - DNA, 932 bp, Zea mays
  misc_feature: Ceres CLONE 1565955
  misc_feature: Translation starting site: 175
ggagctccccgcggtggcggccgctctagaactagtggatcccccgggctgcaggaattcgtctcacccctagaaaaagtcgctgcgtagtgtagtgtcatcttatctcttcctcctaccttcactctcaaaatcttcagggagtcgtagaggagcagcaggtgcaccaaaaggatggcagcgccaggctccctgcgacttctccaggccccgtccttcgctgcggccaagtgccagccggtgggtggccgggcatccgcgcggcgagcgccacggccactgttcgccgtgcgcgcctcggctgctgacgccgccaacagggatgccgtgctcaaggccttccgcgagaacagggctctcaagataatttccggtcttcagaactttgacaggagcaccccctgcatctgttgtcacagctgcagataaaggaggtgcaacacatgttgacatagcatgtgacaaggacttagtaaagcttggcatgaatcttaccaaccttccgatctgtgtctcatccgaagatcccttcaccgttccatttctggcgtacaagccggagctaaaatggtttgaaatggaaaaactagaatcctttttataaaaagggcaattgaagttctccccttgaacaaaatcctgaagtctaacaggggaaaacagggaaaaagtcttcccaaaactccccttttcaggaaaagtgtccctcaaacctttattttttgccaaaaccaaagaagaatgccaaaggtctccctcgaaaggaaaggggcgggaaatattccccactggggggggggggaaaagtttttttccccaaaaaaaaaccggggggtgttttttttttttttaaaaagggaaaaccccaatctttttcgggaaagaaaaaacacttttcttggggggttgttaattaacccccaggggggcgc

SEQ ID NO: 80614 - DNA, 704 bp, Zea mays
  misc_feature: Ceres CLONE 1565956
  misc_feature: Encodes the peptide sequence at SEQ ID NO. 80615
ctccccgcggtggcggccgctctagaactagtggatcccccgggctgcaggaattcgtctcacccctagaaaaaatccgaaagcccaagacactgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaaggagtgatcgatgagaacggcgagaatgttccaaagggaaaaaaaaaaaggccttaggaaaaggcaagaaaaactgggggcccaaagggccccatgaggggaaccccccccaaccccccccccccctggggggggggaaccctttgttccccccggggggggaagagtttttcggggggcgggggctccccccgcgagggggggagaaaaccccccccccgggtgtgttttcccaaaaaatttgggggggcacccacccccc

SEQ ID NO: 80615 - protein, 118 aa, Zea mays
  misc_feature: Ceres CLONE 1565956
MEDERNTQQHQGGEQAQDQENEVKDRGLLDSLLGRNKHDDQEKKNQQAEEELATGMEKVTVAEPDHKEEGHEAAEKKDSLLAKLHRTSSSSSSSSDDEEEGVIDENGENVPKGKKKRP

SEQ ID NO: 80616 - DNA, 932 bp, Zea mays
  misc_feature: Ceres CLONE 1565958
  misc_feature: Encodes the peptide sequence at SEQ ID NO. 80617
  misc_feature (423)..(423): n is a, c, t, g, unknown, or other
  misc_feature (512)..(512): n is a, c, t, g, unknown, or other
gagctccccgcggtggcggccgctctagaatagtggatcccccgggctgcaggaattcgtctcacccctagaaaaagcaaaccttggatctcgcgcgcgcacgtaggggagcgcagcggagcaagaggaaagccatggctacgccggcggcggtgatgaaggtgtacgggtgggctatctcgccgttcgtgtcgcgggctctgctggccctggaggaggccggcgtcgactacgagctcgtccccatgagcccccaggccggcgaccaccgccgcccggagcacctcgccaggaaccctttcgccatggtgccggtgctcgaggacggcgacctcacgctcttcgaatcccgggcgatcgcgaggcacgttctccgcaagcacaggccggagctcctgggcgccggcgccggcggcagcctcnagcgggcggcgatggtggacctgtggctcgaggttgaaggcgcaccagctgagcccggcaaggggtcgccatccgtgttgagtgcttcnctgcggccgctgctcggcccgcaagcgcgaccaaaacggtcgttcaccaaaacgtggaaaaaccccagggagggtgccccgagtgttaccaaggccccgttttggccaaagttaaggttaccttcccggggaattttctttgggcttgccagaacttaggccctttacccattatgggatggtattagggggccccccaaaaacccccccccccctttgttaaaggggtctcctccgccttaaagccctggggtggggggaggggtttttcgggggggcccccggggaaaaaaaaaggggggggggaatatttatagtcggtggggccgcccgcggaattttttttaaacccctcccccccaaaaaacaaattttttcttcttttaaaaacacacccctcctcctttttattgttgtgtt

SEQ ID NO: 80617 - protein, 178 aa, Zea mays
  misc_feature: Ceres CLONE 1565958
  misc_feature (6)..(81): Pfam Name: GST_N Pfam Description: Glutathione S-transferase, N-terminal domain
  misc_feature: SWISSPROT Homolog: EC 2.5.1.18 Glutathione transferase
  misc_feature (97)..(97): Xaa is any aa, unknown, or other
MATPAAVMKVYGWAISPFVSRALLALEEAGVDYELVPMSPQAGDHRRPEHLARNPFAMVPVLEDGDLTLFESRAIARHVLRKHRPELLGAGAGGSLXRAAMVDLWLEVEGAPAEPGKGSPSVLSASLRPLLGPQARPKRSFTKTWKNPREGAPSVTKAPFWPKLRLPSRGIFFGLART

SEQ ID NO: 80618 - DNA, 813 bp, Zea mays
  misc_feature: Ceres CLONE 1565959
  misc_feature: Encodes the peptide sequence at SEQ ID NO. 80619
  misc_feature (528)..(528): n is a, c, t, g, unknown, or other
  misc_feature (565)..(565): n is a, c, t, g, unknown, or other
  misc_feature (587)..(587): n is a, c, t, g, unknown, or other
ctccccgcggtggcggccgctctagaactagtggatcccccgggctgcaggaattcgtctcacccctagaaaaatccactccggcctaaatatccgagctactattcctagtacagagtacagactacagagcaaccatcagcggcgaccactcgatccaagtagcgtataatctgctgtttcctgcggtgggtttaggagcgtataatctgctccagtcgctagctcaaccatgggctacgaggaggaagacaggctgctgttcccgtcctccgtcttcactgagagcttcacggaggccgccgccaccgccaccacccccggctccggtagtgagcagacgaaggctcggcagctgagcgacgggcaggccaggaagcggcggctgagcgacgggcaggcgcggttcctggagctcagcttcgggaaggagcggaagctcgagacgccccgcaaggtgcagctggccgccgagctgggcctcgacgctaagcaggtggccgtctggttccagaaactgcgcgtctngcacaagagcaagctcatggaggaaggagttctcagncttcgcgcgcgcacgacgcccnccgtcctcacaaactgccactcgaggacggaggtcgttgggcagtgcacgaacgccagccaaggaggaggaaggccgccgaccttcatcccctacttgagcgaaggacgccttacaacgcttaccttgaactggaggggacttgctttccggggatattttggggggaaaagtttaagggcccttttaaatggtatgattcgactcaaggtagggattttttgcgg

SEQ ID NO: 80619 - protein, 193 aa, Zea mays
  misc_feature: Ceres CLONE 1565959
  misc_feature (48)..(102): Pfam Name: Homeobox Pfam Description: Homeobox domain
  misc_feature (99)..(99): Xaa is any aa, unknown, or other
  misc_feature (111)..(111): Xaa is any aa, unknown, or other
  misc_feature (119)..(119): Xaa is any aa, unknown, or other
MGYEEEDRLLFPSSVFTESFTEAAATATTPGSGSEQTKARQLSDGQARKRRLSDGQARFLELSFGKERKLETPRKVQLAAELGLDAKQVAVWFQKLRVXHKSKLMEEGVLXLRARTTPXVLTNCHSRTEVVGQCTNASQGGGRPPTFIPYLSEGRLTTLTLNWRGLAFRGYFGGKSLRALLNGMIRLKVGIFC

SEQ ID NO: 80620 - DNA, 1194 bp, Zea mays
  misc_feature: Ceres CLONE 1565960
  misc_feature: Encodes the peptide sequence at SEQ ID NO. 80621
aaatttaaccacctactctataagtacattggacgagacaacacaacacaataattaattataaagtaaatacaaaatagagctcccgcggtggcggccgctctagaatagtggatcccccgggctgtttgaattcgtctcacccctagaaaaagctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtcgtgctaactcccacgcatttggcaacccccccgggatatgctgctgggggtgagctatttaaaaagatctgcagtgcgggggagatttagtgaggatgagggcaaggatctttcttcccaacaactgattttcagggagtgtaaccaatttggccatttccctgctaaagtaaggccgtaaagaaaatcttgaaaactttaaaaaaaaaagctcctccctcagaaattggtaagtttgtccgccaatcccccgggatttcggtgaaattttttgtttgcatatttcgcggggataaaccctcaccaagaggtacctatatccaaggatgctcattggacacaccgatactgttcaaaaccactggataacaaagtttataagccctgtgagtttagaggccaacaacaaactgtggacgaaataaaaatagtttgaccattaccacaagagggggagactccttccctcttctagagaataataaagatatgttaacccacatatgtgcgaacaggggaggtgtcccgggcagatatgttaacgggcatcctgttgatgtgataggaacacctccattaaaattggttggcaaaccatacccgcatggggggtcggtaaatcacctttatagcgagagagacccggataaatgatacctcgaaaaaagatatttcccaaaaaagactacttccccgcgggcattatcttccgcatgtagacatttgatgcagaattacacaaaata

SEQ ID NO: 80621 - protein, 95 aa, Zea mays
  misc_feature: Ceres CLONE 1565960
  misc_feature: SWISSPROT Homolog: EC 2.7.11.1 Non-specific serine/threonine protein kinase
MERYEVIRDIGSGNFGVTKLVRDVRTKELFAVKFIERGQKIDEHVQREIMNHRSLKHPNIIRFKEVVLTPTHLATPPGYAAGGELFKKICSAGEI

SEQ ID NO: 80622 - DNA, 1333 bp, Zea mays
  misc_feature: Ceres CLONE 1565962
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (753)..(753): n is a, c, t, g, unknown, or other
  misc_feature (757)..(757): n is a, c, t, g, unknown, or other
  misc_feature (758)..(758): n is a, c, t, g, unknown, or other
  misc_feature (760)..(760): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (804)..(804): n is a, c, t, g, unknown, or other
  misc_feature (821)..(821): n is a, c, t, g, unknown, or other
  misc_feature (822)..(822): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (856)..(856): n is a, c, t, g, unknown, or other
  misc_feature (1007)..(1007): n is a, c, t, g, unknown, or other
  misc_feature (1145)..(1145): n is a, c, t, g, unknown, or other
  misc_feature (1149)..(1149): n is a, c, t, g, unknown, or other
  misc_feature (1228)..(1228): n is a, c, t, g, unknown, or other
  misc_feature (1234)..(1234): n is a, c, t, g, unknown, or other
  misc_feature (1289)..(1289): n is a, c, t, g, unknown, or other
aaaaataggccgatgacaaccgagagcataagaagacaaaatgagtgatttatgaaaaagaataaaaaaaaaaactgggactcaccgcggtggcggccgctctatgaatagtggatcccccgggctgcaggaattcgtctcacccctagaaaaatctcgccatcctacgcctcgcgccgccgtcacagtaacgcttgcagccccaatcccccacggcgaccatggcgcggctcgcagggagtccctactcccatggtgggcacagatgcgcgggtcataacaggcgagggtgactggctgatcgccgaccccccatcgaacaacgtcggccttttcaatcgatcctccctcgctcccgggggacaaagctcccgtgcctgggaagcgggggaccctggaaccaaaacgccggggtggcaaaggtccccaacccgcgggagaaatcccggnnnggggaggtatacagccggccccgggggaacaaacgggggggggggggtcctttttatttttttttattgtgggagggcccggtttatcaacctccgggcgccgcaacgagcccgggtgtgtggtgggtgggaggatgtatacgcttgggcgaacgaacagagtgggggagggtagttggcggtgagggggggggagggaggaggggcacccccccccccaccagacgggaggggggtggtatggatgttagaccaacgcaaaattcgacaactgctcgggtgagagagaaggtgggtgatnatgnnantcggttcggggnnnnnnnntnnnnnnnntnnnnnnnnttggggngggcgcggagggggtgnngggnnnccccgcctatctccgttgcgaagttggntagcagggaggaagcggccatccctctgattgacccagtggacgacccggtcgagccgccgagtagatataggcacggccggcagtgagacacggcgccggccagcgtacataactgcgtcgagagcgcgcgcgtctatcgcgcgacgccnggggtgctcattgaccattataactaggagagcgcggaggcgcgcgaggaacagtgagtataatccattgctcgcatacgtgacgattatcgacgtcgacacgtcatggagatgtaacgaatgagaatatgtgatcgnagcngacgtaccgaatatgtacgagtcattactccgtgatatagatcggaagtcgacgctgtatgagcggcgagtagtggagncgaggnaattagatgatataattcgggtacacccgctcgtgcctgtataactcgagacagngcgctcgcgtcagggatactatgcgctcgtggtgaactcattga

SEQ ID NO: 80623 - DNA, 935 bp, Zea mays
  misc_feature: Ceres CLONE 1565964
  misc_feature: Encodes the peptide sequence at SEQ ID NO. 80624
acccgcggtggcggccgctctagaactagtggatcccccgggctgcaggaattcgtctcacccctagaaaaaaaacgagcggttagaaaccctagtcaaaaccctcgccctcccaaaaactactcacgtctcgccgccccgccgtatcaccctttctcggcggccggcctcttctcttcacggactcgcaggtcatcgagatgtcgtcggcggaggcgaaggccgcggcgaaggcggtcccggagtctgtgctgcgcaagcgcaagcgggaggagcagtgggcagcggacaagaaggagaaggccctcgcagacaggaaggaggcgcttgacagccgcaagatcatatttgctcgcgccaagcagtacgcccaggagtacgacgcccaggagaaggagcttgtgcagctcaagcgtgaggctcggttgaagggtgggttctatgtgagcccagaggccaagcttctgtttgtgggtcgcatccgtggtatcaatgccatgcacccccagaccccgcagattctgcagctcctgcggtttgaggcagatctttcagtggtgtctttctcaaggttaacaaggcaactattaacatgcttcgcgaggggggagccaaattgttgcgtttgggaaaccccaacctgaaaaagggtttggggaatttattcttcaaaaaaggtttttgggaaagctgaaaaacaagaagaatttccctttttaaaacaaacatttttttttggggggggggcgttggggaagagaaaaaatatttttgtcttctggagaacctgttgtccaaaaaaaaaaagagaagggggggccgcccccctccaagagaggggggaaaaaaatttccttttggggggaataaaaaaagaagagaaaaacccccttcttggtggggtcccacaaaaaaaaagaaaaagcacacccttt

SEQ ID NO: 80624 - protein, 147 aa, Zea mays
  misc_feature: Ceres CLONE 1565964
  misc_feature (16)..(86): Pfam Name: Ribosomal_L30_N Pfam Description: Ribosomal L30 N-terminal domain
MSSAEAKAAAKAVPESVLRKRKREEQWAADKKEKALADRKEALDSRKIIFARAKQYAQEYDAQEKELVQLKREARLKGGFYVSPEAKLLFVGRIRGINAMHPQTPQILQLLRFEADLSVVSFSRLTRQLLTCFARGEPNCCVWETPT

SEQ ID NO: 80625 - DNA, 809 bp, Zea mays
  misc_feature: Ceres CLONE 1565965
  misc_feature: Encodes the peptide sequence at SEQ ID NO. 80626
  misc_feature (780)..(780): n is a, c, t, g, unknown, or other
ctccccgcggtggcggccgctctagaactagtggatcccccgggctgcaggaattcgtctcacccctagaaaaaatccgtcccgacccgaccagctttgagatcgcgatggcggacggccgctgctgcaccttcctggagatcctcttcgccatcatcctcccgcccctcggcgtcttcctccgattcggctgctgcagaatagagttctgcatctgcctgctgctcaccatccttggctacgtccccggaatcatctacgcgatctatgtccttgttgctctcgactctgaccagcacgagagggaatactacacccttgcttagagcatctggttgtgccaggcgggcctgcacagttgagtcgaatcagtatttttttctcatgtggattgtctgacatggcataagcgggcatgggtaacaagttgtgtggtctatatctctgttaccaaacttgggagctctctttattgggctccggtattccatctggaattggggatccttccagaaaataaaatgcccattgaaagcccggaatcgagaagcaaggggccctccccaaggccaagggaaaaccgtggcctccccccccccctcggggggttttaggaaaaatttcctggttccttttctggcgccccgggggaaaagcatttttttttcaaaaaaaatttgggaaaaaaagtcttaaagggggccctttttattttttggaaaaagaggaaaaggtgtttgggggggtttttgggctcccccaaaaaaggccccccctttnaagaggatggtgggaccctccccccccac

SEQ ID NO: 80626 - protein, 72 aa, Zea mays; identical to SEQ ID NO: 51501
  misc_feature: Ceres CLONE 1565965
  misc_feature (7)..(58): Pfam Name: UPF0057 Pfam Description: Uncharacterized protein family UPF0057

SEQ ID NO: 80627 - DNA, 850 bp, Zea mays
  misc_feature: Ceres CLONE 1565966
  misc_feature: Encodes the peptide sequence at SEQ ID NO. 80628
  misc_feature (796)..(796): n is a, c, t, g, unknown, or other
  misc_feature (797)..(797): n is a, c, t, g, unknown, or other
acccgcggtggcggccgctctagaactagtggatcccccgggctgcaggaattcgtctcacccctagaaaaagcaaaccttggatctcgcgcgcgcacgtaggggagcgcagcggagcaagaggaaagccatggctacgccggcggcggtgatgaaggtgtacgggtgggctatctcgccgttcgtgtcgcgggctctgctggccctggaggaggccggcgtcgactacgagctcgtccccatgagcccccaggccggcgaccaccgccgcccggagcacctcgccaggaaccctttcgccatggtgccggtgctcgaggacggcgacctcacgctcttcgaatcccgggcgatcgcgaggcacgttctccgcaagcacaggccggagctcctgggcgccggcgccggcggcagcctcgagcgggcggcgatggtggacgtgtggctcgaggtggaggcgcaccagctgagcccgccagcggtcgccatcgtggtggagtgcttcgctgcgccgctgctcggccgcgagcgcgaccagacggtcgtcgacgagaacgtggagaagctcaggaaggtgctcgaggtgtacgaggcgcggcttggcgagtgcagggtacctcgccggcgacttcctcagcctcgccgaactcagccccttcaccatcatgcactgcatcatggccaccgagtacgccgcccgccctggtcgaagcggctcccgcgcgtcagcgccttggttgggaggggcttcgccgcgcgccccgcggccaagaaggtgggcggagttcatacccgnntcggcgcggcccggacttgctgaacacccctcccaaccacagggatggatgct

SEQ ID NO: 80628 - protein, 229 aa, Zea mays
  misc_feature: Ceres CLONE 1565966
  misc_feature (6)..(81): Pfam Name: GST_N Pfam Description: Glutathione S-transferase, N-terminal domain
  misc_feature: SWISSPROT Homolog: EC 2.5.1.18 Glutathione transferase
  misc_feature (223)..(223): Xaa is any aa, unknown, or other
MATPAAVMKVYGWAISPFVSRALLALEEAGVDYELVPMSPQAGDHRRPEHLARNPFAMVPVLEDGDLTLFESRAIARHVLRKHRPELLGAGAGGSLERAAMVDVWLEVEAHQLSPPAVAIVVECFAAPLLGRERDQTVVDENVEKLRKVLEVYEARLGECRVPRRRLPQPRRTQPLHHHALHHGHRVRRPPWSKRLPRVSALVGRGFAARPAAKKVGGVHTRXGAARTC

SEQ ID NO: 80629 - DNA, 910 bp, Zea mays
  misc_feature: Ceres CLONE 1565973
  misc_feature: Translation starting site: 144
  misc_feature (392)..(392): n is a, c, t, g, unknown, or other
  misc_feature (393)..(393): n is a, c, t, g, unknown, or other
ctcaccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcnncccctatcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaagcccggctcccagatcttcaggcgagggtggactggactacctcgggaaccccagcctcatccacccgcaaagcatcctcgccatctggggcttgccaggtcttgctcatggggccgcgtcagggggttactgaataccccggcggccgccttgggcaagggtcgtcaaacccggttcttttccggggggaaggttttcaaaccgttttgggccttacccaaacaaaccccgaggccttcccctgaacctcaagggggaaaggaacttcaagaaacgggcccgccctccccattgtttctccccagggttccgaaatctttgtttccaagcaccattttttaccgggggaaagagggccccctttcg

SEQ ID NO: 80630 - DNA, 808 bp, Zea mays
  misc_feature: Ceres CLONE 1565974
  misc_feature: Translation starting site: 134
  misc_feature (534)..(534): n is a, c, t, g, unknown, or other
  misc_feature (537)..(537): n is a, c, t, g, unknown, or other
  misc_feature (563)..(563): n is a, c, t, g, unknown, or other
  misc_feature (573)..(573): n is a, c, t, g, unknown, or other
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctggggcatgctgggcgcgttgggctgcgtgttcccgggagctgctcgcccgcaacggcgtcaagttcggcgaggccgtgtggttcaaagccnggntcgcagatcttcagcgaggggtgggnctggactacntcgggcaacccgagcctgatccacgcgcaaagcatccctcgccatctggggcttgccaggtcgtgctcatgggcgcccatccagggggtaccgcggtctccggggggcccctttcgggaaaagggtgtttaaacccctttttaccccggggggaaaggtttttaaaccggctttgggccttccccgaaaaaacccctggaggggctttccgggggaagctcaaagggggaaaggg

SEQ ID NO: 80631 - DNA, 884 bp, Zea mays
  misc_feature: Ceres CLONE 1565977
  misc_feature: Encodes the peptide sequence at SEQ ID NO. 80632
ctggagctccccgcggtggcggccgctctagaactagtggatcccccgggctgcaggaattcgtctcacccctagaaaaatatgtcatagtggggccaaaggaaggtgatacaccagacaggcagaagtacaaacaacgcatcaaatttttcgaacctgagatcaagggaccttcacctgaaatggttgagtacatcggaatgcaaaacctgattaatgccataaagagtactgttggactgagtgaagggaaactgctatttggtttcgaaggcaacttatctggagagattgtgtggggagctcttgatgacgttgtgatgcgtggtgttagtgaaagtacattccaaatcttgccaacaggcagtgcaagtagtggaccaactgggatgttcaaagggactgtatctacttcgaataatggtgcgtttactactataacgacaaagacttttactgcgccataagacctgtcatcatatgatagtgctgagctacgagtgtatgctgatgggtcgacgcataactcattataccgactagctatgaatgggattctgctagtctattcaggagtctttaccccactaaaagggggatggctaagtggttaaggtacttctctatccactgaacccggagttccaggctccaactgggactggaagccccaaccctgggttggaaccccccttaaatcgctaacacctctggttttacaaaattggagaccggggccaaaaaaaactcgaacaattaaaaaaagcccccctttgaacttccttttttcccgggtttgaaggtatcccccaggaacccatttccttccgagggttgttcctctggaaattccggggggattctcaaaaccctaaaaacccggg

SEQ ID NO: 80632 - protein, 154 aa, Zea mays
  misc_feature: Ceres CLONE 1565977
GAPRGGGRSRTSGSPGLQEFVSPLEKYVIVGPKEGDTPDRQKYKQRIKFFEPEIKGPSPEMVEYIGMQNLINAIKSTVGLSEGKLLFGFEGNLSGEIVWGALDDVVMRGVSESTFQILPTGSASSGPTGMFKGTVSTSNNGAFTTITTKTFTAP

SEQ ID NO: 80633 - DNA, 796 bp, Zea mays
  misc_feature: Ceres CLONE 1565978
  misc_feature: Encodes the peptide sequence at SEQ ID NO. 80634
  misc_feature (542)..(542): n is a, c, t, g, unknown, or other
ctccccgcggtggcggccgctctagaactagtggatcccccgggctgcaggaattcgtctcacccctagaaaaagcaccgctctgaaaaccattcccaggcaggcccgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgtaggcggacccggcggcggcgatggccgcggcgcggcacgagttcggcgagcacggcggcgtgaacatgtccatcgaggcgtcggcgacgttcacggtgatggagccggacacgatgcggcggctggtcgcgggcgagctgggccccgaccgcggagacatgtacatctacagccggcacttcaacccgacggtgctggcgctggggcggcagatggccgcgctggagggcacggaggccggctacttgcacgcgtccgggatgtccngcatctcgtccgtgctgatgcaactggggggcgccggcgggcacctggtgggcgtcccgtgccttgtaccgcgggacacacgcgctgcttggccggtttctgccgcgcgcctccgggggtgcccgccacctttctgggaacccaacaaccagcccccgtgggcgcccccgggggccccggcgagacaccggtgggggtacttggaaccaatgtccaaaccaaacttgggcgttcccaaattccatggttggggg

SEQ ID NO: 80634 - protein, 167 aa, Zea mays
  misc_feature: Ceres CLONE 1565978
  misc_feature: SWISSPROT Homolog: EC 4.4.1.11 Methionine gamma-lyase
  misc_feature (83)..(83): Xaa is any aa, unknown, or other
MAAARHEFGEHGGVNMSIEASATFTVMEPDTMRRLVAGELGPDRGDMYIYSRHFNPTVLALGRQMAALEGTEAGYLHASGMSXISSVLMQLGGAGGHLVGVPCLVPRDTRAAWPVSAARLRGCPPPFWEPNNQPPWAPPGAPARHRWGYLEPMSKPNLGVPKFHGWG

SEQ ID NO: 80635 - DNA, 888 bp, Zea mays
  misc_feature: Ceres CLONE 1565980
ctccccgcggtggcggccgctctagaactagtggatcccccgggctgcaggaattcgtctcacccctagaaaaaaacccaaacaccacaatccccttcaacaaacgcaccgcactccacggcagccagaaaacacaatccacagagtctccgtgaggtctgagcgaggtaggactagctctgagcgagttcttccgtcttccaggtataatcctagcaactctcactatcctcttcgcatcgctcgtctctttttgagaccagttggatttctcttatttttccttggatcctactacctaatagaacagagctccggagccttttagtttctggtctctgatctactcattttcttttcttccccttttggtgacataggtaggtctagttaagatctgtcgtgcctgttctttgattttagctaagaacaggcgatttagtcttcttctttcctacaaaaaaaatccccagaaaaaaaagttgtgagtagtatattcttgtacattttgatggcgctgctataaatcttcccgggcccagccaggatttgatgcgaggcgaggaagtctttcttgcaagaaaaccccccatcccttttggcaagtcccccggggccgttttttcccgggggcgcgagcccaggggggccaatacccggggaccccctctgagcccggggggaaaatggttttttttgggggcccttcccccctataaaaaaaaccgggggggtgcgccgggggggcaaaactaaaaaaccccccctccaaagtgggggggggggggggggcccaaaagtgtttaaaaaataatatccccggggggggggagctttcttggggggaggggggggggggaaaaaatcctccccccccccacccccccc

SEQ ID NO: 80636 - DNA, 847 bp, Zea mays
  misc_feature: Ceres CLONE 1565981
  misc_feature: Encodes the peptide sequence at SEQ ID NO. 80637
  misc_feature (657)..(657): n is a, c, t, g, unknown, or other
ggagctccccgcggtggcggccgctctagaactagtggatcccccgggctgcaggaattcgtctcacccctagaaaaactcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgtttgagcagctgatgagaggaggccattccgtgctctcttggatgttggccttatcaggactaacacgggaaaccgtgtcttttggtgcccctcaagaaagctttggatgggggccctggatattcctcacanccaaaagaaggtttgcttgaattcaaaaaggatgaacaaacctttggatgctgattcccccccgcagggaacatttattggggggccatgttgcctgaccaccctgaagaaaccttgctgaaaaaggggccccaaaaaatccccaaaaccccttttcggggtgtacttttagaaaggggggttggggggt

SEQ ID NO: 80637 - protein, 133 aa, Zea mays
  misc_feature: Ceres CLONE 1565981
  misc_feature (27)..(134): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSV

SEQ ID NO: 80638 - DNA, 852 bp, Zea mays
  misc_feature: Ceres CLONE 1565983
  misc_feature: Translation starting site: 104
  misc_feature (519)..(519): n is a, c, t, g, unknown, or other
  misc_feature (522)..(522): n is a, c, t, g, unknown, or other
  misc_feature (616)..(616): n is a, c, t, g, unknown, or other
ggagctccccgcggtggcggccgctctagaactagtggatcccccgggctgcaggaattcgtctcacccctagaaaaagcctcttcagtcttctccttataaaatgtgcaggcagcatcagcacttgagcagtgaccacaagaccaaaagaagcctcagttttggcatccagaagcaactggccatggaaagcagtgggatcggcagagtggccccactggaggccgtcctcttcgacatcgacggcaccatggccatctccgacccgttccaccaccgggccacctcggagatgctcctcaaggtgggctacaacaacggcgtgcccatcacgcccgagttcggcatggcgaacatggccggccggagcaacgagcagatcggccgcttcctgttcccggactgggaccagcgccgcctcgacgccttcttcgccgagaaggaggcgctcttcgccaggtacgccgccgaggggctccgggagatcgccgggctcacgccgctctgccgctggggcgnccnggcgcggctcaggcgcgcccgcgtcaccaacgcacctagggccaacgcgagctcatgatctccatcctcgggctctccgactttttttccttcncgtcaccggcgaggaatgcgggcgaaccaagccttaccttgacccgtacctcagggggctcgacctgcttgggttctcgccggacaacccctccgggtccaagactccacccctggggggcagcccggatttgcgcaaggaatcccgggggttctcctccccaaaaaaagaaaaaagaaaaattttttcccgttggggaaaactttttttttgggggattcaaaaaaccccaggtt

SEQ ID NO: 80639 - DNA, 850 bp, Zea mays
  misc_feature: Ceres CLONE 1565984
  misc_feature: Encodes the peptide sequence at SEQ ID NO. 80640
  misc_feature (564)..(564): n is a, c, t, g, unknown, or other
ctccccgcggtggcggccgctctagaactagtggatcccccgggctgcaggaattcgtctcacccctagaaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctaccctcagatgaagggtgactatcacaggtatcttgcngaatttaagactggtgctgagaagaaggaatctgctgagagcacaatggtgggctataaggctgctcaggacattgctctggctgaggctggcactacccatccgataaaggtgggacttgctctaaatttttaggggtccattaggaggattctaaattccccaaaaaaacttggaacctggaaaacaagggttttgatgaactattcctgagtaaaaaaccctggggggggatcttaaagggaaagccccttgactttgcacctcccggagaaaaccttgccct

SEQ ID NO: 80640 - protein, 178 aa, Zea mays
  misc_feature: Ceres CLONE 1565984
  misc_feature (3)..(179): Pfam Name: 14-3-3 Pfam Description: 14-3-3 protein
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYPQMKGDYHRYLAEFKTGAEKKESAESTMVGYKAAQDIALAEAGTTHPIKVGLALNF

SEQ ID NO: 80641 - DNA, 809 bp, Zea mays
  misc_feature: Ceres CLONE 1565986
  misc_feature: Encodes the peptide sequence at SEQ ID NO. 80642
  misc_feature (498)..(498): n is a, c, t, g, unknown, or other
ggagctccccgcggtggcggccgctctagaactagtggatcccccgggctgcaggaattcgtctcacccctagaaaagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgcccgaagcgctggggctgggcaactggggtgaaggcncaggattgggcggccggtcccccgcgggcaggcccactaccctggggcccccccggtggcggtgggggaaagcttgccaaacaatcctggggggggcaaaatttcgtgggcccatttccccttttgccgaaaaacccaggggccaccccgggggaaaaaagggaccccccaaaaaaaaaaaaaaaaaaacccccgggggggggggcgcctttttaaaaacccccgtttggggggttttttcccagggggggaaccccccccccccaaaaaattttttgggaggagaaaaaaacaaaaccaccctcagagga

SEQ ID NO: 80642 - protein, 224 aa, Zea mays
  misc_feature: Ceres CLONE 1565986
  misc_feature (58)..(204): Pfam Name: Chloroa_b-bind Pfam Description: Chlorophyll A-B binding protein
  misc_feature (121)..(121): Xaa is any aa, unknown, or other
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLAVPGVLVPEALGLGNWGEGXGLGGRSPAGRPTTLGPPRWRWGKACQTILGGAKFRGPISPFAEKPRGHPGGKKGPPKKKKKKTPGGGGAFLKTPVWGVFSQGGNPPPPKNFLGGEKNKTTLRG

SEQ ID NO: 80643 - DNA, 963 bp, Zea mays
  misc_feature: Ceres CLONE 1565987
  misc_feature: Encodes the peptide sequence at SEQ ID NO. 80644
  misc_feature (963)..(963): n is a, c, t, g, unknown, or other
ccccgcggtggcggccgctctagaactagtggatcccccgggctgcaggaattcgtctcacccctagaaaaatctcacgcgactcattcgatcttcagtcttcttacatagtagtgcaataaaataaccaccctggatgtggagcagtaccatggccctctcctccactgccttcccctgcgagggcctaaacttgtcgtcctcttcaccctttcgtcaggcccgcctgaccatgtgcaagactgcggggaaggccaagcctgcggccgcgtccgggagcccgtggaatggatgcgacggcatgctgtacctgggcaccacgaccggtgatcccccgagatatctgactgtgcaacctcccgggctactaccggtgggacaaaacttgggatcgtcccccccccccggagaagttttaccacagaaccggggagcccggtaggggtaatccactccccgggtggggcccattcctgggggcccccttccgggcatggggttcatttcccgggaaacatggtcccttccccgtcaaaaagagggttcttatatttcctggggggaaaagaaccctcctcatggggattctataggggcaccggcctcctcctctagaatatatttttcttgccaaaaagggggtgggaaaaaacattgggtacttctttccccctcgggtgggaaaaatacccccaaggggacttcaaattttccccaagtttgagaagaaaaaaaaaacttcctatgtgcgctatattttttttgggggaaaattatgcgaaccacctcctcttaattgttccaatataaaggggctcccccccctcctacgtggggggaggcttttatatagataaaactcaccggcggcgggggagggttctctcttatctaggtggaaaagatatattttttaagaaacgccccctccgtattagttataattatcaggggttgaggagn

SEQ ID NO: 80644 - protein, 96 aa, Zea mays
  misc_feature: Ceres CLONE 1565987
MALSSTAFPCEGLNLSSSSPFRQARLTMCKTAGKAKPAAASGSPWNGCDGMLYLGTTTGDPPRYLTVQPPGLLPVGQNLGSSPPPGEVLPQNRGAR

SEQ ID NO: 80645 - DNA, 826 bp, Zea mays
  misc_feature: Ceres CLONE 1565988
  misc_feature: Encodes the peptide sequence at SEQ ID NO. 80646
  misc_feature (589)..(589): n is a, c, t, g, unknown, or other
  misc_feature (815)..(815): n is a, c, t, g, unknown, or other
ctccccgcggtggcggccgctctagaactagtggatcccccgggctgcaggaattcgtctcacccctagaaaaatatacctaccagatatttcgaggtttagcctatattcacacagtacctggtgtttgtcacagggatgtgaaaccacagaatcttttggttgatccattgactcaccaagtgaagatatgtgattttgggagtgccaaaatgttggtcaaaggtgaagcaaacatttcatatatatgctcacgttattaccgtgctccagagctcatatttggggcaaccgagtacacaacatcaattgatatttggtcagctggatgtgttcttgctgagctgcttcttggccagcctctcttccctggcgaaagtgctgtggatcaacttgttgagataataaaggttcttggtactccaacacgtgaggaaatccgttgtatgaatccaaactacaccgagtttagatttcctcagatcaaagctcacccatggcacaagattttccacaagcggatgcctccagaagctatagatctcgcttcacgtttgctccagtactcaccaaatctaagatgcactgnctcttgaagcgtgtgcacatccattctttgatgagttgcgagagccacatgcgaggttgccaaatggacggccatttcctccactgttcaactttaaacaggaactagcaaatgcctccccggagctcatcaacaggctgatcccagaccatgctaggcggcatcttgggctcactttattgcccaccactggaccataggcgaaggctctatggtgtttaaaccnttgctcttctg

SEQ ID NO: 80646 - protein, 197 aa, Zea mays
  misc_feature: Ceres CLONE 1565988
  misc_feature (2)..(198): Pfam Name: Pkinase Pfam Description: Protein kinase domain
  misc_feature: SWISSPROT Homolog: EC 2.7.11.1 Non-specific serine/threonine protein kinase
  misc_feature (196)..(196): Xaa is any aa, unknown, or other
PRGGGRSRTSGSPGLQEFVSPLEKYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTXS

SEQ ID NO: 80647 - DNA, 869 bp, Zea mays
  misc_feature: Ceres CLONE 1565990
  misc_feature: Encodes the peptide sequence at SEQ ID NO. 80648
  misc_feature (583)..(583): n is a, c, t, g, unknown, or other
  misc_feature (619)..(619): n is a, c, t, g, unknown, or other
ctccccgcggtggcggccgctctagaactagtggatcccccgggctgcaggaattcgtctcacccctagaaaaacccaatccaactccaaactctccatccagtgggaaaaaaaaacaaaaagggtaccggaagcggcgaaagcctcgcctcccgccgctctcgcatcgtctccagagcgcacgtcagatcaggtgcgccgcgcccccctcgcctaagctgcgacgaccatccatcgaacaggaaggatgacgggctccatggatctcccggccaagggcgggttcagcttcgacctgtgtcgccggaacaacatgctggagaagaacggactcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagctttcacgttatgcacgggccgcggatcangaggtgtaactgctcttacactactgaagtcacccntctttcagtatcagggccatgtcagtgctgccctttgtcttggtgggagtggattgtactgggccacattttcccaccgttttatccacccgggtccactgaaacctcttcctttggccccctgggggcctgggttccccttgctgcaaagtcaagggttggaaacaaagtaaaaaaagggctttacttgggggagaggggaaacaaatttggtggcgagcaatcgggggcgggtatttcacaagggctg

SEQ ID NO: 80648 - protein, 114 aa, Zea mays
  misc_feature: Ceres CLONE 1565990
  misc_feature: SWISSPROT Homolog: EC 3.4.25.1 Proteasome endopeptidase complex
  misc_feature (112)..(112): Xaa is any aa, unknown, or other
MTGSMDLPAKGGFSFDLCRRNNMLEKNGLKVPGFRKTGTTIVGLVFQDGVVLGADTRATEGPIVADKNCEKIHFMAPNIYCCGAGTAADTEAVTDMVSSQLQLSRYARAADXEV

SEQ ID NO: 80649 - DNA, 1192 bp, Zea mays
  misc_feature: Ceres CLONE 1565991
  misc_feature: Encodes the peptide sequence at SEQ ID NO. 80650
  misc_feature (57)..(57): n is a, c, t, g, unknown, or other
  misc_feature (71)..(71): n is a, c, t, g, unknown, or other
  misc_feature (475)..(475): n is a, c, t, g, unknown, or other
  misc_feature (476)..(476): n is a, c, t, g, unknown, or other
  misc_feature (481)..(481): n is a, c, t, g, unknown, or other
  misc_feature (487)..(487): n is a, c, t, g, unknown, or other
  misc_feature (1192)..(1192): n is a, c, t, g, unknown, or other
aatatttgcaaaaaacaacaaaccaaaaaaaaaaaaaaacacaacaaaaaccaaaantaataaattaaaanaaaaaaaaaactccccgcggtggcggccgctctagaacagtggatcccccgggctgcaggaattcgtctcacccctagaaaaacccaatccaactccaaactctccatccagtgggaaaaaaaaacaaaaagggtaccggaagcggcgaaagcctcgcctcccgccgctctcgcatcgtctccagagcgcacgtcagatcaggtgcgccgcgcccccctcgcctaagctgcgacgaccatccatcgaacaggaaggatgacgggctccatggatctcccggccaagggcgggttcagcttcgacctgtgtcgcccgaacaacatgctggagaaaaacggactcaaggtcccgggattcaggaagaccgggacaaccatcgtcggccctcgttttcaggaatgannccttnctcctngccaaacacaagggccaacgaaaggcccccaaaatttgctgaaaaagaaactgggaagaaaaatcccccttttattggccaccccaaaatacttacctgcctgttggaagccaaggaaactgtcttgcgggaaaaccgaaagggcccggtttaacagaataatgggggggaggccttccccagagcttataagcgcctttcacacccgttttattgttccaaacacgggggcccggcgcaaaattctctaggaagatgttggtaaacaccctggagtcccctcttaaacaaccacttaccctcgtaaaaaagaagtaaacgacacccttgtctcttttaaaaagaggatattatctcaagatgggccccacctggttctcaaggtgggcccttatcccacccctagtgtgattttttctgggagtgggcacaagaaggggaaatttgggtaaccacggggggggccacacacacttatataccacacctgtgggtctgtattattctaacaacacggggagggggccaccggaagagagaaccgctctccaccttctattagccaccacccaagggggaggcctctcgaggctactacttttggggcgagcaacaatagataaatgaggatttttaaaacccgcagagtatatacaaaaaaaggccgcctccctcccgggggaggggggggtgaaccccgccacn

SEQ ID NO: 80650 - protein, 48 aa, Zea mays
  misc_feature: Ceres CLONE 1565991
  misc_feature: SWISSPROT Homolog: EC 3.4.25.1 Proteasome endopeptidase complex
MTGSMDLPAKGGFSFDLCRPNNMLEKNGLKVPGFRKTGTTIVGPRFQE

SEQ ID NO: 80651 - DNA, 825 bp, Zea mays
  misc_feature: Ceres CLONE 1565994
  misc_feature: Encodes the peptide sequence at SEQ ID NO. 80652
  misc_feature (696)..(696): n is a, c, t, g, unknown, or other
ctccccgcggtggcggccgctctagaactagtggatcccccgggctgcaggaattcgtctcacccctagaaaaaaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggacggcgcccaagaacagttcatctgcccatgcccacgatcccagtacaacacctagggcnagggtggtccgtggaccggcgcctctgtcgctggccctgtttcacgccgacgtcgacgacggcaggtcttcttcgtcccgggggtggagaccgacttcaggaccggcaagacccgtggttgaaaggcat

SEQ ID NO: 80652 - protein, 226 aa, Zea mays
  misc_feature: Ceres CLONE 1565994
  misc_feature (54)..(92): Pfam Name: CytB6-F_Fe-S Pfam Description: Cytochrome B6-F complex Fe-S subunit
  misc_feature (110)..(204): Pfam Name: Rieske Pfam Description: Rieske [2Fe-2S] domain
  misc_feature: SWISSPROT Homolog: EC 1.10.99.1 Plastoquinol--plastocyanin reductase
MATSAALSTAANPTQLCRSRASLGKPVKGLGLSMGRERAQRSIVCQAASSISADRVPDMEKRKLMNLLLLGAISLPTVGMVVPYGAFFVPAGSGNAGGGTYAKDKLGNDITVEAWLNTHGPNDRTLAQGLKGDPTYLVVEQDKTLATYGINAVCTHLGCVVPWTAPKNSSSAHAHDPSTTPRARVVRGPAPLSLALFHADVDDGRSSSSRGWRPTSGPARPVVERH

SEQ ID NO: 80653 - DNA, 863 bp, Zea mays
  misc_feature: Ceres CLONE 1565995
  misc_feature: Encodes the peptide sequence at SEQ ID NO. 80654
gagctccccgcggtggcggccgctctagaactagtggatcccccgggctgcaggaattcgtctcacccctagaaaaagcgccccaaacccagggcagagtcgcagggtgacggggagagcccatcatggcgccgcagcagccgtgaagcacaagagcttttctgcagcacgacggctttgtcctctctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaggccaagcgcgtctgcgcggacccctgcacgtcaaggtgaaaccatgttggagagcgggaccccgggacttcatttgggaacccgcaaaaagaggcccgcggactgctcgtcaggggcagcctggttccggctccatccaaaggcgttttctgggaaaggttaaaaaaccttggcgcaaaaaaggaaaaagcccgggcccttttttcaaaaaggccccgggaaaaaaaaggcgccccccaatgaaccccggcacattaaaacaaaaagttttttggggggcaaca

SEQ ID NO: 80654 - protein, 142 aa, Zea mays
  misc_feature: Ceres CLONE 1565995
METAAVAAAGAGRRIMVAVDEGEESLHALNWCLANVVSPAGGDTLVLVHARRPRPVYAAMDSAGYMMTSDVLASVERHANAVSAAAVDRPSASARTPARQGETMLESGTPGLHLGTRKKRPADCSSGAAWFRLHPKAFSGKG

SEQ ID NO: 80655 - DNA, 1220 bp, Zea mays
  misc_feature: Ceres CLONE 1566003
  misc_feature: Encodes the peptide sequence at SEQ ID NO. 80656
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1220)..(1220): n is a, c, t, g, unknown, or other
aggggggcttcaatatccttaatctcacccacacctacaaaagtaaaaaacaataaaacctnnnntnnnnnnnaacacaccgcggtggcggccgctctagaacagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactactagaagatcgtgcgcgacacctgccgtgagaacccggctccctccaaccacgtggggcctcgacgcccaaccgctgcaaggtgcctggtgaaaatcgaagcagcagtccccccaacatttccgcagggcgttgcaccggggcactttcactgaagccggcccccagggaaaattgggcgccggggccaaccagggggcccacaatgttgtcggggttacgctctacccgaaacgagaacccccccgcaagcctttattggtccggtttctaaccccaacggtggctttgggtccaatccgaagacctttgggggtggttcgtccgctctcttcaagcctgataaaggtatgtggcgggcagtagagaaaaactgggggcacacccccgtggtcgctccacctgaggggtttgtgagagaggcgcctcataaaaacgggggctaagaggaaacaccccaatgagtgttaaaccgggggggggaaaaataacgcggtgggaaaccactaaggtggggcgggggccgccccatgaggagggtgccccggttacctcccgcgtgtgcgcacaccccggagagggcttttgttgtgttgccccccccatatgcaaggagaaaaaagaacggtgttatccccaatatgataatgaagagctctacgctgcgtcaagactgtagaagggggagatagggttcataataaagccccagtgtgaattcctatgagagagattcacctccaccaggaggagaagaacgtatattccttagcatataggaggn

SEQ ID NO: 80656 - protein, 67 aa, Zea mays
  misc_feature: Ceres CLONE 1566003
  misc_feature (4)..(68): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKATVDY

SEQ ID NO: 80657 - DNA, 779 bp, Zea mays
  misc_feature: Ceres CLONE 1566004
  misc_feature: Translation starting site: 148
  misc_feature (334)..(334): n is a, c, t, g, unknown, or other
  misc_feature (368)..(368): n is a, c, t, g, unknown, or other
  misc_feature (398)..(398): n is a, c, t, g, unknown, or other
tggagtccccgcggtggcggccgctctagaactagtggatcccccgggctgcaggaattcgtctccccctagaaaaaaagcacgtctgtttctccccagctccaagccggacgacgcagcgtagcagcagagagccagagaccagagatggccgccctcgccgccgcctccacgggccgccttcgccgcgaagccgcgcgcgcgcctctccgtggcctgctccgccgccccggcgacagcagcagcgtgtcgctcgcgtcctccgtgagacttctccccgcgctggcgctgtcgcggtgctgctgtctcgggcgcacctcccctcgcccgcggncgcgaatcgcggggctgacccgtgcaggagtccnaggcgtcgcgaagcgcgagaagactcgatncagaagctcaccgcgtcgctgaagaagtacgcgcccgaaagcgcccccgcgtttggcattaaaggccaccatttgaaaaaaacaaaggcgcccgttttcgagaactaacgggaaagtccggggcctgctttggtggggggcccaaaaggccctgcccccaacccttaattttaaagggggggaaaccaggggggactggggggggaagtttttttcaccccggggggcgggggtttttctcttaaaaagccccgggggtggaatagggggggggtcccccaaggaaacctcccttttttgcgcttttaggggggaaaaaaaaaaaacccccccccgggggggggaattatatttttgtgggggtgggggtctctgcccccc

SEQ ID NO: 80658 - DNA, 881 bp, Zea mays
  misc_feature: Ceres CLONE 1566006
  misc_feature: Translation starting site: 180
  misc_feature: SWISSPROT Homolog: EC 3.2.1.22 Alpha-galactosidase
ggagctccccgcggtggcggccgctctagaactagtggatcccccgggctgcaggaattcgtctcacccctagaaaaagcgtgcccagtgtctgacaacgcgccccaaccccaaccccaacccagcggtcccagtcccccctccgttctctctgcactctgcagctgccggtgccggccatggcgcgcgccccgagctcgtggacgccgtccctcgccatggtgctcctcgtcgtggccgccgcggccgtggtcgcgtcgtcagaggcggccagggtgcccgccgccgtcggcaactggacgggggaggagctgcgcggggccgcggcgaggcggggcggccggcgctcccggcgccgcgcgttcgagaacggcctcggccggacgccgcagatggggtggaatagctggaaccacttcggctgcgggatcaacgagaacctcatcaagcagacagctgatgcgctggtcaacaccggtctggcaaagctgggctacgagtatgtcaacatagatgattgctgggcggagtctgacagggactaccagggaagcttcgttgcaaacagacaaaaccttcccctctgggatcaaaggcgctcgcggaatacgtgcacgcccaagggggctcaagcttgggcatctacaacgaagctgggacccggacctgcaacccaaaaatgccaaggtcattttgacccccaagaagcaaggactttaaaaaatttttcgtcctgggggaattcgattttttttgaaaataaaaaaattggcaaacaacccccgggggggaacgttctttgggggggtgtttcccgaaaaataaacgcaccgcctttaaaaaacattttgggggaaaaggggcattttttgtttctcccg

SEQ ID NO: 80659 - DNA, 831 bp, Zea mays
  misc_feature: Ceres CLONE 1566008
  misc_feature: Encodes the peptide sequence at SEQ ID NO. 80660
  misc_feature (451)..(451): n is a, c, t, g, unknown, or other
  misc_feature (582)..(582): n is a, c, t, g, unknown, or other
ctccccgcggtggcggccgctctagaactagtggatcccccgggctgcaggaattcgtctcacccctagaaaaactcgtccaaaaccctagcccttgcgccgccgcctcctccgccacccagcgctcgagctcctcgcgtcctgcgagcgcgcgccgcaacgccaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccataggggcactccctgcttccgtggttatggcaggcgtaatggtgagcgcangaggaagtctgtccgtggttgcatcgtgagccaagacctatctgttatcaacttggtgattgtgaagaaaggtgagaatgatctgcctggtctgactgacactgagaagccaaggatgaggggtcccaagnggccctcaagatcagaaagctgttcaacttaacagggatgatgatgtacgcaagtacgtgtacacataccgcaggacatcactacccagaacggcagaaggtcagcaggcaccctagaatccaacgctggtgacacccttgacctcagaaggaacgtggctaaatccctgacagaagaagagataacttgaagaagtctgaggctgctgagtaccagagcttcctgcccaaagctgaagggacagaggg

SEQ ID NO: 80660 - protein, 148 aa, Zea mays
  misc_feature: Ceres CLONE 1566008
  misc_feature (1)..(129): Pfam Name: Ribosomal_S6e Pfam Description: Ribosomal protein S6e
  misc_feature (95)..(95): Xaa is any aa, unknown, or other
  misc_feature (139)..(139): Xaa is any aa, unknown, or other
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERXRKSVRGCIVSQDLSVINLVIVKKGENDLPGLTDTEKPRMRGPKXPSRSESCST

SEQ ID NO: 80661 - DNA, 868 bp, Zea mays
  misc_feature: Ceres CLONE 1566009
  misc_feature: Translation starting site: 738
  misc_feature (868)..(868): n is a, c, t, g, unknown, or other
ctccccgcggtggcggccgctctagaactagtggatcccccgggctgcaggaattcgtctcacccctagaaaaaaaacccccggcacctgtccgaattccagccgcccacctcacgcaagcggcaagcccacgggcgctctctctccccctgcgcctcgtcgcctctccaatccctctcgtcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttcccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgcccatatatgattatgcacttgatctcatcttagacattgagtcttctaatgatgacggggttaccgaggagcaaaatgatttatcagtcatctgcagaaatgctgtacggttttaatcatgcacgatacaatttaacccagcagggtctagctgcaaaggtgtgagaaagtcagaactn

SEQ ID NO: 80662 - DNA, 841 bp, Zea mays
  misc_feature: Ceres CLONE 1566014
  misc_feature: Encodes the peptide sequence at SEQ ID NO. 80663
  misc_feature (695)..(695): n is a, c, t, g, unknown, or other
ccccgcggtggcggccgctctagaactagtggatcccccgggctgcaggaattcgtctcacccctagaaaaagcccaacagccaatccacacctcgcttgcgttgtcctcgccctgatccggttcccccgttcctcgcctcctctgacccaaattgagccaagcgaagccgtgcccgtgatccggtccatgcgcggagcgtggtagccggattctatcgccgtcgcctccccttcgccgccattttccagtcgccgggatcagccgagttggatctcgaggcataaagcgttgcgggcgcccggcgaggatacgatgcctgcggtgctcgccgcattcgctaccctccgagccgccgctgccatcgcctccggggactcctccttcccctgttcccatcgcctcaagcatcgttttagtagtagtaattttagtagtagtaattgtcattgacctttgcgttccctccgtcgcgcacgctcctcggctcggtcctcaccttcgcatctcggttttggtctggttgtgctcgatccgaagcttactttggctttgcagcttctctccttgtcgaagtttggtgtctgggatcgacctgcagatcggaaagaaacaaggtagtcattatcaccttacagataagagaaacttctctttgtaatttgggatcaagcctgtggatggaccaaccctcgngggacttcagtgctgaaagtgttagcagcaactcaggtctctggcaaagcacctgtttaaatcctggttgccagcatggctgtgctttgctgggaagataattatgtcaaggccgtaaatatctcatgggcaagattgatttggga

SEQ ID NO: 80663 - protein, 38 aa, Zea mays
  misc_feature: Ceres CLONE 1566014
  misc_feature (6)..(6): Xaa is any aa, unknown, or other
MDQPSXDFSAESVSSNSGLWQSTCLNPGCQHGCALLGR

SEQ ID NO: 80664 - DNA, 1123 bp, Zea mays
  misc_feature: Ceres CLONE 1566015
  misc_feature: Encodes the peptide sequence at SEQ ID NO. 80665
aaataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttttcgaaacaaataaaaaggaaaaaaaaaaaaaaaa

SEQ ID NO: 80665 - protein, 156 aa, Zea mays
  misc_feature: Ceres CLONE 1566015
  misc_feature (1)..(150): Pfam Name: Ribosomal_S7 Pfam Description: Ribosomal protein S7p/S5e
MSRRGTAEKRTAKSDPIFRNRLVNMVVNRIMKDGKKSLAYQILYRAVKKIQQKTETNPLLVLRQAIRRVTPNIGVKTRRNKKGSTRKVPIEIGSKQGRALAIRWLLEASQKRPGRNMAFKLSSELVDAAKGSGGAIRKKEATHRMAEANRALAHFR

SEQ ID NO: 80666 - DNA, 857 bp, Zea mays
  misc_feature: Ceres CLONE 1566016
  misc_feature: Encodes the peptide sequence at SEQ ID NO. 80667
ggccgctctagaactagtggatcccccgggctgcaggaattcgtctcacccctagaaaaaacccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctcctcaagtacgactcgattgctcggcaccttcaagggccgacgtcaaagatcgtggacgacacgaccatcagcgtcgacggaaagcccatcacggtcgtctccagcagggacccgctcaagctcccatggggggtgagctcggcatttgacatcgtcatcgagggcaccggagtcttcgtccaacggccccggcgcccggaaaacaaatccaggccgggcgcgaaaaaaggggaatcttcacggcttcccgccaaggggcgccgaacatccccaacctatgttcggtcgggcgttcaagaagggcggacttaccaaccaccgcggtctgccgaaacatttttagggaacggggttccttggaacaaaccaatc

SEQ ID NO: 80667 - protein, 250 aa, Zea mays
  misc_feature: Ceres CLONE 1566016
  misc_feature (83)..(234): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSIARHLQGPTSKIVDDTTISVDGKPITVVSSRDPLKLPWGVSSAFDIVIEGTGVFVQRPRRPENKSRPGAKKGESSRLPAKGRRTSPTYVRSGVQEGRTYQPPRSAETFLGNGVPWNKPI

SEQ ID NO: 80668 - DNA, 1268 bp, Zea mays
  misc_feature: Ceres CLONE 1566020
  misc_feature: Encodes the peptide sequence at SEQ ID NO. 80669
  misc_feature (66)..(66): n is a, c, t, g, unknown, or other
  misc_feature (72)..(72): n is a, c, t, g, unknown, or other
  misc_feature (73)..(73): n is a, c, t, g, unknown, or other
  misc_feature (491)..(491): n is a, c, t, g, unknown, or other
  misc_feature (1015)..(1015): n is a, c, t, g, unknown, or other
aattattttttttttagctcacatacacccataaatattattcctttttatcctaaccaaaaaccnacaacnnaaaccggaactcaccgcggtggcggccgttctagaactagtggatcccccgggctgtaggaattcgtctcacccctagaaaaaatcttacagccagccccacatcacggagcatcccccttaataacagcaaactaccacacccatgtccacctccgtatcctccgacgccgttgccgctctcgtcccacccctcaccggccgccggtcgccgccggcatctcgcgtaccccacatttgccgcacaagaatcagatccaaaccccgtatcttctcttcttccccctcctttcccattgtccccgccgctgccatggccccccgggaggggcggcccccaacccccttctatgacgggggccaaagaagaaagtgggtcttcttcgcactaccgaggaggatttgtgcccccccccccncaaaaaaaaactggggtaacctgtacccagaaagtatcatccgccccaaaagggggggcccttcaaccgccaagggctcttcctgggcgggattccctccttccgaggggcagctacaagaaaagctgcaaacgaaagccccgccggtaaacccttggaatatcaggtggggaaacttgcgagacaaaggtggggataccatatctttttctggggctggggattgaaagaaggggtttccttaggcctcccaagggggaacccccttgttgggagaaataacgagaccttatccatgaggctatctccttccctaaaaagaaactgaggggattttgttttcttccaccaccaaagagggttgcgcccacaaaaagatcctcccttcactcgtgggacaaaaaagatgttgttattactcgcccccgtctaaaacaataaataagtgcgcgttctgattttcctggctctttaaagagagaagaagctcggcctccgaaagagatgcttttagcgcagaggangggggtgggccatgtacacaaccaaacacacttggtgttcacatagaaaagacgcgggggttgatataatacccctcaatgtgtataccatcgtgcgccaacggaggacaaatatccctctaataggtgtagagggatagtttcagagcgttattctgtgggggaagcggggtaaacctctttagtgtagcggaaaagatgggtggggtgtttcttcctgaacccgttggagcacccgtctcatgtgtttgtg

SEQ ID NO: 80669 - protein, 110 aa, Zea mays
  misc_feature: Ceres CLONE 1566020
  misc_feature (36)..(36): Xaa is any aa, unknown, or other
MAPREGRPPTPFYDGGQRRKWVFFALPRRICAPPPXKKNWGNLYPESIIRPKRGGPSTAKGSSWAGFPPSEGQLQEKLQTKAPPVNPWNIRWGNLRDKGGDTISFSGAGD

SEQ ID NO: 80670 - DNA, 936 bp, Zea mays
  misc_feature: Ceres CLONE 1566024
  misc_feature: Encodes the peptide sequence at SEQ ID NO. 80671
  misc_feature (785)..(785): n is a, c, t, g, unknown, or other
gaaagctggagctccccgcggtggcggccgctctagaactagtggatcccccgggctgcaggaattcgtctcacccctagaaaaaatcactccctcgcctcccccgctgtgccggcctgcacacacagacacacacaccacagcctacagcgcttctgctgctccagctcctcgtactaccgcgcccgcgcgctgctcgttccccggcctctgcttgcttggctcgtcgagcccagaggttggtggagaggcggggcttattgccccagataggagatcggggacgcgggagggcgcgtcgcgctcgggccggtctcggttcagcgggatcacttggccgtggccgtggtcgggcctccggcgcccatgtggtgagccaagccaggcttttgttgcccggggggcagagatcttgcacttgcagcagtgaagccggcggtgcggtccggtccggtccggagccgagcggcgcccaccgccatggccggcagcgacgaggtcaaccgcaacgagtgcaagggggcggtgccgatccacacatgggtcctcatctccaacttcaagctggcgtacaacatgctccggcgggcggacggcaccttcgaccgcgacctggccgagttcctggaccggcgggtggcgcccgacgcgcgggcccaggaaggggtctcctccttcgaccacgtgatcgacacgtcgaccggcctggaggtcgcaatcttacgcgccgccgcccaacacaacggcggcgggcggggccaccctgcccatcctgtactccctcngcggcacgcccggcggcggcggcgggggcgttcccggtcatccctctcctccaaggcgggagccttcgcgcactcgtcgtccgggcagggcattctactaaaccttgttgccggcggctgcaaagctgaccaaggcgctgggtggtttccc

SEQ ID NO: 80671 - protein, 152 aa, Zea mays
  misc_feature: Ceres CLONE 1566024
  misc_feature (102)..(102): Xaa is any aa, unknown, or other
MAGSDEVNRNECKGAVPIHTWVLISNFKLAYNMLRRADGTFDRDLAEFLDRRVAPDARAQEGVSSFDHVIDTSTGLEVAILRAAAQHNGGGRGHPAHPVLPXRHARRRRRGRSRSSLSSKAGAFAHSSSGQGILLNLVAGGCKADQGAGWFP

SEQ ID NO: 80672 - DNA, 948 bp, Zea mays
  misc_feature: Ceres CLONE 1566026
  misc_feature: Translation starting site: 502
  misc_feature: SWISSPROT Homolog: EC 2.6.1.62 Adenosylmethionine--8-amino-7-oxononanoate transaminase
gaaagctggagctccccgcggtggcggccgctctagaactagtggatcccccgggctgcaggaattcgtctcacccctagaaaaactataacatcaagccagatctagtatcactggccaaggctctttcaaacgcctacgtacccatcggggcaactcttgttagcccagagatatcagatgtgatccattcccagagcaataagcttggttcatttgctcatggattcacgtactccggccatccggttgcctgtgctgtggccattgaagctctgcaactttatcgcgaaagggacattcccggccatgtcaagcaaatagccccaaagttccaggacgggattagggcgctggcagacagtccgattataggggagatacgtggcttggggatgattatggggaccgaattcacaaacaacaagtcaccgactgatctgttccctgccgaatgggggggttggtgccatcttcggcgaagagtgccagaagcgcggcatgctggtgagggtcgctggcgacgccatcatgatgtcgccgacgctgatcatgacgcccggcgaagtcgacgagttggtgcgcatctacggggaagccctcaaggccacggagggagagggtggcagccctgcagtccaagaagaactagccaaaagggcggcgacgacgataacgataaacgccgggcgacgacggaccatatttgatgtacaggtgaataaacagccaagttcgtggctgcgagatggcatagcgcgcctgtctctgttcttgctctgtcgccagcaaatggtgggtcacctttttaacatgtcatagaggtttttttcttccctcctttcccttaggaatggcattactctcaaatgtttgctgccccgtagttccggagaaaaggggtgtcggggataccgggagatttatagggtccgatccatgcgtttt

SEQ ID NO: 80673 - DNA, 936 bp, Zea mays
  misc_feature: Ceres CLONE 1566027
  misc_feature: Encodes the peptide sequence at SEQ ID NO. 80674
  misc_feature (702)..(702): n is a, c, t, g, unknown, or other
  misc_feature (806)..(806): n is a, c, t, g, unknown, or other
ctggagctccccgcggtggcggccgctctagaactagtggatcccccgggctgcaggaattcgtctcacccctagaaaaaacaagcaccagaccaattaactagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctangcgccgagatcgtcggcaccttcatcctcgtctacaccgtcttctccgccaccgacgccaagaggaacgcccaggactcccatgtgccgatcctcgccctcttnccatcgggtttgccgtgttcctcgtccacctgccaccatccctatcaccggcacggcatcaaccccgcgcggagccttggcgccgccgtatttacaacagcacatgcctgggcttgacatgggatcctct

SEQ ID NO: 80674 - protein, 253 aa, Zea mays
  misc_feature: Ceres CLONE 1566027
  misc_feature (46)..(254): Pfam Name: MIP Pfam Description: Major intrinsic protein
  misc_feature (181)..(181): Xaa is any aa, unknown, or other
  misc_feature (215)..(215): Xaa is any aa, unknown, or other
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLXAEIVGTFILVYTVFSATDAKRNAQDSHVPILALXPSGLPCSSSTCHHPYHRHGINPARSLGAAVFTTAHAWA

SEQ ID NO: 80675 - DNA, 942 bp, Zea mays
  misc_feature: Ceres CLONE 1566028
  misc_feature: Encodes the peptide sequence at SEQ ID NO. 80676
gaaagctggagctccccgcggtggcggccgctctagaactagtggatcccccgggctgcaggaattcgtctcacccctagaaaaagaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgagggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcctggaagacctcggttctgctccttcaggttcaattgtactgctgcatgcctgtgctcacaaccctactggagtagatcctaccatcgaacagtgggaacagattaggcagctgatgagatcaaaatcactggctcccgttcttgacagtgcctatcaaggctttgcaagtggaagtcttgacaagatgctcagtcagtgcgtatgtttgttgtgctgatggtggtgaaactctcatggctcagagctacgctaagacatgggatttgttatggagagcgtgttgcgcctttag

SEQ ID NO: 80676 - protein, 242 aa, Zea mays
  misc_feature: Ceres CLONE 1566028
  misc_feature (33)..(241): Pfam Name: Aminotran_1_2 Pfam Description: Aminotransferase class I and II
  misc_feature: SWISSPROT Homolog: EC 2.6.1.1 Aspartate transaminase
MASQGSSVFAALEQAPEDPILGVTVAYNKDPSPVRVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLAPVLDSAYQGFASGSLDKMLSQCVCLLC

SEQ ID NO: 80677 - DNA, 955 bp, Zea mays
  misc_feature: Ceres CLONE 1566030
  misc_feature: Encodes the peptide sequence at SEQ ID NO. 80678
  misc_feature (817)..(817): n is a, c, t, g, unknown, or other
aagctggagctccccgcggtggcggccgctctagaatagtggatcccccgggctgcaggaattcgtctcacccctagaaaaaatccacccttcccctttctcttcgtctccgtccgctcccggcatcgtcccctcttccccgtctcgcggtcgccgcccacgggcttcgattgatcttcttccggtgctggtggcaggtggacggatcgtgtccttgcttggccgcccacagcagcaatggacgacggggacctggacttctccaacccggacacgtacctgtgcccggcgctcggcactgacccgcccagcagctgctccatggacagctacttcgacgagatcctcaaggacacggagcaccacgcctgcacgcacacccacacctgcaacccgccggtgcacgacctatcgcacacccacacctgcgtccacgtccacaccaagatcgtcgcggcctcgcccggcgacgacactgccgactcgccgtccgagaacacaccaacggcagcggcggcaacggcagcaacgccgcctccaagaagcgcccctcggggaaccgcgccgccgtcaggaagtaccgggagtagaataggcccccaccgcgtcgctggaggaggagggggtccatctcaaggcgctccaccagcacctcgtggaaaaagtcccgaagccacgccgcgctcgaagcggaagtgggcaaggctccgctgcctgctccgtcgacatcagggggagggatccaaggggaaaatttggcccgtttcccataccaaagggcgccccccagcggccaagaaaggcgatcctcgtgttncggggttgacacaagaaggggtcccctttccggggctccccgcccctgtttatcatggccccgcggaccttcagattgacacgatctaattgttttgtaccccccgtggatgtttggggccttgtgtggaggcccacg

SEQ ID NO: 80678 - protein, 222 aa, Zea mays
  misc_feature: Ceres CLONE 1566030
  misc_feature (194)..(194): Xaa is any aa, unknown, or other
MDDGDLDFSNPDTYLCPALGTDPPSSCSMDSYFDEILKDTEHHACTHTHTCNPPVHDLSHTHTCVHVHTKIVAASPGDDTADSPSENTPTAAAATAATPPPRSAPRGTAPPSGSTGSRIGPHRVAGGGGGPSQGAPPAPRGKSPEATPRSKRKWARLRCLLRRHQGEGSKGKIWPVSHTKGRPPAAKKGDPRVXGLTQEGVPFPGLPAPVYHGPADLQIDTI

SEQ ID NO: 80679 - DNA, 963 bp, Zea mays
  misc_feature: Ceres CLONE 1566031
  misc_feature: Encodes the peptide sequence at SEQ ID NO. 80680
  misc_feature (807)..(807): n is a, c, t, g, unknown, or other
  misc_feature (815)..(815): n is a, c, t, g, unknown, or other
  misc_feature (816)..(816): n is a, c, t, g, unknown, or other
  misc_feature (885)..(885): n is a, c, t, g, unknown, or other
  misc_feature (886)..(886): n is a, c, t, g, unknown, or other
  misc_feature (895)..(895): n is a, c, t, g, unknown, or other
  misc_feature (896)..(896): n is a, c, t, g, unknown, or other
caaagctggagctccccgcggtggcggccgctctagaactagtggatcccccgggctgcaggaattcgtctcacccctagaaaaatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgcacgtggagcttcctgctggcagtgttgttggaagtgcttccttgcggagacaatctcagattctctacagatatccatcactgaaagtagttaacttcagaggaaatgttcagacacggttaaggaaactcaaggaaggagatgtgtctgctacattgttggcgctggctggattaaggcggctaaatatggcagaaaatgcaacagctgtactatcagtggaagaaatgcttccggcagttgcccaaggtgctattggaatcgcttgccgaagcaacgatgacaaaatgatggagtatctgtcctcgttgaaccacgaggataccagactagctgtcgcatgcgaaagagaattcttggcagttcttgatggcaactgccgaactccaattgccgcctatgcttaccgtgacaaggacgggaactgctcattccggggtctactggcttcaccagacggatctaaagtatttgagacggcaagaagtggaccgtactctatcgacgacatggtcgagatgggcaaagacgctggccacgagctgtaggcgaatgctgggcctggcttcttngatagccnntcatgaacagaatgtgcgggcatgcgcgatttcagttggcaccctttcggttgaaaaacaggcaatagnnttttttttnngagggggtttttttttgtttcctcttttttcccctactactagtccctgctagagccctgtactctg

SEQ ID NO: 80680 - protein, 216 aa, Zea mays
  misc_feature: Ceres CLONE 1566031
  misc_feature (1)..(136): Pfam Name: Porphobil_deam Pfam Description: Porphobilinogen deaminase, dipyromethane cofactor binding domain
  misc_feature (144)..(217): Pfam Name: Porphobil_deamC Pfam Description: Porphobilinogen deaminase, C-terminal domain
  misc_feature: SWISSPROT Homolog: EC 2.5.1.61 Hydroxymethylbilane synthase
MKDVPTYLPEGTILPCNLPREDVRDAFICLTANSHVELPAGSVVGSASLRRQSQILYRYPSLKVVNFRGNVQTRLRKLKEGDVSATLLALAGLRRLNMAENATAVLSVEEMLPAVAQGAIGIACRSNDDKMMEYLSSLNHEDTRLAVACEREFLAVLDGNCRTPIAAYAYRDKDGNCSFRGLLASPDGSKVFETARSGPYSIDDMVEMGKDAGHEL

SEQ ID NO: 80681 - DNA, 1215 bp, Zea mays
  misc_feature: Ceres CLONE 1566033
  misc_feature: Encodes the peptide sequence at SEQ ID NO. 80682
  misc_feature (47)..(47): n is a, c, t, g, unknown, or other
  misc_feature (53)..(53): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (966)..(966): n is a, c, t, g, unknown, or other
  misc_feature (1066)..(1066): n is a, c, t, g, unknown, or other
  misc_feature (1181)..(1181): n is a, c, t, g, unknown, or other
aacggtgggcatatcattgatcccaaattattctgttccttatcctnctttgnacggcncnnccaaaagtggagctccccgcggtggcggccgctctagaatagtggatcccccgggctgcaggaattcgtatcacccctagaaaaaccactacacacaaacacacaatggcaccagaaacgatgctcctcggcgtctgtgccgtgctgatggtggtcggcgtcacgaacgcggcggagggccaggtggcgtcggtcgtcgtgggcctggcgaggtgcgccgacagctcgaggaagaacatgaaggctgaggccggtttcaagggtcttcaggtggcgatcaagtacaagaacagcaactgcgagtaccagacaaaggccgtgagtgagatccaaagctccggagccttcagcgtaccactcgccgccgacctccactgcgccgactgctacgcgcagctccacagctcctcccacaacgcgccttgccctgggcaggagccgtccaggatcgcgcccatgtcaggcggcaacttcggtcgccgtgcctggcaagatgcactacccgttccgctgagtgcgcgtccgcgttttctcggctccccgatcaagaaagaccttgttagatccactttcacaaggtgacccctgcctggcggccggaattaccccccgggggccttgacccacatcaatgccgccaggtggccgggaattcccacccccgggggccccgaatacacatcaaatgacttgctcgcccgggagttatccaaccccttccccaagtccggggaaataaccatcccgcttcaccaccgtcccatgtggtaaccgggcgccagactccaaagaccctaatctcccctaatcttaacctatatccttcacccgggtgaaatcacacgtagaggtttgtgtatgcaacaccacccgaattggctccgtaagccttgtataataacanggacagaggggctatccgcgctagtacttatctttaattttatccatacgttgcaactcttgctaacatatagttgacggctcttctacgcgttacgtgncaaaaactccatactcgtggcttgcaataatatagacccccgcggccaggccctctgtaccttttattgacccgggcatccgacatatattacgttgttataccactttgaatcntgggccctccgagagaaggatcttatctagtgtg

SEQ ID NO: 80682 - protein, 158 aa, Zea mays
  misc_feature: Ceres CLONE 1566033
  misc_feature (31)..(158): Pfam Name: DUF1210 Pfam Description: Protein of unknown function (DUF1210)
MAPETMLLGVCAVLMVVGVTNAAEGQVASVVVGLARCADSSRKNMKAEAGFKGLQVAIKYKNSNCEYQTKAVSEIQSSGAFSVPLAADLHCADCYAQLHSSSHNAPCPGQEPSRIAPMSGGNFGRRAWQDALPVPLSARPRFLGSPIKKDLVRSTFTR

SEQ ID NO: 80683 - DNA, 964 bp, Zea mays
  misc_feature: Ceres CLONE 1566037
  misc_feature: Encodes the peptide sequence at SEQ ID NO. 80684
  misc_feature (31)..(31): n is a, c, t, g, unknown, or other
aaagctggagctccccgcggtggcggccgcngtcgaactagtggatcccccgggctgcgtacatcgtctcacccctagaaaaaacccggcagtcacacctcgaaagcaacagctagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggacatcggcgggctggaccacagcatccccgccgccacccacggccagttcctccccggcgccgacgacacctgggtgcccaaccccggcttcgaggtccccaaccccttcatgcccggcgcggccactccctgaacacgtacccgcgctggcgaaggtggctcacggtcgatctgatcgtcgagcgccgccgcccgccctgaacgaatatactactagctactctcggtctgctacgtatagctagcttagcttagctagccgtgcttgcctgctgcatgtacgcatgtcttcgtgtggcccgtcccacgtctctcttctagtctctgtgcactttacggctcagtgaagttacctgaatgtgccccgcgcaatgcgtaacaaatcttttggggccgtaagtgttgctgggaaatgtaccatgtatgtaaccccttgtttctcggccccctaaggtaaaaccaaaataagggggatgggaaaaaaaaaatcctcggtggctttatcttttatgtggggggggatttagataacaaggtgcgaatgaggtagtaccaaccacaa

SEQ ID NO: 80684 - protein, 110 aa, Zea mays
  misc_feature: Ceres CLONE 1566037
MARWSSSALVAVLVVLAAAVACSAARPVPAQQQQAVEDVKRPDTLHEGTVLIPGMGRYEIGSHYIPDIGGLDHSIPAATHGQFLPGADDTWVPNPGFEVPNPFMPGAATP

SEQ ID NO: 80685 - DNA, 980 bp, Zea mays
  misc_feature: Ceres CLONE 1566038
  misc_feature: Encodes the peptide sequence at SEQ ID NO. 80686
atagctggagctccccgcggtggcggccgctttcgaactagtggatcccccgggctgcttgacattcgtctcacccctagaaaaagtggcgtcgtctccgcttttactagatcatcagtagccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctacgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactctttctttggaacgaaggaggcatttggctttgcgccttcctggttattatggcttaggtacagcacctttatgttgttgtatcctactgggatctctagtgaagttgggctggatcacattgccttgccttacatgtaagcatccgaaaaatactggtattagaatgccaaacaatgggaacttctcatacaattacttcttattcatctggccttgccctccctgatttatgtttccaggaagcccccccagttaccgtttcattgctctcccaaagggatgagagcgccttcaaaaggccaaaacgggggtggttattccccgccagcaaagggaataccgggggactgggtttgccggaagggatatcccaaaccggggccaagttttctgacatcccccaattaaaat

SEQ ID NO: 80686 - protein, 165 aa, Zea mays
  misc_feature: Ceres CLONE 1566038
  misc_feature (55)..(166): Pfam Name: PTPLA Pfam Description: Protein tyrosine phosphatase-like protein, PTPLA
MAGVGSALRRLYLSVYNWVVFFGWAQVLYYAVLTLRLSGHKAVYAAVERPLQFAQTAAIMEIVHGLVGLVRSPVSATLPQIGSRLFLTWGVLWSFPETQSHLLVTTLVISWSITEIIRYSFFGTKEAFGFAPSWLLWLRYSTFMLLYPTGISSEVGLDHIALPYM

SEQ ID NO: 80687 - DNA, 948 bp, Zea mays
  misc_feature: Ceres CLONE 1566039
  misc_feature: Translation starting site: 499
aaagctggagctccccgcggtggcggccgctctagaacagtggatcccccgggctgcttgaattcgtctcacccctagaaaaaacctcttcaatcccagtcccacacaaagtttctcctcgatcctcatctcctccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtgggtcgggtggccgccggtgagggcgtacaggaagaacaccttccaggcggcggcggcggccaagaaggtcgagcagatgcagaagcagcagcagcagggaggcctgtacgtgaaggtgagcatggacggcgcgccgtacctcaaggaggtggacctccggatgtacaaggggtacagggagctcagggaggctctggacgcgctcttcaccaactccttctccgcgggcggcgaggggggggggcgacacaccaggacggccttcgctacgaagacaagacgggggactcatgctccccggagacgtgccccggggatatgtcatctcttcgtgcagaagcccgggaaaatgagggctctgcccccggaggccggggatcgctgatcctacataaacaaggctacagaccgcccccctgggaaccggaatccagagcacacccggatcgacttgacaaggaaggagggggggaccctgggggcttgagctctccagggtggacaaaaaaagggtttttttgaaccc

SEQ ID NO: 80688 - DNA, 926 bp, Zea mays
  misc_feature: Ceres CLONE 1566040
  misc_feature: Translation starting site: 146
  misc_feature (762)..(762): n is a, c, t, g, unknown, or other
ctggagctccccgcggtggcggccgctctagaactagtggatcccccgggctgcaggaattcgtctcacccctagaaaaaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgccggaagcgctggggctgggcaactgggtgaaggcgcaggagtgggcggccgtccccggcgggcaggccacgtacctgggcgcccccggtgccgtggggcacgctgccgaaccatcctggcggtcgagttcgtggccatcgccttcgccgagcaccagcgcacaatgggagaggaccccgagaagagaagtaccccggcggcgccttcgacccgctcggcttctccagggaccccgccaagctcgaggagtacaagctcagggagatcaagacggccgcctcgccatgctggncttcgtcggcttctgcgtccagcagtcggcgtacccgggcacggcccgctcgagaactcggcgccccactcggcgacccctggacacacatcggcgaatcatcatccctagatgatctcccctgaacggttaattgttgatttttcgactagcactagcactgc

SEQ ID NO: 80689 - DNA, 930 bp, Zea mays
  misc_feature: Ceres CLONE 1566042
  misc_feature: SWISSPROT Homolog: EC 1.11.1.7 Peroxidase
ctggagctccccgcggtggcggccgctctagaactagtggatcccccgggctgcaggaattcgtctcacccctagaaaaaatccccaacagcccgagcctgaggttcttcgacgtggtggaccgcgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgaggacatggttgtcctctccggcgcacacaccatcggcgtctcgcactgcagcagcttcgccggaattaacaacacaggcgaccggctctacaacttcagtggctcatccgacgggattgatcctgcgctgagcaaagcctacgcgttcctcctcaagagcatttgcccgtcaaacagcggccggttcttccccaacacgacgacgttcatggacctcatcacgccggccaagttcgacaacaagtactacgtcggcctcaccaacaacctgggcctcttcgagtcggacgcggcgctgctgaccaacgcaaccttgaaagcgctggtcgactcctcgtgcgcagcgaggccccgtggtaagacaaatttcgcaaatccatgctcaagatggggcagatcgaggtgctcacggggacccagggcgaaatcagcggcactggcaggtcatcaaccctcttatggcgccgcccaatcgtccttgtccgttagccaggttcattaggaaccctggaatggctcaagccaacccattcccgtgtgtctgcaggggtttgggtgtggaacaaaaaaaa

SEQ ID NO: 80690 - DNA, 1045 bp, Zea mays
  misc_feature: Ceres CLONE 1566043
  misc_feature: Encodes the peptide sequence at SEQ ID NO. 80691
gatagctggagctccccgcggtggcggccgctctacaactagtggatcccccgggctgcatgaattcagtctcacccctagaaaaaagcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgcttggccacaaccccgtccacaagaaggtgcccgtgctcgtccacggcggccgcgcgctcccggagtccgtcatgatcctccagtaccttgacgacgcctggccggagacccgcccgctgctcccctccgacgccttcgaccgcgcgctcgcgcggttctggtgccacttcgccgacgacaagctcgggccggcggtgggcgcggtgttcgcgtccaccgggggaggcccatgatggctgttgttccgcaagtggactaggaacctgggcgcggattagattctgaatttctgggaccggctctgttccggggccagcgtctttctttccgttggccacagagacggggctctgcttggaacctacgtcctggggtgttggtggatgccagctggtctcgcgccctgcccccgggaaacaagggacgggggcggcgcccttcgtggttgtgccccaacagattttgctggggtcttcccccgcctcggggttgggtccacttctcttttggccccagggccaaggtcctcgtggggtacctctcctcccatttaaagacggtatggcttatatacctccccccgcggttttgtgtgcctgcgtttcccccccccgaccagtggatagagttcttcgtccccgggtctggcttcctccctcggctttagtgtggtgggagcacagcaacagagtttcgcaaaaagttccgctctgttttgtttgggcctgtgtgcctcacccgtatctcgaattatgggg

SEQ ID NO: 80691 - protein, 132 aa, Zea mays
  misc_feature: Ceres CLONE 1566043
  misc_feature (14)..(87): Pfam Name: GST_N Pfam Description: Glutathione S-transferase, N-terminal domain
  misc_feature: SWISSPROT Homolog: EC 2.5.1.18 Glutathione transferase
MEKTSENAIPPAASPLMLFGSWASSYTHRVQLALRLKGLEYDYVEEDLGNKSDELLGHNPVHKKVPVLVHGGRALPESVMILQYLDDAWPETRPLLPSDAFDRALARFWCHFADDKLGPAVGAVFASTGGGP

SEQ ID NO: 80692 - DNA, 961 bp, Zea mays
  misc_feature: Ceres CLONE 1566044
  misc_feature: Translation starting site: 322
catagctggagctccccgcggtggcggccgctctagaactagtggatcccccgggctgcaggaattcgtctcacccctagaaaaaagagcagagctgcctccagacgagacgaggaggacgcggcgccgttcgggcttggcagcaaccagcgtctagcgcagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggttgaactcatttcagcaggccaacaccagggtggcatgatcctgattgttccacagggggaccatgcagtaaggctagggaatgatgctagcgttgggcaggtggtggacgttgagaaaggggtcggagtatgctatcacattcagtgctgcccggacatgtgcacaactggagggactgaatgtttccgtggctaggtggcgtgtctcagacaatagacttggcagaagttgtacaactaaaaagcctggaatgcgtacccctttggctttttcagggaacgaaagaacaggccccttctttcattcttggaccccgggcagtggaggaagaatccaaacttgtggggcccttccccaaaacaaccgttgcccgtcaaaaaaagccttttccccccggacaaacccaagggaaaaggggggggcccgaaga

SEQ ID NO: 80693 - DNA, 956 bp, Zea mays
  misc_feature: Ceres CLONE 1566051
  misc_feature: Encodes the peptide sequence at SEQ ID NO. 80694
  misc_feature (823)..(823): n is a, c, t, g, unknown, or other
  misc_feature (898)..(898): n is a, c, t, g, unknown, or other
  misc_feature (899)..(899): n is a, c, t, g, unknown, or other
tagctggagctccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtcgggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaatgatgccgacaagctgcagacctccgacggctgggccaagttcaccgggggattcttcttcggcggcatctccggcgtgctctgggcctactttctcctctacgtgctcgacctcccntacttcttcaagtagaatcatcaaagatgcgtatatatatagctccggccgatcctctctctgctgcatggattnnttagggtggggtgggccctggttcatttcactccagcggtgatcagggccttggtta

SEQ ID NO: 80694 - protein, 204 aa, Zea mays
  misc_feature: Ceres CLONE 1566051
  misc_feature (44)..(202): Pfam Name: PsaL Pfam Description: Photosystem I reaction centre subunit XI
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGVASFNEGDPSTAPSLTLTGRKNDADKLQTSDGWAKFTGGFFFGGISGVLWAYFLLYVLDLPYFFK

SEQ ID NO: 80695 - DNA, 942 bp, Zea mays
  misc_feature: Ceres CLONE 1566052
  misc_feature: Encodes the peptide sequence at SEQ ID NO. 80696
  misc_feature (844)..(844): n is a, c, t, g, unknown, or other
  misc_feature (908)..(908): n is a, c, t, g, unknown, or other
ctggagctcaccgcggtggcggccgctctagaactagtggatcccccgggctgcaggaattcgtctcacccctagaaaaaacaaccacgcacgccagcccgctccagcctccaacccattcttcggcggttcggcccggcctgcaccctgcagccaccaagcaaacccagtgctctgctttctgcattcccccccgccgccactccgtcgggcttgatgagcctctgctccaagctcttcgcgttgctccgcaagtcccgcgccctcgccaccagcaccgccgccgcagccgccgcgacaacctccgcgacggcgtcggccaacgggatggaggaggctgtcgccgcggcgggcccgctgcgcacgcgcgtctgcatcatcggcagcggcccagccgcgcacacggcggccgtctacgccgcgcgcgccgagctcaagcccgtcctcttcgagggctggctcgccaacgacatcgccgcgggtggacagctcaccaccaccaccgacgtcgagaacttcccgggcttccccgacggcatcctcggcgccgacctcatggatcgctgccgcgcgcagtcgctcaggttcgggaccaagatcctcaccgagaccgtcaccaccgtggacttctccgccccgcccttccgtgtcgcctccgacgacaccgttgtgcacgccgactccgtcgtcgtcgccacgggcgccgtcgcgcgcatgctgcacttcgccggctccgacgccttctggaaacggggcatctccgcctgcgccgtctgcgacggggctgcgcctatcttccggaacagcccatcgccgtcgtcggaagcggggactccgccatggnagaagctaaactcctcaccaagtacggctcgcaagttacatcatccaccgccgcagcgactccngggcgtccagatcatgcaagtgcggatggcggcc

SEQ ID NO: 80696 - protein, 242 aa, Zea mays
  misc_feature: Ceres CLONE 1566052
  misc_feature (51)..(223): Pfam Name: Pyr_redox_2 Pfam Description: Pyridine nucleotide-disulphide oxidoreductase
  misc_feature: SWISSPROT Homolog: EC 1.8.1.9 Thioredoxin-disulfide reductase
  misc_feature (210)..(210): Xaa is any aa, unknown, or other
  misc_feature (231)..(231): Xaa is any aa, unknown, or other
MSLCSKLFALLRKSRALATSTAAAAAATTSATASANGMEEAVAAAGPLRTRVCIIGSGPAAHTAAVYAARAELKPVLFEGWLANDIAAGGQLTTTTDVENFPGFPDGILGADLMDRCRAQSLRFGTKILTETVTTVDFSAPPFRVASDDTVVHADSVVVATGAVARMLHFAGSDAFWKRGISACAVCDGAAPIFRNSPSPSSEAGTPPWXKLNSSPSTARKLHHPPPQRLXGVQIMQVRMAA

SEQ ID NO: 80697 - DNA, 968 bp, Zea mays
  misc_feature: Ceres CLONE 1566055
  misc_feature: Translation starting site: 246
  misc_feature (810)..(810): n is a, c, t, g, unknown, or other
  misc_feature (859)..(859): n is a, c, t, g, unknown, or other
ctggagctccccgcggtggcggccgctctagaactagtggatcccccgggctgcaggaattcgtctcacccctagaaaaaaaccccccacacagactatcgagccgcgcgcggaggcgaggcgttcgcacacctcgtccgcgcgtacttggcctctccccgcgcctaccaccgttccgttgcgcccgctaacgatcacgcgtgtccggcgggagagagagtaggtagggagaggacgggacatggatgctcgggttcacggagatgtcgtggtcgtcggcggaggcgcaggcgccgccggagcagctgtgcgaatgggtggcggccgtcgcggcggctcgccaagggacggagacgccgctgacagcagtggccgaagcgttcgatgagctggcgcgcaggatggacgccgaccgcggcgagctccgcgtcacgcccttcagcgacatcctgtgccctcgtctccgtgctctgcaacaacctcaggatggccttcaggttcgccagagatggagtacctcaccaagatcttccttcttgatagaaaagaacacagcgcaccgaaaaaaaagaactttggaattgcaatcttctccttcagagaagctccaggatagaaagttgccgcgctgatatgactcgcggtctattgcgtgcagactcgttcaccatttcaatggtgaacgatctcatcggtgacagcgagtcgtaacgcacgctgagcgacatcctcgacgaagacatccataacgactgcgtgatgatgcatgtgatgcacgtcctgaacatgctcaggttcgtctcggacgcngactcatacatgactactcgtagcatgcctcacaacagaaggttcatgnatgatgctgctacacagctttacgtgatgtgtgtcaaccgcttctatctgtgccatacgaaagctgcttgagctgcatgtacccctcgagccaggtgcagtagtacgcc

SEQ ID NO: 80698 - DNA, 1025 bp, Zea mays
  misc_feature: Ceres CLONE 1566056
  misc_feature: Encodes the peptide sequence at SEQ ID NO. 80699
  misc_feature (803)..(803): n is a, c, t, g, unknown, or other
  misc_feature (986)..(986): n is a, c, t, g, unknown, or other
tattttgttacatgtttttaatgactcctcctataatataccgtgtgttgtggtgggtgttctcatgtgggttcgctcggtggtagtgtctcaaagctggagctccccgcggtggcggccgctctagaactagtggatcccccgggctgcaggatattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaacaaaccggcgtccctcgtggtggcaacgggcccgcgcggcgcccgcccggggcccatcttgccctccatgtccatgtcctcctccaacccggcctaaaaactggagtccttcccgggtcacccccataaagggatccctccggggccccgcgaagaattaacccgtggtttcactttaccccacctttttttcccttttaccacaaaaccaaagaactcactctactttggggggccccccggccccccccggggggggtttttccctgcgcccagtaataaaaaatcctcccaaaaaaaaaacccccccccccgtgaaaacaaaaaccctttccccttctgggggaggaaacaaacacttcgtgtgtttgtctcccgcccgggggaggggagctgttcacattactatctatgggtggggagaaaaacaaaatttttgttttttctcttacccataggggggggggtgtgtggtaanaaacatcatggtgatacaaccctatttttttcttgaataaagaaaaaattggtttggggggtgaggggggcgcaccaaaaacaatattgtagcccacgaaccactccccttgtgtgttttttcaatttcaaaaacacaacaacacacccccttttccctatttcactcacaataacaaaaagntaaataaaaatacctcttctgtcgcgggtccccccccaa

SEQ ID NO: 80699 - protein, 56 aa, Zea mays
  misc_feature: Ceres CLONE 1566056
MATAAASSLLKSSFAGSRLPAATRNKPASLVVATGPRGARPGPILPSMSMSSSNPA

SEQ ID NO: 80700 - DNA, 972 bp, Zea mays
  misc_feature: Ceres CLONE 1566057
  misc_feature: Encodes the peptide sequence at SEQ ID NO. 80701
ctggagctccccgcggtggcggccgctctagaactagtggatcccccgggctgcaggaattcgtctcacccctagaaaaagcacttgtgccttctgccttgtgcgcagcggagtctttggactcggtaatcccggtcctgtcctcccccgaccaaacacagtccctggatccatgggtgtcgaggaggagcgcgacggcgaggagcaacgccgccccctcctctcctccaccccgccagccgcggcggacccgcagcagcaacagtaccagttcctgggccggagcacctcttcagtgctgcgcggcggtggcgggggctgggaagggcctgaggtgagcgccgacgaggtcaggtcggccgctggcttccacacgttccagggcccacctcccaacggcgacaacgcctatgcttacccgccgtccattcatagcgccatgctctccccgtccccatctcatgccccaccgtctccccatccaaatgaagggttggcgattgttcctcaagggccatatccgtatggtggcagttaccaaccttctgagagcgtcgggagggatgtactggatgaaggtggagatccgacagctactcattgaccatattggacatcgatgctgttggggaagtcaccctgcccgcacatggaaaattacctccattgaggactgcaatgtctatgttggcaccttggaaaccttcatcgaggaaagatacattattacaaaaaaggagccctttgaaagtgggaatatagatggaagagaaaaaggtcctttgcctggattgtgggaaactgatttgaggtctaaagttcctgtactttttgtaccagagaaagagtgacccgtcagattcacattcagattatattgaaagtgctcagattgggagggtcgtggagagaaaccatgcctacatgcaatgctggttcaagctcacgggttttataagcaattcaaatgac

SEQ ID NO: 80701 - protein, 143 aa, Zea mays
  misc_feature: Ceres CLONE 1566057
MGVEEERDGEEQRRPLLSSTPPAAADPQQQQYQFLGRSTSSVLRGGGGGWEGPEVSADEVRSAAGFHTFQGPPPNGDNAYAYPPSIHSAMLSPSPSHAPPSPHPNEGLAIVPQGPYPYGGSYQPSESVGRDVLDEGGDPTATH

SEQ ID NO: 80702 - DNA, 930 bp, Zea mays
  misc_feature: Ceres CLONE 1566058
  misc_feature: Encodes the peptide sequence at SEQ ID NO. 80703
  misc_feature (400)..(400): n is a, c, t, g, unknown, or other
tggagctccccgcggtggcggccgctctagaactagtggatcccccgggctgcaggaattcgtctcacccctagaaaaatcgccaccagtggccgcgtcctcttcatttccgccatccgtatcgtctccctagggtttggcactttggccgccgccatggcgtcggcgtcgcgtgcgctcctcctctcccgtgcgctccaggccggcgcgtctcgccgcgtccccgccctcctgcgcccggtcgctgcggccgcgagcctcctcccagcggtggcggggccggcaggggccgccctcggcgctagggtgcggtgcttcgcgacccagccggcgacgtcctcgctgcgggactcgtccccaaactggagcaatcgcccgcccaaggagacgatcctcctcnacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtcccgctgggttcttcctgattcatacttggatgtcaaaaacaaggactattggagcgaacccttcataaatgggcaagctgttccttatgaatcctaaatatcatggaaaagtgggtgagaaaacaatggcccgggccaaatgaaaaaaaaccggcgcaaagaataggccctcgccaacttttgacaaggtcaagggaaccttttgaaagggagaaggggaaaacattgcccaaaactacccgaaaaccgaagatggggcccttcctgccccaaaagggtttcaattggccc

SEQ ID NO: 80703 - protein, 166 aa, Zea mays
  misc_feature: Ceres CLONE 1566058
  misc_feature (82)..(82): Xaa is any aa, unknown, or other
MASASRALLLSRALQAGASRRVPALLRPVAAAASLLPAVAGPAGAALGARVRCFATQPATSSLRDSSPNWSNRPPKETILLXGCDFEHWLVIMEPPPGDASNPDITRDEIIDSYIKTLAQVVGSEEEARQKIYSVSTRHYFGFGALVSEELSYKLKEIPKVPLGSS

SEQ ID NO: 80704 - DNA, 962 bp, Zea mays
  misc_feature: Ceres CLONE 1566064
  misc_feature: Encodes the peptide sequence at SEQ ID NO. 80705
  misc_feature (359)..(359): n is a, c, t, g, unknown, or other
ctccccgcggtggcggccgctctagaactagtggatcccccgggctgcaggaattcgtctcacccctagaaaaactctttcaacttcgttcgcaagaagctcagaagtcagatcagaagccgccgaggggaggcgccgacgccgagtttttgctccatcccgcatccaccgccagaatgtttctcacgaggacggagtacgaccgcggggtgaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctggaaccnagcagtgtgggaaaaatcatggaaattgatgagcacataggctgtgccatgagtgggcttattgctgatgctagaacactagtcgagcatgctcgtgttgaaacccagaatcataggttctcataccgggagcccaatgaccgtagaatcttcacaccagcctttttgtgacttacctcccgccctttggcgaaaggggacaaaaaattcatggtcacggcccatttgggaagcccctcccccaatttgctggaacccaatgaaaatggagccttgccctgtacttaccccgaccccatttgggaatctttttggggaatgccaccccaaaggcaattgggtttcggggccccaaaagagactaaaaacccctctggggaggaaaataaaaaaagggaattggccctttggagggggggagaaaaataacccttttttttttttaaaaaggttttgggggggaaagaggggcccccaaacacgctctttttgtgcgggggggtgccccaaaaaccccccttcccccccccccaggagggagaaaccctcttccggggggggggaaaaaccctcgcggccgcgcgtgttttttttctcaaccaa

SEQ ID NO: 80705 - protein, 117 aa, Zea mays
  misc_feature: Ceres CLONE 1566064
  misc_feature (31)..(117): Pfam Name: Proteasome Pfam Description: Proteasome A-type and B-type
  misc_feature: SWISSPROT Homolog: EC 3.4.25.1 Proteasome endopeptidase complex
MFLTRTEYDRGVNTFSPEGRLFQVEYAIEAIKLGSTAIGLKTKDGVVLAVEKRVTSPLLEPSSVGKIMEIDEHIGCAMSGLIADARTLVEHARVETQNHRFSYREPNDRRIFTPAFL

SEQ ID NO: 80706 - DNA, 990 bp, Zea mays
  misc_feature: Ceres CLONE 1566065
  misc_feature (805)..(805): n is a, c, t, g, unknown, or other
  misc_feature (807)..(807): n is a, c, t, g, unknown, or other
  misc_feature (811)..(811): n is a, c, t, g, unknown, or other
  misc_feature (812)..(812): n is a, c, t, g, unknown, or other
  misc_feature (814)..(814): n is a, c, t, g, unknown, or other
  misc_feature (848)..(848): n is a, c, t, g, unknown, or other
  misc_feature (855)..(855): n is a, c, t, g, unknown, or other
ggagctccccgcggtggcggccgctctagaactagtggatcccccgggctgcaggaattcgtctcacccctagaaaaaaaatgacagggaaaaaaaaccaatcatctcactatctcagcgccgagctcgagcccgcagcctgccatcccctttggcaaccaaatccggcttgcctgcagcggatctccatctggtcggagtggatcgggtctccggtgggtgttctcgcctccgtgggcgttagtgccggcggaccggacacgtcccccgcaacagcggcagcggggggctggcctaactgcgggggcttgagggcggttctcggaaaggggcccctaagtgggccccacgggggggggcccccaaattccccccctttttgggggaaaaggggggaacccccccccccctgtgggagggcgcccaaaattccccccttaaagggggggaaaaaaaggggttttttgaaaaaaaaaacacggggggtttttggggccccccccacctttgttttgggccccccacccccccccccttttgtgtgagagaaaaaaatttttccccccaaatatcccccccccgccaaaaaaaaaagaaattttttttttcttgccccccccccctcttcctttggggggggaaaatatttttaaaaaaaagaggggggggggggggggagaaaaaaaaaaaaaaaacaaaaacccctccccccccccctctggtgtgttctttctttttgggggtgggtgggggggggcaaaacacaccccctcgcggggggagggggaggggggggggggggggngngggnncnccaatcccccctcctcccccctctcttttttttnagaaagncgtggaggaggaaggggaggcgcacccccccccccccccctggcctgcgtgttttgttttagtttttcgcgcctgcacccaccaccacccacccccaccacccaaaataataaagagaagggaggagggggcggg

SEQ ID NO: 80707 - DNA, 960 bp, Zea mays
  misc_feature: Ceres CLONE 1566067
  misc_feature: Translation starting site: 194
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (532)..(532): n is a, c, t, g, unknown, or other
  misc_feature (890)..(890): n is a, c, t, g, unknown, or other
  misc_feature (891)..(891): n is a, c, t, g, unknown, or other
  misc_feature (919)..(919): n is a, c, t, g, unknown, or other
ctccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgatcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggttacctctctaacttcccgtcctaccgcaccgccgtgagcccgctgctgcggggcgtcaaagtcggcctcccgcacggttagggcccccccggggcccctnnngnttaaggggcccgtttccgaacaaccccctttgaaggccaagccggggcgcttcggggccccccgggcccgtgcccatccctaaagggtttggccccccattttaggggggcccccccccttaaaaaagggggaccccttcaagggggcccccctttaacccctcaccggcaaataaaatgaggcccaaaaaattgaaacccccccaaggggggaggcaattttacccggggagatttattttttggggggatttccccgggggggcggggggggaattttttcccccccaagggggccaaaccccccccacatttttttaaaggaaaaacaatacccaaagaggggtttttttttatnnccccggggggaaccccccccctataatnaaaataataatagagggggggcggggcgccctcttttttct

SEQ ID NO: 80708 - DNA, 935 bp, Zea mays
  misc_feature: Ceres CLONE 1566068
  misc_feature: Encodes the peptide sequence at SEQ ID NO. 80709
  misc_feature (753)..(753): n is a, c, t, g, unknown, or other
ccccgcggtggcggccgctctagaactagtggatcccccgggctgcaggaattcgtctcacccctagaaaaacccatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtgcccaatccggccgatcccccctcctatccgccgcagaggcggcgcctctgggcctaccccgatgtatagcaacttcaaggagcaggcgatcgagtacgtcaagcaggcggtccaggaggacaatgccggcaactacgtcaaggcgttccctctctacatgaacgcgctcgagtacttcaagacccatctcaagtacgagaagaaccccaagatcaaggaggccatcaccgccaagttcaccgagtacctccgccgcgccgaggagatccgggccgtcctcgacgagggcggcgcggggccgggggccaacggaggtgacgcagccgtcgccacgcgccccaagaacaagggcaaggacggcgacgggggcaacggaagggatgactccgagcagtcaagctcagggcggggctcaactctggcatcatcaccgagaagcccaacgtcaagtggaacgacgttgctggcctcgagagcgccaagcaagctctgcaggatggcgtcatattgccggtcaagttccacagntcttcacgggcaagcggaggccttggaaggcgtttctttttgtatgccccctccgggaaaaggaaagtctaacttggcaaaagccgtcgcacccgaggctgaatcaacatttttcagaaaatcttcctcaaatcggggttcaaaggggatgggggaaagcgaaaatataagccccaatcttt

SEQ ID NO: 80709 - protein, 216 aa, Zea mays
  misc_feature: Ceres CLONE 1566068
  misc_feature (5)..(73): Pfam Name: MIT Pfam Description: MIT (microtubule interacting and transport) domain
  misc_feature (7)..(73): SWISSPROT Homolog: EC 2.7.11.1 Non-specific serine/threonine protein kinase
  misc_feature (173)..(212): SWISSPROT Homolog: EC 3.6.4.3 Microtubule-severing ATPase
  misc_feature (156)..(156): Xaa is any aa, unknown, or other
MYSNFKEQAIEYVKQAVQEDNAGNYVKAFPLYMNALEYFKTHLKYEKNPKIKEAITAKFTEYLRRAEEIRAVLDEGGAGPGANGGDAAVATRPKNKGKDGDGGNGRDDSEQSSSGRGSTLASSPRSPTSSGTTLLASRAPSKLCRMASYCRSSSTXLHGQAEALEGVSFCMPPPGKGKSNLAKAVAPEAESTFFRKSSSNRGSKGMGESENISPNL

SEQ ID NO: 80710 - DNA, 968 bp, Zea mays
  misc_feature: Ceres CLONE 1566069
  misc_feature: Encodes the peptide sequence at SEQ ID NO. 80711
  misc_feature (844)..(844): n is a, c, t, g, unknown, or other
  misc_feature (845)..(845): n is a, c, t, g, unknown, or other
  misc_feature (922)..(922): n is a, c, t, g, unknown, or other
  misc_feature (931)..(931): n is a, c, t, g, unknown, or other
  misc_feature (968)..(968): n is a, c, t, g, unknown, or other
ctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaggcgtttgcggcctatggcaagctccgccttgagcggatgaacaagaagcacctcggtgcccgccagaagatagcagctgatgcagagaagtagacaagagtgaagcagccaaactttgtagcctgttttgttctgttcagtcatagcgagatgctacttccanntcagtgctgttccagttttttttgggtgctggaaatagagacagtcaaatattttggtgtcctacgggttgataccnttgtattgnttgcgaaccagctatctaatgggtaaatgaaatctgn

SEQ ID NO: 80711 - protein, 204 aa, Zea mays
  misc_feature: Ceres CLONE 1566069
  misc_feature (6)..(185): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTYKAKLVIFPRRARKVKAGDSTLEELTTATQVQGDYMPITRGEKRSVEVVKVTDEMKAFAAYGKLRLERMNKKHLGARQKIAADAEK

SEQ ID NO: 80712 - DNA, 877 bp, Zea mays
  misc_feature: Ceres CLONE 1566071
  misc_feature: Encodes the peptide sequence at SEQ ID NO. 80713
  misc_feature (20)..(20): n is a, c, t, g, unknown, or other
tcccctcggtggcggccgcngtccaactagtggatgccccgggctgttgccctcgtctgcacccctagaaaaaatttttcttcggcgcgtacctcttcctcttccacctcgtccactgccgcggcgaacaccatcgtggaagaagcggcggcggtggcggctgtatccgtttcgcagcataccggatccatctccgacgcgctacggcactatgggaagtgctaccgggagctctcgaaagtccgcctcagtgctcttgttgtggcaacttcgggggctggttatgtgcttggtagtggcaacatcgtggatattgctggactttgttgcacatgtgctggtacaatgatggttgcagcatctgcaaataccctcaaccaggtgttcgagataaaaaatgatgctaaaatgaaaaggacaatgcgacgtcccctgccatctggtcgcatcagtcctgcacatgctgcaatgtgggctacaagtgttggagttgcaggaacagctttgttggcctggaaggctaatgacttggcagctgggcttgcagcttctaaccttgttctgtacgcatttgtgtatacgccgttgaagcaaatacaccctgttaatacatgagttggggcaatcgttggtgccattccaccacttttggggtgggcggcagcttcaactgaactgtcactaaatgccatgatactccctgccgcattggactattggcaaatacctcattttatgggctcttgcgtacttatgtcgaaatgattacctttgctggagggtatccgaaagtttccttttgctgaatctaccgggtaaagaactgctggggtggccctaaaaaattggctgtacaagctccctttggggtttattt

SEQ ID NO: 80713 - protein, 193 aa, Zea mays
  misc_feature: Ceres CLONE 1566071
MPRAVALVCTPRKNFSSARTSSSSTSSTAAANTIVEEAAAVAAVSVSQHTGSISDALRHYGKCYRELSKVRLSALVVATSGAGYVLGSGNIVDIAGLCCTCAGTMMVAASANTLNQVFEIKNDAKMKRTMRRPLPSGRISPAHAAMWATSVGVAGTALLAWKANDLAAGLAASNLVLYAFVYTPLKQIHPVNT

SEQ ID NO: 80714 - DNA, 951 bp, Zea mays
  misc_feature: Ceres CLONE 1566074
  misc_feature: Encodes the peptide sequence at SEQ ID NO. 80715
  misc_feature (740)..(740): n is a, c, t, g, unknown, or other
  misc_feature (755)..(755): n is a, c, t, g, unknown, or other
  misc_feature (756)..(756): n is a, c, t, g, unknown, or other
  misc_feature (778)..(778): n is a, c, t, g, unknown, or other
  misc_feature (895)..(895): n is a, c, t, g, unknown, or other
ggagctccccgcggtggcggccgctctagaactagtggatcccccgggctgcaggaattcgtctcacccctagaaaaagacccatcgctcactacgcgaccgctagctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctccctgccctggagctngtcggggccaagggnngccgcgccgcgcccgccgcgtnccagggaagccccagaaggtcgggtcctcggacgctccctccgggtcggccgggtccgacgacgcccgcgccactgtcgccgccgggcgcaaggtcgtcggctggagcttcgccggnctcgcccgccgtcctggctgtcttgtgtgagaatgagacgtgcgtcggttctaggg

SEQ ID NO: 80715 - protein, 258 aa, Zea mays
  misc_feature: Ceres CLONE 1566074
  misc_feature (47)..(184): Pfam Name: Fasciclin Pfam Description: Fasciclin domain
  misc_feature (194)..(194): Xaa is any aa, unknown, or other
  misc_feature (201)..(201): Xaa is any aa, unknown, or other
  misc_feature (240)..(240): Xaa is any aa, unknown, or other
MARRIAVAAAFLALAVVAPAALAQAPGPAATPSGPPNVTAILEKGGQFTMFMRLMKETQQDTQLNSQLNSSYASSGGGYTVFAPTDNAFNNLKPGTLNSLTQQQQVALVQGHVLPQFYSMDSFQTASNPVRTQASGRDGPYTLNITATANNQVNVSSGVAEVTINNALSAVKPLAVYSVDKVLPALELVGAKGXRAAPAAXQGSPRRSGPRTLPPGRPGPTTPAPLSPPGARSSAGASPXSPAVLAVLCENETCVGSR

SEQ ID NO: 80716 - DNA, 942 bp, Zea mays
  misc_feature: Ceres CLONE 1566075
  misc_feature: Encodes the peptide sequence at SEQ ID NO. 80717
  misc_feature (867)..(867): n is a, c, t, g, unknown, or other
  misc_feature (880)..(880): n is a, c, t, g, unknown, or other
ctggagctccccgcggtggcggccgctctagaactagtggatcccccgggctgcaggaattcgtctcacccctagaaaaaatccccgcacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttcccgccgccgcctcctccatgttcccaaagccgcctcctgggacgaatccgtccccgaggatggtggagatgcggaggaatccgttgccgctggggacgacgaggacgaggacgagaagccgcggcccgagccggtgtcctcctccgagttccagttcgcggcgccacccgagggctacgtcgagcccgcggcgtttgacgagctaccgccggagtccccagaagacgtggcggcggcgtacgaatctctctacgggccggccttcagcggcgagacattgctggggaacaatgtcttcgaggtcaaggtggtcgaccccatcgacatggaccgggagcagcgtccgaacgacgatttcaccgagcgcgtcgtgcaggtcaaccgcgtcaccaaggtcgtcaagggagggaggcagctctcctaccgcgcaatcgtcgtcgttggcgacatgataggccacgttggtgtcggcgtgggaaaggcaagggagtcacggatgccatcacccaagccgccatgaacggccggcgcaaccttgtcacagtgccgctaactaagtactccacattcccgcacagagctgatgcngactatggagcanccaaggtgatgttgaagcccctgctgccctggatctggtggtattgctgtgggaccttgaag

SEQ ID NO: 80717 - protein, 215 aa, Zea mays
  misc_feature: Ceres CLONE 1566075
  misc_feature (161)..(211): Pfam Name: Ribosomal_S5 Pfam Description: Ribosomal protein S5, N-terminal domain
MAATATAMAIATISPAAPIPSAPFPSLPLGLRLRPQPLLFAASRRRLLHVPKAASWDESVPEDGGDAEESVAAGDDEDEDEKPRPEPVSSSEFQFAAPPEGYVEPAAFDELPPESPEDVAAAYESLYGPAFSGETLLGNNVFEVKVVDPIDMDREQRPNDDFTERVVQVNRVTKVVKGGRQLSYRAIVVVGDMIGHVGVGVGKARESRMPSPKPP

SEQ ID NO: 80718 - DNA, 962 bp, Zea mays
  misc_feature: Ceres CLONE 1566077
  misc_feature: Encodes the peptide sequence at SEQ ID NO. 80719
aagctggagctccccgcggtggcggccgctctagaactagtggatcccccgggctgcaggaattcgtctcacccctagaaaaaaagcgacgataagcgttcagaaagccatcgtccttacagacgagacacgagaggcagcgagccagcgaccggcaacagttttctcggaaggcagcctcttcctcgtcgccgccgacgtcacccgccgcggctgtcggggatgccggtcagggtggtcgataccgccacgccttcctcgcagccctccccagggcaagaagcaaatactggacacccatctcctcctagatgttcactcttaagtgctggaagatcttttgctggaactcagaatgtttcaagtctgcagaaggatgaagcatggaaagtgaatgtccgcatccatggttgtgatcttgaacagggttatctatgtggaacgatggaagcgcttaatgttccattagcagatacacctgtagtgacattctgggagggggagatagtggatgctaaaaattacacctttttcactggcaagtgggaggcatcgccagaggatgatataagacattggtccaagttcccatcatttatgcctcttctgagtcagattgagacagacggtggcaagtctctggactttagcaactatccttacatatatatgagatgggaagaacagtattttgtcaatgttggagttgactgtgggttaaccatcgctggtttctactacgtctgcttttcttgtagtgaaggctccattagtgaatttttatatgatccaaatagcagtccgtttcagaagcctcgaatgaagtgtaacaatgagaaaaattctggaatcaccttttcatcctatgagctgcattgaaatggccaaatgccctcgacgaacaactttcttgtcagcatatggggtggactgaactcataaccccccaaagctgctgtatg

SEQ ID NO: 80719 - protein, 218 aa, Zea mays
  misc_feature: Ceres CLONE 1566077
MPVRVVDTATPSSQPSPGQEANTGHPSPPRCSLLSAGRSFAGTQNVSSLQKDEAWKVNVRIHGCDLEQGYLCGTMEALNVPLADTPVVTFWEGEIVDAKNYTFFTGKWEASPEDDIRHWSKFPSFMPLLSQIETDGGKSLDFSNYPYIYMRWEEQYFVNVGVDCGLTIAGFYYVCFSCSEGSISEFLYDPNSSPFQKPRMKCNNEKNSGITFSSYELH

SEQ ID NO: 80720 - DNA, 945 bp, Zea mays
  misc_feature: Ceres CLONE 1566078
  misc_feature: Encodes the peptide sequence at SEQ ID NO. 80721
  misc_feature (945)..(945): n is a, c, t, g, unknown, or other
ggagctcaccgcggtggcggccgctctagaactagtggatcccccgggctgcaggaattcgtctcacccctagaaaaagaaaccttttgccgtcttgcggcggccttctgctccgccgctcgttctcatatcttgcggcggcctggggaaaaagaggagagatcggagatgaaggcgtgtgcgaaggctgcgggggagaggctgccgctggtctgtgctccgtcaactaggcagcctctagctcggagctttgttaaggcaagaagattaccctctcaacatgagacgaagtcccaagtatcctgctcggtttgggtgtcagaaaacacagctcacagaatagatgccacagcagaaaatattttcccagcaatgaaagatcatgtcttgaaagcaactgatgcaatcaacagaggagaagtgattgcggtgcctactgataccatatacgggtttgcatgtgatgcatgctctgcaagagcagttaatcctatttatgagatcaaaggacgcatacaatcaaggcctctgggaatttgtgttggggatgtctcacacatatcacggtttgcttttatgggaccacttgccacagggcttggctggaaattctacttcctggggccgggcactattggttctaaaacggaggtggaaaccgccctactttgagaaatcccccttaaccccggccctggataagcattggaagttcccgtgcccggaacctgggatttcttcccatcccctcgccccggggacacgggaagtccactttccacccccccacggcccaattttttgcgggaaccccccacgcgtgggtctgtgttcaagaatattcccagggtggttttgggccccttccgccccaatgtgctcttatagtgcggagaattttctccttcggtggcgtggccgttccacaaacacaccctgatatcn

SEQ ID NO: 80721 - protein, 167 aa, Zea mays
  misc_feature: Ceres CLONE 1566078
MKACAKAAGERLPLVCAPSTRQPLARSFVKARRLPSQHETKSQVSCSVWVSENTAHRIDATAENIFPAMKDHVLKATDAINRGEVIAVPTDTIYGFACDACSARAVNPIYEIKGRIQSRPLGICVGDVSHISRFAFMGPLATGLGWKFYFLGPGTIGSKTEVETALL

SEQ ID NO: 80722 - DNA, 1018 bp, Zea mays
  misc_feature: Ceres CLONE 1566079
  misc_feature: Encodes the peptide sequence at SEQ ID NO. 80723
ggagctccccgcggtggcggccgctctagaactagtggatcccccgggctgcaggaattcgtctcacccctagatgaaaaaaaaaaaaaaaaaaaaaaaaaaaaaaaaaaaaaaaggctgtgaggtgtgagcctcagcacgacgggattgcgcccacacgcgacgccaaacgaaacagctagccagcccccattcttctccggctccggtgcattccgtgtcctgtcctgtcctgtcctgatggaagcagcaatggctgccacgtcctccctactccttgcctccggctccaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaacgccgtctcgtcgtcgtcgtcatcggaaagatgggttctcgaccctgcaagagacggtgactggcgccacatcggctacaaagtcgcgcgccctggggcgatcgagatagcctcggaggacacggcggtgaccctggggccggggcgcccaaaagcgggaaatggggctccccgtcgccacagtttcagggggctcccgcccggctgggaaataaagggcgggcaccctgctggtgaacgaaccttgaacagaaccaaagggaccctacattaaaagaggggccggttcaacccgggggttcccccgcgttccgtgcgaccccgggagagctattcatttttgggtggaaatccacttgggccatgtttccgctgtaaagaaaaaaaggtgggggttggaggcccccccttacatctcccgaaggaagagctaaggagaccccccataaagaacacccccacccggaaaatatttgaagaacatgtgcctttttttaatgaagagaggaacccccctcttaaaaaataagaggggaggtggagagacatcttctcccctgcgcccctctataatccccccccat

SEQ ID NO: 80723 - protein, 151 aa, Zea mays
  misc_feature: Ceres CLONE 1566079
MAATSSLLLASGSRRWPATLPPSPWPQQQRLVFCLAARTRPLDSKRGSWRRSSSATGGRSNAVSSSSSSERWVLDPARDGDWRHIGYKVARPGAIEIASEDTAVTLGPGRPKAGNGAPRRHSFRGLPPGWEIKGGHPAGERTLNRTKGTLH

SEQ ID NO: 80724 - DNA, 937 bp, Zea mays
  misc_feature: Ceres CLONE 1566082
  misc_feature: Encodes the peptide sequence at SEQ ID NO. 80725
  misc_feature (807)..(807): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (928)..(928): n is a, c, t, g, unknown, or other
ggagctccccgcggtggcggccgctctagaactagtggatcccccgggctgcaggaattcgtctcacccctagaaaaaactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatggaacataagggggagatgaaggttgtggtcaggacagttatttcactcaccaaggaggaggagaaagactcaaggaaaccttgcaggatatccttggggaaaacaaaactatttttgttgaacagaaagatgactacagcatcatgggaggattagtgattgaattcnggcagaagtgcttgatatctcatcaggaacaggcgaagcaatggaggcgnnnctgagcaccacctgacctctaacagccttttggataaagaagcatctcggaatgcaaaggctgtcctgntgaaggttt

SEQ ID NO: 80725 - protein, 202 aa, Zea mays
  misc_feature: Ceres CLONE 1566082
  misc_feature (56)..(195): Pfam Name: OSCP Pfam Description: ATP synthase delta (OSCP) subunit
  misc_feature: SWISSPROT Homolog: EC 3.6.3.14 H(+)-transporting two-sector ATPase
MAAARHLRSGLPLLRAHLASSESAAVAQVSRGFASQAAKPTGKEIKVPKALFGGTGNYASALFLTAAKSNALDKVESEIKAIVEASKKSPLFSQFIKDLSVPKATRVKAIAEIFADAGFSDVTKNFLAVLADNGRLKYIERIAERFVDLTMEHKGEMKVVVRTVISLTKEEEKDSRKPCRISLGKTKLFLLNRKMTTASWED

SEQ ID NO: 80726 - DNA, 921 bp, Zea mays
  misc_feature: Ceres CLONE 1566085
  misc_feature: Translation starting site: 186
  misc_feature: SWISSPROT Homolog: EC 1.1.1.1 Alcohol dehydrogenase
  misc_feature: SWISSPROT Homolog: EC 1.1.1.284 S-(hydroxymethyl)glutathione dehydrogenase
  misc_feature (743)..(743): n is a, c, t, g, unknown, or other
  misc_feature (744)..(744): n is a, c, t, g, unknown, or other
tggagctccccgcggtggcggccgctctagaactagtggatcccccgggctgcaggaattcgtctcacccctagaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggaagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtaaccgtcatgcatggtgggttgtgttgcaaagatcaaccctcatgctccccttgataaagtttgcgtccttagctgtggtatttctaccggtcttggtgcatnncattatgttgcaatacctccgaaggggtcgacagtggctgttttcggttttgggagccgttggtcttgccgctgcagaaaggtgcaggattgctggagcgcaaaggatcattggtgtcgacctgtaccccagcagatcaaagaaacttagaagtcgggttgcactgaattgtgaacc

SEQ ID NO: 80727 - DNA, 1333 bp, Zea mays
  misc_feature: Ceres CLONE 1566087
  misc_feature: Translation starting site: 238
  misc_feature (50)..(50): n is a, c, t, g, unknown, or other
  misc_feature (61)..(61): n is a, c, t, g, unknown, or other
  misc_feature (783)..(783): n is a, c, t, g, unknown, or other
  misc_feature (1060)..(1060): n is a, c, t, g, unknown, or other
  misc_feature (1207)..(1207): n is a, c, t, g, unknown, or other
  misc_feature (1263)..(1263): n is a, c, t, g, unknown, or other
cttatttataaaagtataagataccgcgtttgggccgtggctttttcganatattgtgttntttttcaaactggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggcacggggccgaccgcgtcctgttcctgggcccgctgttcggccagcccccaagctacctgaccggcgagttccccggcgactacggctgggacaccgcggggccccccacctacccggagactttcgccaagaaccgcgaggctggaggtgatccactgccgctgggccatgctggggcgcgactccggtgccgtgttcccggaagctgttcagccctcaacaggagtcaagtttcaggcgaaggcacgtgtgggtttaagagccggggtcccccaaatcttcaagcgaagaggggggggtttgtaattactctcaagacaatccccgaatgcccttggaatccaccgcccccataaagcaatccccagggcccaattctggggggcgtgtggccaagggatgaggttgcacttcanagtggagggcggcccacgtccaaagagggggtgttactccggacaatatcgcggcaacggggttgtggttctccacggattcttgagagagaggggagagaagtgtgggggtgtgtgaaaaaaaccgcgatctttgggtgtttaccccccccccggtggcgagagttaagatacatattttataaaaacccccgcacatgtcgggatggggacctccggccccgaaaatatgaacacaccacgtggagaggatcgtattttattctgcgggataaancctccccattgagggtgcctctgatggggaccatctaatagggagaaaagggggtgcagctctttacacgccaaagaaggttctcccccacttaggatttctagggcgtattatacacacccattggatagagaagccacttctgtnttcatacccctgtgtgaagagagggtgtccccactcttataaataaaacacacggngtgaacatacaacccctcacactttatatcacgtggtgtaaaataaacacagggccatggatgtccacaa

SEQ ID NO: 80728 - DNA, 948 bp, Zea mays
  misc_feature: Ceres CLONE 1566089
  misc_feature: Encodes the peptide sequence at SEQ ID NO. 80729
ctccccgcggtggcggccgctctagaactagtggatcccccgggctgcaggaattcgtctcacccctagaaaaaacgccacaggaaggggaaaaaaaacgcaggtgcccaaaacacgttcgccccagagaattgaaaacttaccactgcgaattcaattcgaaagcctcagacccagagagcttcccatggcatccgctaccacctccatctcgtcgcaccctgccgccctccgcgacgtcaaagctgcgaggattggtggcgcgctgaggcaggtgggcgtggcggcgcgtggccagcgcgctcgggcggtgcccccgctgcgcgcggcggagcctgcgaggcggccggtggcggcctccgcggccgcggcgccgccggccgcgcccgtggccgacgacgccgcggtggactacgaggccctggcgcgcgagcttgagggcgcgtcgccgctggagatcatggatcgggcgctggccatgttcggctccgaaatcgccatcgccttcagcggcgcggaggacgtggcgctgatcgagtacgcgaagctgacggggcgtcccttccgggtgttcagcctggacacggggcggctcaacccggagacgtaccagctcttcgacagggtggagaagcactacggcatccgcatcgagtacatgttcccggacgccagcgaggtgcaggagctggtgcggaccaagggcctctttctcctctacgaggacggccaccaggagtgctgccgcgtgcgcaaagtgcggcccctgcgcagggcgctcaaggggctcagggcgtggatcaccggccagaggaaggacaagtccccgggcacagggccagcatccctctgggtcagtttgaccccttccttcaaggccggaaagccgggctggtaaccttgtccagtggaaacccggtggccaactcgacgggcaagaacatctga

SEQ ID NO: 80729 - protein, 236 aa, Zea mays
  misc_feature: Ceres CLONE 1566089
  misc_feature (102)..(234): Pfam Name: PAPS_reduct Pfam Description: Phosphoadenosine phosphosulfate reductase family
  misc_feature: SWISSPROT Homolog: EC 1.8.4.9 Adenylyl-sulfate reductase (glutathione)
MASATTSISSHPAALRDVKAARIGGALRQVGVAARGQRARAVPPLRAAEPARRPVAASAAAAPPAAPVADDAAVDYEALARELEGASPLEIMDRALAMFGSEIAIAFSGAEDVALIEYAKLTGRPFRVFSLDTGRLNPETYQLFDRVEKHYGIRIEYMFPDASEVQELVRTKGLFLLYEDGHQECCRVRKVRPLRRALKGLRAWITGQRKDKSPGTGPASLWVSLTPSFKAGKPGW

SEQ ID NO: 80730 - DNA, 947 bp, Zea mays
  misc_feature: Ceres CLONE 1566092
  misc_feature: Encodes the peptide sequence at SEQ ID NO. 80731
  misc_feature (649)..(649): n is a, c, t, g, unknown, or other
ctccccgcggtggcggccgctctagaactagtggatcccccgggctgcaggaattcgtctcacccctagaaaaagtcacccaccgccgacggctagccatgtccgccgagcccacctctccgcctctatcgacggcgcaggtccgcgggagcctcatcccgccgcttccagacgacttggctgtccactgcatcgctctcttgccgcgcgccgcgcacccatccctggccctcgtctcccgcgctttccacgccctcctgtgccgccacccggagccgctcctcgccgcgcgccgcaccctccgctgctccgaaccccacgtcctcctctccctccgcccaccctcctccgcgtcccctatcttcttcctcctgctcccgcaccccgggtggcccccgctcccgcttccctcccctcccgtccccgtctcgtcctccgcgtcggccgccaccgacggcgcccggctcttcctcgtcggcggatccgtatccgcggtcccctctgcgtccgtgcagatcctggacccccgggccagatcctggtccgccggcccgcgcctgtcctctacgcgggagttcgccgcggccgtcgcgcactccggggcgctgttcgtcgccggcggctgcatcccctcgtcccctttctgggncgaggctctcgacctctccactccgaacgccaagtggagagccgtcgccagcccggcccacctccgcgagaagtggatgcaccgctgcgcgtcgctcgacggggaggtcgttgtggtggcggaccgtggcggcttgtcctacgattcctcggcgccacctgcgggagcgttgggcaccggtgtcgccggtgcctgacatgggatggaaggccccactgcatgggttgaaggaatcctctactcttacattacctgggacggtcagggggttgaatccgtaactggatcttggaccaag

SEQ ID NO: 80731 - protein, 248 aa, Zea mays
  misc_feature: Ceres CLONE 1566092
  misc_feature (110)..(155): Pfam Name: Kelch_1 Pfam Description: Kelch motif
  misc_feature (184)..(184): Xaa is any aa, unknown, or other
MSAEPTSPPLSTAQVRGSLIPPLPDDLAVHCIALLPRAAHPSLALVSRAFHALLCRHPEPLLAARRTLRCSEPHVLLSLRPPSSASPIFFLLLPHPGWPPLPLPSPPVPVSSSASAATDGARLFLVGGSVSAVPSASVQILDPRARSWSAGPRLSSTREFAAAVAHSGALFVAGGCIPSSPFWXEALDLSTPNAKWRAVASPAHLREKWMHRCASLDGEVVVVADRGGLSYDSSAPPAGALGTGVAGA

SEQ ID NO: 80732 - DNA, 988 bp, Zea mays
  misc_feature: Ceres CLONE 1566094
  misc_feature (988)..(988): n is a, c, t, g, unknown, or other
tggagctccccgcggtggcggccgctctagaactagtggatcccccgggctgcatgaattcgtctcacccctagaaaaaatctcatcgcaacgttacgcaagcatcctccacctcctgccttgcctgcctgcctgcgtcgtagtttgcacaccgcaaccgtgttcttctctctctctctctctctccctctcgtccctgagaaagcgccgccgctctacgttcccctcgcttgcgctcggtccggaaaaggaccgtccttccatggccatcgcctcccgtgcaacgaagcgcgcgctgatcacctttcgccgccgcaagctcccggatgaggcagtcgcggccgacgccgcctgcgaagcgatcgccgcccgctcccacccagatggtgccgctgcccccggagcccccctcatccgtgaagcccctgcatttcgaggacaccggcgccttgttcggggggaacccaaattcggggtttcttgccacacttggccgcgtttaaggggaatttccctgggcccccttatgggacccccccccggggggccttgggggttaccctgtggaagggaaaaaaagtggtatttcggcaattccacacatgaaaaggggtctcgatttatatttcccccttttttgtgggaaaataaaacggggttttttgtcccccccccccttgtgggccccccttttgtatctctttataaaaaaaggcccccctcccccctgtttgctattaaaaaaaggggggaatattctcttttaaaaaaatttaagagaggtgggttggttgtttcctcaacaaaaattctcctggatatcccccccacaaaaaaaattatatagggcgtctcccctcaataatcttctctaaagaaaaaagccttctccatacacacatagtgtgggtgtggggagaaaaataactccctctctccttctggcggagtaaataaaagagtaatatccccctcccccccccgcccn

SEQ ID NO: 80733 - DNA, 956 bp, Zea mays
  misc_feature: Ceres CLONE 1566095
  misc_feature: Encodes the peptide sequence at SEQ ID NO. 80734
  misc_feature (847)..(847): n is a, c, t, g, unknown, or other
  misc_feature (854)..(854): n is a, c, t, g, unknown, or other
  misc_feature (898)..(898): n is a, c, t, g, unknown, or other
ctggagctccccgcggtggcggccgctctagaactagtggatcccccgggctgcaggaattcgtctcacccctagaaaaagtacccatcgctcactacgcgaccgctagctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaagtcaccatcaacaacgcgctcagcgccgtcaagcccctcgccgtctactccgtcgacaaggtgctcctgcccctggagctgttcgggggcatagggcccgccgccgcgcccgcgcgcgtccagggtaagcccaagaggggcgggtcctcggacgctccttccgggtcggccgggttcgacgacgncgcgccnacgggcgccgccggcgcagggtcgtcggctggagcttcccgggnctccgcgcgttcttggctgtctgttgggagagtgaaacgtgcgtcgtttctagggacg

SEQ ID NO: 80734 - protein, 259 aa, Zea mays
  misc_feature: Ceres CLONE 1566095
  misc_feature (47)..(185): Pfam Name: Fasciclin Pfam Description: Fasciclin domain
  misc_feature (223)..(223): Xaa is any aa, unknown, or other
  misc_feature (240)..(240): Xaa is any aa, unknown, or other
MARRIAVAAAFLALAVVAPAALAQAPGPAATPSGPPNVTAILEKGGQFTMFMRLMKETQQDTQLNSQLNSSYASSGGGYTVFAPTDNAFNNLKPGTLNSLTQQQQVALVQGHVLPQFYSMDSFQTASNPVRTQASGRDGPYTLNITATANNQVNVSSGVAEVTINNALSAVKPLAVYSVDKVLLPLELFGGIGPAAAPARVQGKPKRGGSSDAPSGSAGFDDXAPTGAAGAGSSAGASRXSARSWLSVGRVKRASFLGT

SEQ ID NO: 80735 - DNA, 960 bp, Zea mays
  misc_feature: Ceres CLONE 1566098
  misc_feature: Encodes the peptide sequence at SEQ ID NO. 80736
  misc_feature (720)..(720): n is a, c, t, g, unknown, or other
  misc_feature (856)..(856): n is a, c, t, g, unknown, or other
  misc_feature (859)..(859): n is a, c, t, g, unknown, or other
  misc_feature (865)..(865): n is a, c, t, g, unknown, or other
  misc_feature (871)..(871): n is a, c, t, g, unknown, or other
  misc_feature (902)..(902): n is a, c, t, g, unknown, or other
  misc_feature (903)..(903): n is a, c, t, g, unknown, or other
  misc_feature (912)..(912): n is a, c, t, g, unknown, or other
  misc_feature (913)..(913): n is a, c, t, g, unknown, or other
  misc_feature (923)..(923): n is a, c, t, g, unknown, or other
  misc_feature (924)..(924): n is a, c, t, g, unknown, or other
ctggagctccccgcggtggcggccgctctagaactagtggatcccccgggctgcaggaattcgtctcacccctagaaaaagccccctcgcgacgctatagagtctccgtgacctcaaccaccatgccgcaagtcgggcgtgatcggggcctgctggagcggccgcgcgcgctaccgcggtcggcggacccggccgtgcagatcgccggcaacttcgcgccggtcggcgagcaggcgccggtgcggtcgctgccagtgtcgggccgcatcccaccattcatctcgggcgtgtacgcgcgcaacagggtcaaccccagcttcgagccgtcggcagggcaccacctgttcgacggcgacgggacggtgcgcgcggtgcgcatccgcaacggcgcggccgaatcgtacgcgtgccggttcaccgagacggccaagctccggtaggagcgcgcgctggggcgggccgtgttccccaaggccatcggcgagctgcactggcactccaggatcgcgtgtttggcgctgttctacgcccgcgagctgtgcgggctcgtcgacccgtcccgtggcacgggggtcgccaacgccggccttgtctacttcaacggccgtctcctggccatgtccgagcaagccctgattgccgctgtcggctctccacttctccagttctgggtgaagaagtaaagatcagccgagaatgaggtcaacccagttgaatccnatggagctgtggtctcggttaagaagacagtatatacaacactaatcaccaaatcttagtcgccgcttgcggccgccgccatcactagccaatgcatcgtccctggcgcgcggtcgcgtccaggcttcccatccanggntactangtgtantcctaccggtactccttgaaaactagacggnnaagtgtggnncaccagcagnnccagcgtgcgcgtggctgactgactgactgactggc

SEQ ID NO: 80736 - protein, 105 aa, Zea mays
  misc_feature: Ceres CLONE 1566098
  misc_feature: SWISSPROT Homolog: EC 1.13.11.51 9-cis-epoxycarotenoid dioxygenase
  misc_feature: The sequence is a functional homolog of SEQ ID NO 6 in US patent 7049487
MPQVGRDRGLLERPRALPRSADPAVQIAGNFAPVGEQAPVRSLPVSGRIPPFISGVYARNRVNPSFEPSAGHHLFDGDGTVRAVRIRNGAAESYACRFTETAKLR

SEQ ID NO: 80737 - DNA, 946 bp, Zea mays
  misc_feature: Ceres CLONE 1566099
  misc_feature: Encodes the peptide sequence at SEQ ID NO. 80738
  misc_feature (805)..(805): n is a, c, t, g, unknown, or other
  misc_feature (806)..(806): n is a, c, t, g, unknown, or other
  misc_feature (815)..(815): n is a, c, t, g, unknown, or other
  misc_feature (835)..(835): n is a, c, t, g, unknown, or other
ggagctccccgcggtggcggccgctctagaactagtggatcccccgggctgcaggaattcgtctcacccctagaaaaaaaatgacagggaaaaaaaaccaatcatctcactatctcagcgccgagctcgagcccgcagcctgccatcccctttggcaaccaaatccggcttgcctgcagcggatctccatctggtcggagtggatcgggtctccggtggtgtttctcgcctccgtggcggttagtggcggcggacggaccacgtccccgcagcagcggtcagcggcggctggcctagctgcggtggcttgaggcggctctcggacgggtgcctcgagctggcaccagcgggtgggtgccgcaagtctcaccgctagctggtgtagaggcggcgagtcccggcgccatggagggtaggccgcaagtgtccgcttagagaggggtcaacaaagggacttgtcaagctacgacactgcggtcttcggttgccctgctcagcttgttgttgccgtacatgatccttcatgatttgtgagagatctatattccccgaatcttcaccggctctgccagatcactggcgatcttcttgccagccgcctccgctaacctgcgcggcacagtagagctcaggaaaagcggtgggactgagggagaaaagaggagatgactagcctgtcgatcacagtgatgacgctgaacttgcatgaaagcgagcagccgagcgagagtccaacagctgggagaagcgcctgtacatctgcgtcagcgtcatcaccagctactctcctacatcctttgcaccnnacaggcttnagatggcaactggactaccntacacagtgctttgcaggttatgaacagtttggaatcttcagaaaaggctcacaggacaacactgatgaatactgccacatattctatgaaaaggaaaggtggaggctaca

SEQ ID NO: 80738 - protein, 93 aa, Zea mays
  misc_feature: Ceres CLONE 1566099
  misc_feature (47)..(47): Xaa is any aa, unknown, or other
  misc_feature (50)..(50): Xaa is any aa, unknown, or other
  misc_feature (57)..(57): Xaa is any aa, unknown, or other
MTSLSITVMTLNLHESEQPSESPTAGRSACTSASASSPATLLHPLHXTGXRWQLDYXTQCFAGYEQFGIFRKGSQDNTDEYCHIFYEKERWRL

SEQ ID NO: 80739 - DNA, 924 bp, Zea mays
  misc_feature: Ceres CLONE 1566102
  misc_feature: Encodes the peptide sequence at SEQ ID NO. 80740
ctccccgcggtggcggccgctctagaactagtggatcccccgggctgcaggaattcgtctcacccctagaaaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaagccaagccagcggcggcgtccgggagcccgtggtacggccccgaccgcgtgctgtacctgggcccactgtccggcgagccacccagctacctgacgggcgagttcccgggcgactacggctgggacaccgcggggctgtccgcggacccagagacgttcgccaagaaccgggagctggaggtgatccactcccgctgggccatgctgggcgcgctcggctgcgtcttccccgagctgctcgcccgcaacagcgtcaagttcggcgaggtcgtgtgggtcaaggccggctcccatatcttcagcgagggcggggtggactacccccgggaacccgagcctcatccaccccataggatccctgctatctggggccgccaagacggggtcatgggggcccctcgagggctacaccatcccccggggggccgctccgaggaaggctgtcaaaccccttttaacccgggggggagcttttaacccgcgttgggcttaccgaaaaaccccaaaggccttgcccaaatgtttaagggcaaagaaccccaaaaaatgcccgcccccccccacggggccccatggccggaatttctcgcccccgagccaataggtccgggagaaaggcccctcctccaaaaactcccgctaacaaacataggcgaaccccccg

SEQ ID NO: 80740 - protein, 197 aa, Zea mays
  misc_feature: Ceres CLONE 1566102
  misc_feature (65)..(198): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNSVKFGEVVWVKAGSHIFSEGGVDYPREPEPHPPHRIPAIWGRQDGVMGAPRGLHHPPGGRSEEGCQTPFNPGGSF

SEQ ID NO: 80741 - DNA, 1108 bp, Zea mays
  misc_feature: Ceres CLONE 1566103
  misc_feature: Encodes the peptide sequence at SEQ ID NO. 80742
  misc_feature (403)..(403): n is a, c, t, g, unknown, or other
  misc_feature (729)..(729): n is a, c, t, g, unknown, or other
  misc_feature (931)..(931): n is a, c, t, g, unknown, or other
  misc_feature (1108)..(1108): n is a, c, t, g, unknown, or other
gctccccgcggtggcggccgctctagaactagtggatcccccgggctgcaggaattcgtctcacccctagaaaaaatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgaccgaggagcaggaggaggagaggctgcggtacctctagttcgtgcagcaggcggcggcgcaagcgctggtgctggccgccgcggggtacgcggacgccaagcatggcgcccggcctctcctccccccgcncaataaaggcgagggccccgtgaaggcccgcggcgggcccctcctataacgtttcccccgccgttccgctcgaacttcttgaattttatcgaccaccaaggtgggtgagccccgttaaaggaaaaaaaccgcccccctcccccccctttggaggaagggaagccccacaccttgggcccgccccgcgcgtccgaaaaagagtttctccccagcccagcgggtgggtggggggcagaccccacggggcccacggcaagagttgaaccagtcttccccgcgtactagctcaataagtgccggcgagaaaacccctctgggcatcaaancagaggcactcgctgttcgcgttaggtgaccgccccccccacctcgaccacttgggggaggcgcgattggtaaaactcctcctccagccagggttctacccctgcgttagtcgagtggcgcgtgcgacgggtgcaggtggggcgtagcatgtgcatactacccgacgtggagagacagatacaggtgtgtaggtcgcgtcanagagcaccacaaccgttggtgtagtctcggtggcgatccgcccaactgccttcgtgtgggttggtttatatggcggcgtgccactgccgagctgtgattgttggagcacacactatgtgttgttccttatttggcatgccggccctggcccgcattggcggggcacgcgctggtgtn

SEQ ID NO: 80742 - protein, 41 aa, Zea mays
  misc_feature: Ceres CLONE 1566103
MADSATNDAPLVASNQPTEEEVTVERAAATEEQEEERLRYL

SEQ ID NO: 80743 - DNA, 961 bp, Zea mays
  misc_feature: Ceres CLONE 1566104
  misc_feature: Encodes the peptide sequence at SEQ ID NO. 80744
ctccccgcggtggcggccgctctagaactagtggatcccccgggctgcaggaattcgtctcacccctagaaaaactgcattccccctttccccttccgtccgctgcattcctgctctcttgctctcctcgctctcagaccacagttgccgccgccgccgccctaagccagggtgctgaggctttcgttggcctcttcgccggcagcgagcacccaccagttctgtagaaatggctgatggtgaggacatccagcctcttgtctgcgacaatggcaccggaatggtcaaggctggttttgccggcgatgatgcaccaagggctgtattccctagcatcgttgggcgtcctcgtcacaccggtgtcatggtagggatggggcagaaggatgcatatgttggtgatgaggcacagtccaagagaggtattctcacgctcaagtacccgattgagcacggtattgtaagcaactgggatgacatggagaaaatctggcatcacactttctacaatgagctccgtgttgccccggaggagcaccctgtgttgcttactgaggctcccttggaccaaaagccaacagggagaagatgacccagattatggtccaagactttcaatgttctggccatgtacctttgcaatttcagcaggcccggcacccctaggctaggggccggaccactgagattgttccccatttcggggaaggggggggagccttacggggcccatttttaaaggaaaaggcccctcccccaaggatttcaaacgctggaatctgtgcggggcgggacctaccaaaccgccccagaaaattcccccgggaaggggtttttccttccaaacccccccagaaggaattgtttgggactcccggagaaacctgggttttttccctttcaccccaaaaaatgttggagcccaaaaaacccccctgtgataaaaaattaaaccctcggt

SEQ ID NO: 80744 - protein, 120 aa, Zea mays
  misc_feature: Ceres CLONE 1566104
  misc_feature (4)..(120): Pfam Name: Actin Pfam Description: Actin
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLDQKPTGRR

SEQ ID NO: 80745 - DNA, 998 bp, Zea mays
  misc_feature: Ceres CLONE 1566107
  misc_feature: Encodes the peptide sequence at SEQ ID NO. 80746
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (126)..(126): n is a, c, t, g, unknown, or other
  misc_feature (972)..(972): n is a, c, t, g, unknown, or other
  misc_feature (973)..(973): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
agaaaagggnnnnncnccggggnnnaggggnnngggnnnntttannnggggtggggtttggggggggggnnnnnccaaagctggactccccgcgggggcggccgcatcagaacgagtggatccccncgggctgttgcaatacggcgcacccctagaaaaagttcgtccccgcccatcgctcgctcatcagaaggagggcctagccttccgcagcagcgctcgtcagactccgccgcccgcaattccccccttgccccggcttttaatgggctttccctcccaccgaaatggccggcgatccctgcacccgcgccgccggtgaccgccccaccgccaccacctcctccgtcgccttcttctccgcctggggcgggctcggcctcggcccctccagcttgctgctccacctgctcctcctccactccctcttatagcctcccaggcttgcccctggcccccgccaccccccatgggccgcggttttcctcccccacgtccgtcggggacccccacgggtcggcaaagcccaagggccccccaaggtggcaagaaaaccgaaaaccggctctaaagaaaaccccgggggggggcccaaaaagccccgccccaggcccccccaagagggggcgccccctgtggccccccgcgttaggggggggcgcccccccccaagagggggccccccgcgccccccgggagaaaaagaaaaaacccggggccccccttttgggggggggggcgcccaaaggggtttcccaaatcttgggggggcgaaggaaatatcccccccgggccggccctaagagaaaaaaaaaaggccgccccccctttagtggtgggggccccctcccccccagggggggggcctcgggggaaaaaaaaaccccccccaagaggggcgcccccccgctcggttttggggggggagagaggggttagggagaaccccccaaaaaatctcggggggaggtnntnnnnggggggggggaagactattc

SEQ ID NO: 80746 - protein, 312 aa, Zea mays
  misc_feature: Ceres CLONE 1566107
  misc_feature (4)..(4): Xaa is any aa, unknown, or other
  misc_feature (5)..(5): Xaa is any aa, unknown, or other
  misc_feature (6)..(6): Xaa is any aa, unknown, or other
  misc_feature (8)..(8): Xaa is any aa, unknown, or other
  misc_feature (9)..(9): Xaa is any aa, unknown, or other
  misc_feature (11)..(11): Xaa is any aa, unknown, or other
  misc_feature (13)..(13): Xaa is any aa, unknown, or other
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (24)..(24): Xaa is any aa, unknown, or other
  misc_feature (25)..(25): Xaa is any aa, unknown, or other
RKGXXXGXXGXGXXXXGWGLGGGXXQSWTPRGGGRIRTSGSPRAVAIRRTPRKSSSPPIARSSEGGPSLPQQRSSDSAARNSPLAPAFNGLSLPPKWPAIPAPAPPVTAPPPPPPPSPSSPPGAGSASAPPACCSTCSSSTPSYSLPGLPLAPATPHGPRFSSPTSVGDPHGSAKPKGPPRWQENRKPALKKTPGGGPKSPAPGPPKRGRPLWPPALGGGAPPQEGAPRAPREKKKKPGAPLLGGGAPKGVSQILGGRRKYPPRAGPKRKKKGRPPFSGGGPLPPRGGASGEKKTPPKRGAPPLGFGGGERG

SEQ ID NO: 80747 - DNA, 962 bp, Zea mays
  misc_feature: Ceres CLONE 1566109
  misc_feature: Translation starting site: 157
  misc_feature: SWISSPROT Homolog: EC 3.4.22.16 Cathepsin H
tggagctccccgcggtggcggccgctctagaactagtggatcccccgggctgcaggaattcgtctcacccctagaaaaaactggtgccagtgggccattgttctggccttactccctcacacaacccagtaaaatattgccagtcccgccgtcgagatggccccaatccgcctgctcatcctcgccgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcactgtgaggtacggcaagagctacgagagcgcggcggaggtccacaagcggttcaggatccccaccgagagtctccagctcgtccgctccaccaatcggaaaggcctctcctaccgcctcggcatcaaccgcttctcggacatgagctgggaggagttccgtgcgacccggctcggcacagcccagaactgctccgccacgcttaccggcaatcaccggatgcgcgccgccgccgttgcgctgacggagaccaaagactggagggaggatgggattgtgagcccagtgaaaaaccagggccactgtggatcatgctgggcctttcagcactactggtgcactttgaggctgcatatacccaggcaactggcaagctccatctctctctctggagcacagctttattgactgtggtttttgcattcaacaatttcggatgcaacggaagccttccatcccaggccttttaatacatcaaatacaatggcggggcttgaacctgagggaatcttatcccttaccaaggtggtcaaggggatccggcaagttataagaatgacaatggttggaaatcaacggtttttgggactctggttaaacattaacccgtggggttgctg

SEQ ID NO: 80748 - DNA, 908 bp, Zea mays
  misc_feature: Ceres CLONE 1566111
  misc_feature: Encodes the peptide sequence at SEQ ID NO. 80749
  misc_feature (842)..(842): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
  misc_feature (855)..(855): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (865)..(865): n is a, c, t, g, unknown, or other
  misc_feature (867)..(867): n is a, c, t, g, unknown, or other
  misc_feature (868)..(868): n is a, c, t, g, unknown, or other
  misc_feature (870)..(870): n is a, c, t, g, unknown, or other
  misc_feature (871)..(871): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (881)..(881): n is a, c, t, g, unknown, or other
  misc_feature (882)..(882): n is a, c, t, g, unknown, or other
  misc_feature (888)..(888): n is a, c, t, g, unknown, or other
ctccccgcggtggcggccgctctagaactagtggatcccccgggctgcaggaattcgtctcacccctagaaaaactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaggactacgccggcaagatcacgtgctgcaaggtgaacacggacgacagccccaacgtggcgtctacctacggcatccgcagcatccccaccgtgctcatcttcaagggcggcgagaagaaggagagcgtcatcggcgccgtcccgaagtccacgctcaccaccctcatcgacaagtacatcggtagttcatgagcatgccatgccatgccatgcatacatgcatcgacgactaaacacatatgtgtatctctagtagcctttgcatacgggatatgatcaatttcagcagccagccgtctgctactgctgtgttatatataccatacctccatgtcgaaatcagagtacattaattagttttcagtcacgatttcgattccgtatatatatatatatatatatanannnnnnnngngngtgnnnnngngnngnntnnnnttttnntttatnaaggtaaattaggaagaaat

SEQ ID NO: 80749 - protein, 167 aa, Zea mays
  misc_feature: Ceres CLONE 1566111
  misc_feature (60)..(163): Pfam Name: Thioredoxin Pfam Description: Thioredoxin
  misc_feature: SWISSPROT Homolog: EC 1.8.1.8 Protein-disulfide reductase
MAMETCFRAWALHAPAGSKDRLLVGNLVLPSKRALAPLSVGRVATRRPRHVCQSKNAVDEVVVADEKNWDGLVMACETPVLVEFWAPWCGPCRMIAPVIDELAKDYAGKITCCKVNTDDSPNVASTYGIRSIPTVLIFKGGEKKESVIGAVPKSTLTTLIDKYIGSS

SEQ ID NO: 80750 - DNA, 945 bp, Zea mays
  misc_feature: Ceres CLONE 1566113
  misc_feature: Translation starting site: 398
  misc_feature (734)..(734): n is a, c, t, g, unknown, or other
  misc_feature (797)..(797): n is a, c, t, g, unknown, or other
  misc_feature (846)..(846): n is a, c, t, g, unknown, or other
ctggagctccccgcggtggcggccgctctagaactagtggatcccccgggctgcaggaattcgtctcacccctagaaaaagccgggcagccccgcctcagctcctcaccctcctcgacaactctccctccggccggtcggcccccacgactccccggggcccgtcgtccgcacgggcacgggctgcacggtggtgggagcagagccagagcagccgaggaggcacatctactccgggctccggacctccctcggcctcaacccctctggagtctggattctgccatttcataccatctccgcttcgccactgccagcgcgctggccctggagcggaggcaagaggggtgactacaaggagcttttcgtcatggcactgcctaaggacggctgcctcgatggtgccaagatcacagatggtaggaggggtcggctacaaggagcttcttgtcatggcgctgcctaaggacgacagcatcgatggcgccaaggtcgcagaggccatcggcgtcaagctgccagacgtcgggggggccataaggactattttgaatagcagagaggccagagaatttgccagtggggcactagctggtgctatgtcaaaggctattcttgcacactctagagactatcaggacaagaatgattgtaggagtaggacctaggcacatttttggtagtttggtggatatcatccaacaaaacgggtggcaagggctttgggcagggaantacaatcacatgctccgcatcattccaacccaagcagtcgaactcggaacatttgaatgcgtncagaggagcatggcagaacacaagagaaatgtatagagacggatgcccnagatacagcttggtatatgaaaatcgagcttcacttcacctcttatctcagttgctattgccgtgctgctgctgaatacctgccacactgctgccatct

SEQ ID NO: 80751 - DNA, 958 bp, Zea mays
  misc_feature: Ceres CLONE 1566114
ctccccgcggtggcggccgctctagaactagtggatcccccgggctgcaggaattcgtctcacccctagaaaaaaatattctccgtactaattcgtttgatggtgctcaccacctggcagttgaagcaactattgtccctgttgatcttaatggcgaggactctgtatcccctgctgaagcacgagtacatgcctgaaacatcttaccatggtcagcgcccgcaaaaccagtagaggcagaaaaacacgtggtatgaaaagaacacggctctgttagtgctgtagttgaagatgctaagatgatacttgacgagagtttttgaggagaagactgatgatcacggagatacagtcaaggtgggcgctactcgaaagcggctgcttgctggagctactataagcgaacaagatgaagaacggagcgaagcacattcagaaagtgtttcacttggacggcagcgccgtaagacgcggcaaactgctggagcagtgacacatgccccatgacaaagacgttacaatctgagacacagtagagctgcaaatgctggcgctgcaacatgccgagcatagaaaacgacatcttcgagacgcagaaatatacataccgtagaaagctgctgctgatgacaccgactgaacatcataggttgctgcagaacctgcccctgaaagcaagagggttctgaatcgcagacttcgatgcatcccagtgcattgacttttccaggttaaagtgggtatgcccatccttaaaacgggaaggcccggcaaggaaaaagggattttttggaccgccaaatgcatgcgggattgcaaaaaactctccgaaacctttggagcggacccgaaattagccccttttattcctgggccaaccattctccccaaaaggcgggctttttccaaaagagtttgaaaaaagcccacaaggttttcccccttttgggccacaaaa

SEQ ID NO: 80752 - DNA, 988 bp, Zea mays
  misc_feature: Ceres CLONE 1566115
  misc_feature (92)..(92): n is a, c, t, g, unknown, or other
  misc_feature (94)..(94): n is a, c, t, g, unknown, or other
  misc_feature (95)..(95): n is a, c, t, g, unknown, or other
  misc_feature (133)..(133): n is a, c, t, g, unknown, or other
  misc_feature (328)..(328): n is a, c, t, g, unknown, or other
aaaagagaaggagaggaaaaaaaaaaacacacacagcgaaacccaggggccacaggcccattaacagcatttaggaaattgtggggggggtntnnccaaagctggagctccccgcggtgggcggccgcatcanaacagtggatcccccgggctgtttgcaaacgacgcacccctagaaaaatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcaacggcngtggcggtggcccgggcggcaaaatgaaggctcccttggctgcccccgcgggacgggaagctcaacgggccggcccaggggccccccccgggcccccccggaaccccgggcgctttttttttttttcggaaacccccggggccccccgggggcccaaaagggggaaaacaaaaaaaaacccggggccaccccacaaagaaccccgggccgggggggaggctttcccgggggcccccccccggggggggccccccccaaaaaaggaacaccccccgggggggacattctaaaaaaccccccggaaaaaaaaaaacaaaggggggggaagaacccgcccaaaaacctccgggggaaaaaaccgcgcggggggaaaaaaaaccccccccgggggggagccaccccccaacaacaccccaccaccaaaaaaaaagaatcccccggggggggggggcgccggccccccccccaaaaaaaaaaaaaaaaaaaggggccgcccccccccccccgaaagaaagaaaaaaccccccgggggagggagatttctgagggggccccccgaaaagaggggggtaccacccccccccaccaagggggctattgagggtggggagccgcccccccccgaaataaaaaataaggagccccccccccgcgggggga

SEQ ID NO: 80753 - DNA, 972 bp, Zea mays
  misc_feature: Ceres CLONE 1566117
  misc_feature: Encodes the peptide sequence at SEQ ID NO. 80754
gagctccccgcggtggcggccgctctagaactagtggatcccccgggctgcaggaattcgtctcacccctagaaaaaacgtccctgttcctgtccgactccgccgccggcggaaccccaaccggcgaggatggggaacatcttcgtgaagaagcccaagattaccgaagtggacagggccatcctcaccctcaagtacgcatcgccgcaagctcgcccagttccagcagcagcttgagaaggtaattgaagcagagaaggaagctgcacggcagttggttcaacagaagaagagagacagagctttgattgcactgaagaagaagaaagctcaggaagagctgttgaaacaagttgacacatggcaaatgaatgttgaacaacagctctcagatattgaactaccaagtaaacaaaaggctgtatttgaaagcctgaaggctggaaacgctgcccctaagtctatacagaatgagataaacattgatgatgtcgcacaactgatggattgacactgccgaggctaaggcttattcagatgaaataaatgctgttctgggtgagcagcctcccctgctgaagattaaagaagctgttatggcttgaattttgaaaacataaaaaacctcacctttgcccgtcggagtctttttgcccagaaccccgccgtggttacctgaagttaagaacctgaacgagaaaaatggaaaacccttcccggctgaccccgaaagcctgtgcccggaaggacttccactgaaggcgatatgaagcctcccctgatggtgccccttaccaaagcggcccaaataagaggccgcaccctccccgaaaaaaacccaaagtgttgtgaagggagcccccttccctggggttgtgggagtgagaactgagacattcgtgggggaccaggtttttttttgccccgagtttgtaaacaatcaccccttcttttttttggagctctagatag

SEQ ID NO: 80754 - protein, 47 aa, Zea mays
  misc_feature: Ceres CLONE 1566117
MNVEQQLSDIELPSKQKAVFESLKAGNAAPKSIQNEINIDDVAQLMD

SEQ ID NO: 80755 - DNA, 904 bp, Zea mays
  misc_feature: Ceres CLONE 1566121
  misc_feature: Encodes the peptide sequence at SEQ ID NO. 80756
  misc_feature (751)..(751): n is a, c, t, g, unknown, or other
  misc_feature (754)..(754): n is a, c, t, g, unknown, or other
  misc_feature (780)..(780): n is a, c, t, g, unknown, or other
agctccccgcggtggcggccgctctagaactagtggatcccccgggctgcaggaattcgtctcacccctagaaaaaagctcaccgccacctccacgctcgaagctcctcccgaaccggccgcatcgtcgccatggcagccgccgcttctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccagaaaacaaggtgccttctctagagcacgacaaccaggtgaaaggagagagcttggatttggttaagtacattgacagcaacttcaaaggtccatcgttgctccccgaggatcctgcaaagcagcagttcgctgaggagctgctcggatacactgatgcattcaacaaagcattttactcatgtttagtcgacagggaagatgtgtctgaggaagccgttgctgccttggacaaaatagaagacgccctggggaaattcaacgacggcccgttcttccttggtcagttcagtctggtggacgttgcgtatgtaccattcatcgagaggtttcagatactcctattccacataaagcactatgacatcacaaagggcagaccaanccntcagaaattcatcgaggaagtgtacnagatcgatgcgtacacacagactaaactggacccgcagtttttgcttgagcaaacaagaaggcggctgggattgcttaaagcctgtgaccaggacggactttcgcagatcacccgcgtagtaga

SEQ ID NO: 80756 - protein, 257 aa, Zea mays
  misc_feature: Ceres CLONE 1566121
  misc_feature: SWISSPROT Homolog: EC 2.5.1.18 Glutathione transferase
  misc_feature (207)..(207): Xaa is any aa, unknown, or other
  misc_feature (208)..(208): Xaa is any aa, unknown, or other
  misc_feature (217)..(217): Xaa is any aa, unknown, or other
MAAAASASSVKEVLPSPLTSASEPPPLFDGTTRLYVAYLCPFAQRAWIARNYKGLQDKIKIVAIDLADRPAWYKEKVYPENKVPSLEHDNQVKGESLDLVKYIDSNFKGPSLLPEDPAKQQFAEELLGYTDAFNKAFYSCLVDREDVSEEAVAALDKIEDALGKFNDGPFFLGQFSLVDVAYVPFIERFQILLFHIKHYDITKGRPXXQKFIEEVYXIDAYTQTKLDPQFLLEQTRRRLGLLKACDQDGLSQITRVV

SEQ ID NO: 80757 - DNA, 909 bp, Zea mays
  misc_feature: Ceres CLONE 1566123
  misc_feature: Encodes the peptide sequence at SEQ ID NO. 80758
  misc_feature (670)..(670): n is a, c, t, g, unknown, or other
ctccccgcggtggcggccgctctagaactagtggatcccccgggctgcaggaattcgtctcacccctagaaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctccagccctccgcaaggtttatgaccaaatgcctgagcctaggtgggttatttcaatgggcagctgtgccaacggtggtggatactaccattactcctactctgttgtacgtggatgtgaccgtatagtccctgtggacatctacgtccctgggtgcccaccaactgctgangcactgctgtacggcgttcttcagctccaaaagagatcaacaggcgtaatgattccctcactggtggacaagtgaagcatgctcctgctattctcggtcgctagttttctttgcatttgacctgcttgtccatctgaaataggacacacttgctcggattgcaagtctctctttttttcctggtgtgcctggaagagtatgtccagttgttgatgaacatatactctgtacagcagact

SEQ ID NO: 80758 - protein, 157 aa, Zea mays
  misc_feature: Ceres CLONE 1566123
  misc_feature (36)..(143): Pfam Name: Oxidored_q6 Pfam Description: NADH ubiquinone oxidoreductase, 20 Kd subunit
  misc_feature: SWISSPROT Homolog: EC 1.6.5.3 NADH dehydrogenase (ubiquinone)
  misc_feature (133)..(133): Xaa is any aa, unknown, or other
MSKTAEFVVSKVDDLMNWARKGSIWPMTFGLACCAVEMMHAGASRYDFDRFGVIFRPSPRQSDCMIVAGTLTNKMAPALRKVYDQMPEPRWVISMGSCANGGGYYHYSYSVVRGCDRIVPVDIYVPGCPPTAXALLYGVLQLQKRSTGVMIPSLVDK

SEQ ID NO: 80759 - DNA, 788 bp, Zea mays
  misc_feature: Ceres CLONE 1566125
  misc_feature: Encodes the peptide sequence at SEQ ID NO. 80760
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (97)..(97): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
ntttgttttnnnnnnnnnnnnnnnnnnnggggnnnnnnnaaannngggnnnnnnnnntttttttttaaactggactcaccgcgtggggccgctctanaatagtggacccccgggctgcaggaattcgtctcacccctagaaaaactctctagggtttttgattttagccgccgccgctgctcatctcacatccctcgagaagacgccttgctcctcgccgatcgatacgatggccgttcttctccgacctccacaccgccgacggcctcaagtccctcgaggctcacctcgccggcaaaacctatgtgtctggtgactccattactaaggatgacatttaagggctttcccccgcggttgccgtccaaaccctgggcgctggaattttcctaatgcccgccccgctgggtacgaaaaccgtctcctgccgcctgtaaccccccaaaaattcccccgggtaaaaggccttgttggggggtaaaaaaccccgcccccccccggggaatataaagcttccccttgtgggggaaaaatttttgtttccccctcgggggggtaaataaaaaaagccctcaaaaggggtttttttttttttttttttcccccccctctttanggnnnncccctcttttttttttgggggggggaggagaaaaacacccgcgggggggggggggagacacaaaaaaaaagaggggcccccccttttaaaaaaaaaaagggtggttttttcccccccctctttttcaaaaaaaggaggccccctcttctctttaataaaaaaaaat

SEQ ID NO: 80760 - protein, 29 aa, Zea mays
  misc_feature: Ceres CLONE 1566125
MCLVTPLLRMTFKGFPPRLPSKPWALEFS

SEQ ID NO: 80761 - DNA, 1064 bp, Zea mays
  misc_feature: Ceres CLONE 1566126
  misc_feature: Encodes the peptide sequence at SEQ ID NO. 80762
ggagctccccgcggtggcggccgctctagaactagtggatcccccgggctgcaggaattcgtctcacccctagaaaaaacctactccactctgagctcacaccaaacagcccgtgcaccaaggccaccattcacctccaccaagaacaaacgggaactcttcacagcttcgcacctcgcgtcacaacaccaagacgcacgtaggagggaacctcaagcttcagtcgtccatggctcagcagcaaacaaatcctgaagaggaggtcctcgggcaggaggtcggggccgcgagggtggccactctcaaccgcccgcgccagctcaacggcatctccgacagagtggtgtacctcctcccccaatttctgggaaaaggggacaaagataaaaacccaaatccccccactttaggggtgggccccccgcatttcctgcggggggagaacctaaaaatgttttttgaagggaaaatcaaaaaaatcccggccccaaaagtcggggaaaagaaatgaatggggttttggccaacccaatttcccccataaaaagaaaaaacaagggccgccctctttaatatggggtattgtcaaggggtggtggggggcctccaaagggtgtggccccccacaaaaaggttgggtcgggccatacaaataaaaaaagagatctttggcggaatcgtccaaaagtctaaagtgtgtctcataacacaccacaaatatggggtgacttttttttcaataccccactccccggggcttcccgagtttttattgcggccgaaaaatgccgcgtcaagaatgaggcggcagatcgaatttcccaccgggaaatagacgtttctgcatcgctctgtttatatctatgtttgactcgaccaccggacaaagatgccaagaatatcataagagaccccttccgattctgcaatatatagtagagatcaccgtcccccacaatatcggtattaccatttattcctaattatccccgcagcgacaatcagaaggcattttcataagcagtcttcgtcacgaatagcactctgctgggcggttaatcaga

SEQ ID NO: 80762 - protein, 93 aa, Zea mays
  misc_feature: Ceres CLONE 1566126
  misc_feature: SWISSPROT Homolog: EC 3.1.2.4 3-hydroxyisobutyryl-CoA hydrolase
MAQQQTNPEEEVLGQEVGAARVATLNRPRQLNGISDRVVYLLPQFLGKGDKDKNPNPPTLGVGPPHFLRGENLKMFFEGKIKKIPAPKVGEKK

SEQ ID NO: 80763 - DNA, 858 bp, Zea mays
  misc_feature: Ceres CLONE 1566127
  misc_feature: Encodes the peptide sequence at SEQ ID NO. 80764
aaagctggagctccccgcggtggcggccgctctagaactagtggatcccccgggctgcaggaattcgtctcacccctagaaaaaacaactcatcactcatcagcaatataatacccaagatacaatctaggcagcctacaatctaacgtactccaggctccagctgatttgtccacgcggcatggcgacggccagcgccgcttcaagcttcctcgtcccggcgactgctatcgccccgacaccctctgcatgcccatccacggttcccaagaacaagaagaatgctgccggccggcggcggcgcacattgcagtgcagggccagcggccggcggggcgacgacgaagacagccgcctcctctggctgccccggcgggaagtgctgaccggtctgggcggcccggccgccagcttcgtcggggtcccgggaatccggccttccatccgcccttggaaagcgaaacccccgtgggaaaaaccttcccccggcccggggcccaaagaaaggggtaaaccggggaaaaaaaccttgggggggggaggggttttcgggagccccccaaaaaaaagaaaaaatttttcccggtggggccccccccgggggggggatcacgggggggggcccccccccccccgcgagggggagaggaaaaattaccttccccccctcatagaagaagcataaggggggggggggtgggggaagcacacccctgcggcttttcaatatggtaggaggagggggggtgaggcgggtgtttcgtctatcacgctcatcccccctctccccgggttgaattatggacacaagctcatctatggaaaggagagggagagtgaccccgtatgaaggctgtg

SEQ ID NO: 80764 - protein, 167 aa, Zea mays
  misc_feature: Ceres CLONE 1566127
MATASAASSFLVPATAIAPTPSACPSTVPKNKKNAAGRRRRTLQCRASGRRGDDEDSRLLWLPRREVLTGLGGPAASFVGVPGIRPSIRPWKAKPPWEKPSPGPGPKERGKPGKKTLGGGGVFGSPPKKRKNFSRWGPPRGGDHGGGPPPPREGERKNYLPPLIEEA

SEQ ID NO: 80765 - DNA, 927 bp, Zea mays
  misc_feature: Ceres CLONE 1566128
  misc_feature: Encodes the peptide sequence at SEQ ID NO. 80766
  misc_feature (924)..(924): n is a, c, t, g, unknown, or other
  misc_feature (927)..(927): n is a, c, t, g, unknown, or other
ctccccgcggtggcggccgctctagaactagtggatcccccgggctgcaggaattcgtctcacccctagaaaaaaaaatcagcggtggggccgagagcgaccgccttccctctttatcctccccgtctcccgccgtcgtcttcactgattcactccgacgcctcccctgccgctgccgcaactgggaggcggtccctgtcgcgcgcgacgacgagccttcatgacggggacacgctgctgattcatagcgcaccacccgccggttcgccctcgggctctctcgcgcccctccaacggattactggtgcccaacgcttgtgcttgctgtgtagcctggcgcgtctgctcgcggccgatacctccgcggccggcggcgatgggccaggacctcgtcgagatccatccgagcgagctccagttcacctttgaggtgaagaaacaaagttcatgtgtcgtccacctaatcaacaagtccaacgactatgttgctttcaaggttaaaacaacatctcctaaaagatactgtgttcgaccaaatactggggttatccttcccaggaaaacatgtgaattcacagttaccatgcaagcgctccgaactgctccgccagacatgcaactaaaggacaagtttttggtacagaccacaattgttccttatggtacatctgacgaggaactcgttcctgcctttttctccaaagaactggcagatacattgaggaaagcaaattgagagttgttcttgttagtgcataccaatcctttgaagagcaaccgacttataaaattcatgaccctgagccagttgttgaagttcctgtactgaaagagtgccaatttagagaacgaagtgccgatgcctgcaaaaaagtcctgcccctctggtacagcctcagcgatggtgacgtggaatacctcacntgn

SEQ ID NO: 80766 - protein, 119 aa, Zea mays
  misc_feature: Ceres CLONE 1566128
  misc_feature (5)..(113): Pfam Name: Motile_Sperm Pfam Description: MSP (Major sperm protein) domain
MGQDLVEIHPSELQFTFEVKKQSSCVVHLINKSNDYVAFKVKTTSPKRYCVRPNTGVILPRKTCEFTVTMQALRTAPPDMQLKDKFLVQTTIVPYGTSDEELVPAFFSKELADTLRKAN

SEQ ID NO: 80767 - DNA, 950 bp, Zea mays
  misc_feature: Ceres CLONE 1566130
  misc_feature: Encodes the peptide sequence at SEQ ID NO. 80768
  misc_feature (771)..(771): n is a, c, t, g, unknown, or other
  misc_feature (787)..(787): n is a, c, t, g, unknown, or other
aaagctggagctcaccgcggtggcggccgctctataactagtggatcccccgggctgcaggaattcgtctcacccctagaaaaaccctccgcctcctgctctctctcgcctctggttggcagagctctcttgaagcctcgagactcgtctcgccgctgctccctcagctctgccgctgcgtgcctccgttagctgttgcattgcagcgcagccccgcgagccttgagctgctagctcgcccttcaccacagtcctcagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggcaccacgatggctggactcagggccatcggctacagcttcgattacgatgagtaccacgccttcgtccatggaaggctgccgtacgacaacatcaagcctgaccccattctcaagcacattctcaagaacctgcgcatccgcaaactcatattcaccaacggtgacatggtccacgccgtgagagccctcaagaggctgggcctggaggactgcttcgaggggatcatctgcttcgagaccctgaacccgccctgcccgccgcagggagaccaggagcccgagatcttcgacatcgccggccacttcngccgcttcggcaccgncgacgagctgcccaagaccccgtcctgtgcaagcctaacgtggacgccatggaggagcggctcaggatcgcaacgtcaacccgcacaagcgatcttcttcgacgacaggtagcacattcaggccggggagcgatgggctcccaacgtgctgggggcaatcgaa

SEQ ID NO: 80768 - protein, 212 aa, Zea mays
  misc_feature: Ceres CLONE 1566130
  misc_feature (171)..(171): Xaa is any aa, unknown, or other
  misc_feature (176)..(176): Xaa is any aa, unknown, or other
MEFEDRCHKVQEPKFDCLLFDLDDTLYPLSAGIAGHVKKNIEDYMVEKLGIDETKIENLGNLLYKNYGTTMAGLRAIGYSFDYDEYHAFVHGRLPYDNIKPDPILKHILKNLRIRKLIFTNGDMVHAVRALKRLGLEDCFEGIICFETLNPPCPPQGDQEPEIFDIAGHFXRFGTXDELPKTPSCASLTWTPWRSGSGSQRQPAQAIFFDDR

SEQ ID NO: 80769 - DNA, 862 bp, Zea mays
  misc_feature: Ceres CLONE 1566135
  misc_feature: Encodes the peptide sequence at SEQ ID NO. 80770
  misc_feature (862)..(862): n is a, c, t, g, unknown, or other
aaagctggagctccccgcggtggcggccgctctagaactagtggatcccccgggctgcaggaattcgtctcacccctagaaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgccggcgacgtgcacccggagagctggagggggttcagctccttcggcgggggctacgtcgtcacggccaggccccggggtcatggccgaggccctttcgcaggggccttcctaggggccaaaaaggtccttccgggaccaaactggaggtcggcaggggacggcaaaggccccggggctttatggcccggcccggggggggctttttggcgacccacaagaaaaagggccctccttaagggaagttgggaaaacccttttcccaaaatttgggttgggggggaaagggggaacccccatttcccccttttgggcccccttctgcgggagggcctccctgggggaacctccggagaaaataaacccccggggccccgaagaaan

SEQ ID NO: 80770 - protein, 232 aa, Zea mays
  misc_feature: Ceres CLONE 1566135
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRGFSSFGGGYVVTARPRGHGRGPFAGAFLGAKKVLPGPNWRSAGDGKGPGALWPGPGGAFWRPTRKRALLKGSWENPFPKIWVGGERGNPHFPLLGPLLREGLPGGTSGENKPPGPRR

SEQ ID NO: 80771 - DNA, 992 bp, Zea mays
  misc_feature: Ceres CLONE 1566136
  misc_feature: Encodes the peptide sequence at SEQ ID NO. 80772
  misc_feature (992)..(992): n is a, c, t, g, unknown, or other
aaagctggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctggggctgccaggtggtgctcatgggcgcggtcgaggggtaccgcatcgcctggggcccgctcggggaggtgggcgaccccgctgacccccggcgggaggcttcgaaccgctcgggctccgcggacaacccggaagccgttcccggagcccaagggcaaggaaatcaagaaaccggcggcccccccctggttctccaaggttgcgggttccttcgtggcagggccaactgtcaccgggccaagggtccccgttggaaaacctcgccgaacccctctcgtggacccgtgtaaaaaacaatccgctgggggcctagctatacaaaattttgtcccccgggaaagtgagccgaggggcctan

SEQ ID NO: 80772 - protein, 250 aa, Zea mays
  misc_feature: Ceres CLONE 1566136
  misc_feature (58)..(205): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWGCQVVLMGAVEGYRIAWGPLGEVGDPADPRREASNRSGSADNPEAVPGAQGQGNQETGGPPLVLQGCGFLRGRANCHRAKGPRWKTSPNPSRGPV

SEQ ID NO: 80773 - DNA, 843 bp, Zea mays
  misc_feature: Ceres CLONE 1566139
  misc_feature: Encodes the peptide sequence at SEQ ID NO. 80774
  misc_feature (478)..(478): n is a, c, t, g, unknown, or other
ctggagctccccgcggtggcggccgctctagaactagtggatcccccgggctgcaggaattcgtctcacccctagaaaaaaaacacaaggcgaccgcagagggcaggacaggacagagacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtggggcaggatccaaatggcggcggcaatagaggactgcggctcctgggatccatccctgtactggaagtccgggagagtcgacggcgtggtgggtgaagaagggcgaccgcgtagcggcggcgacgacgaagagatcctgcgattcatggactcggtggacagctacctgctcctcatggactccctatcctccgctcttcgtcagggctggncttgacctggcaagtgctcggccattctatgggcacatcacgcgtttccaagtacactgtttgatcccaaggagcagtctgctgccactaagcttcaaaatggttgatcatggaggcccgaaaacctccaaatccaaaccacccttttgcaaatcaaaggggtcctttgcaaaaagaattgcccctccccctttgactccgtgaaaaagggattttccctgagccaaaaaaaaagggcctcgagaataattttctccccccaaaaaagggaaaacctgtaaaagtggaaacccccaacaccttgttttaaagggggtgtggcccacatatatgtgttaaaagagggggaataaaaaatttttccc

SEQ ID NO: 80774 - protein, 66 aa, Zea mays
  misc_feature: Ceres CLONE 1566139
MAAAIEDCGSWDPSLYWKSGRVDGVVGEEGRPRSGGDDEEILRFMDSVDSYLLLMDSLSSALRQGW

SEQ ID NO: 80775 - DNA, 934 bp, Zea mays
  misc_feature: Ceres CLONE 1566143
  misc_feature: Encodes the peptide sequence at SEQ ID NO. 80776
  misc_feature (762)..(762): n is a, c, t, g, unknown, or other
  misc_feature (834)..(834): n is a, c, t, g, unknown, or other
  misc_feature (839)..(839): n is a, c, t, g, unknown, or other
  misc_feature (926)..(926): n is a, c, t, g, unknown, or other
ctggagctccccgcggtggcggccgctctagaactagtggatcccccgggctgcaggaattcgtctcacccctagaaaaactctcttcttctccccttccacccaaagccttgacctcacgtctgagagcaaaccagacgaaacaaaccctcctgggctgcttccccttttcgatccccatggcgcaggacgacatcccggagtcctccgcctccggatcccccacctcctccgccccggcggctcgcctcaacgccgccgcgcccgagtttaccccccgatccgccgcccagcaccacggcaacaacgcccatcgccgcggcccgcaccaccaccatcagccgcaccaccacccccactaccaccctcaccagcactaccagccgcggcaccagcaccatcaggcccaggccgaggatgaggggagcgccgccgcgacggcggaggatagggagggccccgctggtgcggtgcagccgcagcaccggctgcccgaacccgaggcccgcaagctcgtcaagcaggttgaattttacttcagcgatatcaatttggccacaactgaacatctgatgaagttcatcgctaaggatccagatggatttgtgccaatttctgtagttgcatcttttaggaagatccgagagatagtttatgatagatccttgttggttgctgcattacgcacatcatctgagctggttgtttcagaggatgggaaacatgttaaacgcttacagcccttcaatgccgaagaagttncagtctcgtattgttgttgctgaaaatttacctgaggatcaaaagcatcagactctgatgaagatttctcangctgntggggagtatgaccatgtctatacctggtacacaattagtgcgactcagataccatagtaatctcatgagagctatatgttacctgnattgcagg

SEQ ID NO: 80776 - protein, 201 aa, Zea mays
  misc_feature: Ceres CLONE 1566143
  misc_feature (112)..(171): Pfam Name: La Pfam Description: La domain
  misc_feature (195)..(195): Xaa is any aa, unknown, or other
MAQDDIPESSASGSPTSSAPAARLNAAAPEFTPRSAAQHHGNNAHRRGPHHHHQPHHHPHYHPHQHYQPRHQHHQAQAEDEGSAAATAEDREGPAGAVQPQHRLPEPEARKLVKQVEFYFSDINLATTEHLMKFIAKDPDGFVPISVVASFRKIREIVYDRSLLVAALRTSSELVVSEDGKHVKRLQPFNAEEVXVSYCCC

SEQ ID NO: 80777 - DNA, 876 bp, Zea mays
  misc_feature: Ceres CLONE 1566144
  misc_feature: Encodes the peptide sequence at SEQ ID NO. 80778
agagctggagctccccgcggtggcggccgctctagaactagtggatcccccgggctgcaggaattcgtctcacccctagaaaaaatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaaccccaggctccggcggctcgagcacccagacccgcgcttcctccgctacgccagccccgtgccgtcccacgcggaccacatggccatccttgcggcgccagagacccgggtcaccacactgcccaacggcctgcgcatcgccacggagtcttccctcgccgcgcgcacggctacggtcggcgtgtggatcgatgcgggcagcaggtacgagaacgaggaggcggtcggcgtcgcgcattttgtcgagcacatgctgttcaagggcacgggggaaacgcagcgccgcgcagctggagctggagatcgagggacatgggtggccaccttaaatgcgtacacgtcgcgggagcagagcacctactacgccaaggtgctttgacaaggacgtgccccggggcgaagggaggtcctcctcgggaaatccttccagaaattctaaatccccaacaagggccccgcattgaaacggtg

SEQ ID NO: 80778 - protein, 186 aa, Zea mays
  misc_feature: Ceres CLONE 1566144
  misc_feature: SWISSPROT Homolog: EC 3.4.24.64 Mitochondrial processing peptidase
MAFRRILSTAVRRRSAVAAAAAGNAREASTAVAAAPGVLAPDATAVRAPVMPYDRIAEAVNPRLRRLEHPDPRFLRYASPVPSHADHMAILAAPETRVTTLPNGLRIATESSLAARTATVGVWIDAGSRYENEEAVGVAHFVEHMLFKGTGETQRRAAGAGDRGTWVATLNAYTSREQSTYYAKVL

SEQ ID NO: 80779 - DNA, 1333 bp, Zea mays
  misc_feature: Ceres CLONE 1566145
  misc_feature: Encodes the peptide sequence at SEQ ID NO. 80780
  misc_feature (51)..(51): n is a, c, t, g, unknown, or other
  misc_feature (63)..(63): n is a, c, t, g, unknown, or other
  misc_feature (64)..(64): n is a, c, t, g, unknown, or other
  misc_feature (721)..(721): n is a, c, t, g, unknown, or other
  misc_feature (1030)..(1030): n is a, c, t, g, unknown, or other
  misc_feature (1202)..(1202): n is a, c, t, g, unknown, or other
agaggagggattccttgatttaaaagataaccgtgatgcatcatctttctntaagaggaaccnntaaagctggagctcaccgcggtggcggccgctctagaatagtggatcccccgggctgcaggaattcgtctcacccctagaaaaaggcccacgcaacgcaacgccgccggccacacgcacactgccacacggagctagctagctgcaccgatcctctcgcccgcccgcccgttaggccggttgctgacagtatctagccagcgaggagccgccgttgcttcctagctgcacctccgcgcgctgtctgcaggccagtcggtctcgatccccggccgaaagaaaaagacgacgccgacgatgaaggtgtcggtgctggcgccgtggtcgtctgcggcgctgctgctggtgctggtggcgcaagcgccatcggcggcggatggctcccaccacggcgggggcgggccacaagcctggggtactacaagaagacctgcccgggccgtcaagaacgtggaccaaagtacaaggtcgcccaagcccattaaaagcctaaccggatgggcccggaggcccggcgcttttttccgccctcaatcctttgcccacaaactggcttttcttgcaagggagggggtgcgaaacaaccgtttccggtggctcggccctgggaaccccgattacgtcccgggcgggaaacccccggtgtggaacccgccancaaaaccaaagggggggcccgaaaaatacataaatattccgaggaaccttgggctgctgcgccatatttgtgtaagaggcggaaattctcttacaacaaaaggaaattctaaaatgtggcgtgtggcagcccttcctctgtaatgtgaggaaaagcggttgtgtgtgctcctcccgcggtgtgtaaagaacacgccgaggtttctctaccttacgtagcgcccgtctcgggatcaacacaatcaccgcttcgggagtgggtagttatatgagcacccggagccccccctcgtgagaaaaaacagccggntttatactaaagatctacctgcacccgttagatatagaaatatacgagaggggtggacacactgcgtctcccaatatatctacttcaacagagcacccccctcctctcctgcgtgcgagtcggcgcactgtgagaattacaggactgatatattctaatgtatcctatgcgnggctctcacacccgcaaatacacacgacacacacgttgcaatcatctgatcgtgtgtgcagaaactcccaccactctccttcctcactctttggtatcgctcataatactatatattcctctcacatacgc

SEQ ID NO: 80780 - protein, 167 aa, Zea mays
  misc_feature: Ceres CLONE 1566145
  misc_feature (121)..(121): Xaa is any aa, unknown, or other
MKVSVLAPWSSAALLLVLVAQAPSAADGSHHGGGGPQAWGTTRRPARAVKNVDQSTRSPKPIKSLTGWARRPGAFFRPQSFAHKLAFLAREGVRNNRFRWLGPGNPDYVPGGKPPVWNPPXKPKGGPEKYINIPRNLGLLRHICVRGGNSLTTKGNSKMWRVAALPL

SEQ ID NO: 80781 - DNA, 1159 bp, Zea mays
  misc_feature: Ceres CLONE 1566148
atacgagcaaagccgcaatacaccaaaagatatcgggggtaaatgcacgcgttttctttgtttgggggattcccccaaagctggagctcaccgcggtggcggccgcatcccaacagtggatcccccgggctgctgtgattcgtctcacccctagaaaaagagcgaccgccctcgctgctctccctcaccctcgacgccgcgctcctccgcatcgccaatatcgccgacctctcccacctcccagaccacctcctcatcgatctcttccgtgtaggtacctcgccgcgccctccgccacctctcgaatctgtggcccgctgctgattgatcgtaccggtgccaaggctccgcgtgcttggattcggtttgggcacattttgcggcgtggatttagtagtttcggattgatcctggtggctggggctggggctgggtttgtccgctgttccagaggttacgctgcctgatccgttcttgttacgttctgtgccgcgtgcatggttgatagaacttgtggaattgtaggagggggcgagggttctgatcagttttctacgtgatctgcacgctttactaaaagttatcgaaatgtgggggatatgtcagccacctttttgatcggggttttccttggtttgaataccgggcatttggattttagttttgattattggttaaaaggcgtaccccaggagaatgaagatggggggttgttattggggtgaaaaatcccggggttcaagtggaaatgggaggtaggtccaaaatgggtggtacgggggcggtggaaaccgcttggtgtagaggggggggaagaggccctatctggagattttgattgaagcctgaattgtgaaggagggggggaccggcatatcgcgcaaacagaggcgccctcatgtagatgcctcttattggtgagatgcatagtagaacgtgcgggtctaacgagattttgtcggcgatccctatgggggaatcaccagtacccggctccagtggaagaagattgtggggagggggaagataataagtcgagagccacagcgtttccggggggggtagtagtaaatggtaaagtgaggggggggggaggatatccacatggatttgttacggagtggggcggcggcccgatactagtgtgtaatgtgggcgc

SEQ ID NO: 80782 - DNA, 905 bp, Zea mays
  misc_feature: Ceres CLONE 1566151
  misc_feature: Encodes the peptide sequence at SEQ ID NO. 80783
  misc_feature (33)..(33): n is a, c, t, g, unknown, or other
  misc_feature (361)..(361): n is a, c, t, g, unknown, or other
  misc_feature (363)..(363): n is a, c, t, g, unknown, or other
cggccgcattcgaactagtggatcccccgggcngtagcaattcgtctcacccctagaaaaaaccgcaccctctcactcatcgactttcgccgtagtagatggctagatgccaaaatcccaaatcccttgcgaacctcctaaacctaagcgatggcggtggcggcatcgccgtatttcctcttgctcttcctcttccattcattagctgcactcgcctccctcgcgccaccgccttctcagccaccaccgccgcgggtgcctcagaaagtgcaggtgtggcccaagccggtgtccatcttcgtgggcgttgtcgggatatacgccgatattcccctgggtccaccaaccacgcccccccccncnaaaccaatgggtttcttatcgccaatccggttaatttataccccccctctttttccctcggaggggggggagcacccccattattattccccccgcccaaaaaaaacacccacctggggggggggggtcccccattagggggttggggccggcccctccttggttttcacaaaaaaacaaaaaattcccccttttgccccccccggggtgtgtaaaaaaaaaatctttacacccgttttttttgggggggcgccccccaatttttacgcggcgtcccccggaaaaaatatttttggccgccccccccccccctcccccggggggggagatactcccgcggtgttctttaggaagaaatttttttttctcacgattgtcccccaaaggaaaaaaaagggggtcccccacaataaaaagggggggggaggcgagacaaaatttcttcccctcccccggcggtgtatggttaaaaggttgataaacccccctcctcgctgtgttttctcgcccgggtggggggggagggggtattttgttttggg

SEQ ID NO: 80783 - protein, 116 aa, Zea mays
  misc_feature: Ceres CLONE 1566151
  misc_feature (71)..(71): Xaa is any aa, unknown, or other
MAVAASPYFLLLFLFHSLAALASLAPPPSQPPPPRVPQKVQVWPKPVSIFVGVVGIYADIPLGPPTTPPPXKPMGFLSPIRLIYTPPLFPSEGGEHPHYYSPRPKKTPTWGGGVPH

SEQ ID NO: 80784 - DNA, 937 bp, Zea mays
  misc_feature: Ceres CLONE 1566152
  misc_feature: Encodes the peptide sequence at SEQ ID NO. 80785
  misc_feature (635)..(635): n is a, c, t, g, unknown, or other
  misc_feature (772)..(772): n is a, c, t, g, unknown, or other
  misc_feature (804)..(804): n is a, c, t, g, unknown, or other
ctggagctccccgcggtggcggccgctctagaatagtggatcccccgggctgcaggaattcgtctcacccctagaaaaagctcccgttcccatgctgatttttttaggcggctgctggcctgcctgtctccactggaagctccggattacgtagaaaaggggcgggcggcatgaggatccagtgcgacgcgtgcgaggccgcggcggccgcggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaaggacgcgctgccgcangaggtgccgtcctcgccgttcctgccacccgtcggttgggccgtcgaggacctcctcgagctgtcggactacgaatccagcgacaagaaagactcgtctcttgggctcaaggagctggagtggttcgaggacatcgnactggtccacgcccattcgccagctaaactgncatggcggagttctcgccctcgcgcatgcagtgagttacgccggggtctactagcggacggggcgcgcctgtccagaagtcccgatggagtgcctgacgacaaccacaagatacttcatcggtctgatctggg

SEQ ID NO: 80785 - protein, 255 aa, Zea mays
  misc_feature: Ceres CLONE 1566152
  misc_feature (55)..(102): Pfam Name: zf-B_box Pfam Description: B-box zinc finger
  misc_feature (1)..(47): Pfam Name: zf-B_box Pfam Description: B-box zinc finger
  misc_feature (155)..(155): Xaa is any aa, unknown, or other
  misc_feature (201)..(201): Xaa is any aa, unknown, or other
  misc_feature (212)..(212): Xaa is any aa, unknown, or other
MRIQCDACEAAAAAVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPXEVPSSPFLPPVGWAVEDLLELSDYESSDKKDSSLGLKELEWFEDIXLVHAHSPAKLXWRSSRPRACSELRRGLLADGARLSRSPDGVPDDNHKILHRSDL

SEQ ID NO: 80786 - DNA, 1077 bp, Zea mays
  misc_feature: Ceres CLONE 1566153
  misc_feature: Encodes the peptide sequence at SEQ ID NO. 80787
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (28)..(28): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (68)..(68): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (506)..(506): n is a, c, t, g, unknown, or other
ncccccgcganncnnnnacaccaagganancggggcnncccnnntattttnnnntttnnnnttttttngggggtnnnnnccaaactggagctccccgcggtggcggccgcatcagaagagtggatcccccgggctgtagcaatacggcgcacccctagaaaaagcaaaatccagtatttaagcgccgcggaacactcgtcgagaggagaggacagagcagaggaccaccaccggaccgggctggagctggaggcgtggcggcgccggcgcgtccatcaggaggagaaggggcagggatggtgctgggcggcggcatggcggcagcggccgtaggcggggacgacgccgtcgtcatgcagctgggcgccgccaagggcgaggagaccgtcgtcaacgtcaacggccccgacagacagggccggggttttttatttcggcccccccccccccgagggcgggcttccgaaatacccggggcggaagggcccaggggaggggccccccgntgccctcggggggggggccgggggaccaggcccccccctccccccgtccaaaaaagggggcccgggggggggaaggccccgagaaaaaccccggccgccagggggcgcaggggggcgcgtgatggtgggcggaaaaaagccaagaagccggcggtgggggatacgtacccggggggaagggggggggggccgacgcgccccaagagaggggtccgggggcggcgcgcctgcggggagagggaggggtgagggggcgccccccctccgagagggtgagggaggaagggggcgcgcgggtccgcggggggggggggggacaaaaagaagaaaaggtttggcgggcgggggggggggaggtgagggagagagacggcggaagaccgaagacggagtggaggaggacgagaaggggggggggggggggtgggcgcaaggaacacaaagggcccccccgagagggagaggagggagaaagggggcgaccggacggcgactcgaggagtggaaagaagaggggaggaagatggggggaggagggagcagcgcgcgggcggggagtgagagatgggcg

SEQ ID NO: 80787 - protein, 152 aa, Zea mays
  misc_feature: Ceres CLONE 1566153
MVLGGGMAAAAVGGDDAVVMQLGAAKGEETVVNVNGPDRQGRGFLFRPPPPRGRASEIPGAEGPRGGAPRCPRGGGRGTRPPPPPVQKRGPGGGKAPRKTPAARGRRGARDGGRKKAKKPAVGDTYPGGRGGGPTRPKRGVRGRRACGEREG

SEQ ID NO: 80788 - DNA, 927 bp, Zea mays
  misc_feature: Ceres CLONE 1566154
  misc_feature: Encodes the peptide sequence at SEQ ID NO. 80789
ctggagctccccgcggtggcggccgctctagaactagtggatcccccgggctgcaggaattcgtctcacccctagaaaaagtttgcttgacgttgcactaggtgcaccaagaagccaaagccaatggcgactctacctctgctcctgcacctgctatgggaggcctctccgtgggcccgtgcaggcgcggcgacggccgccgtggtgctggtgtggctagcggcctggacacttgagtgggcgtggtggacgccacggcggctagacagagccctacgggcccatgggcctcaagggcaccaggtaccgcctcctcaccggcgacgtgagggagaacgcccggctcaaccgagaagcccgcacgaagccactgccgcttgggagtcacgacatcatcccacgcgtgctacccatgttccacaacgcggtgaaggagaatgggacatattcattcacttggtttggcccgattccgagggtgataattccagacccggaattaatgagagaagttttgtctaacaagtttggccactttggcaaaccactgtgtagccgtgttggcaagttactagccaatgggctcgctaatcatgaaggcgagaaatgggcaaaacacaggagaattctctaccctgcattccatcatgagaaaataaagcggatgctgcctgtatttgctacctgttgtgccgatatgattaacagatgggataattcaatgtcttacaaggaaccttctgagatggacgtctggactgagctccaaaatcttactggagatgtatctcaagaaccgcattggtagcaacttcagggaggcaagaacatcttcagctacatgagagcaggctgaacgcctatacatctctccaccaattttttcccagctacggctcttgcccctaaatgcatatgtgtatgaat

SEQ ID NO: 80789 - protein, 174 aa, Zea mays
  misc_feature: Ceres CLONE 1566154
  misc_feature: SWISSPROT Homolog: EC 1.3.3.9 Secologanin synthase
MGLKGTRYRLLTGDVRENARLNREARTKPLPLGSHDIIPRVLPMFHNAVKENGTYSFTWFGPIPRVIIPDPELMREVLSNKFGHFGKPLCSRVGKLLANGLANHEGEKWAKHRRILYPAFHHEKIKRMLPVFATCCADMINRWDNSMSYKEPSEMDVWTELQNLTGDVSQEPHW

SEQ ID NO: 80790 - DNA, 1127 bp, Zea mays
  misc_feature: Ceres CLONE 1566155
  misc_feature (42)..(42): n is a, c, t, g, unknown, or other
  misc_feature (50)..(50): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (99)..(99): n is a, c, t, g, unknown, or other
  misc_feature (100)..(100): n is a, c, t, g, unknown, or other
  misc_feature (180)..(180): n is a, c, t, g, unknown, or other
  misc_feature (359)..(359): n is a, c, t, g, unknown, or other
  misc_feature (478)..(478): n is a, c, t, g, unknown, or other
  misc_feature (796)..(796): n is a, c, t, g, unknown, or other
  misc_feature (1083)..(1083): n is a, c, t, g, unknown, or other
atatcccacgagccccaccagccctaacggggccccgggaanattaacancttttnnnnntttttgggggnttnnnccaaaactggaactccgtgcggnnggtggccgctttcaagcgacaggtatcccccggggctgatagcaatacgggggaccccgtagaaaaaaggagtacacacnttctccttagaattgtgagctgtacgagccacccagcaactttcttcatcatcttcttcagccctcgctctgtccgtcgacacagcagctttgcttgccaccaagctagccatgcaggaggagtaagagtacaaccgtaggagagagagagagagagagagagagaaggagagagaganggaggtggaggaggagggaaaagaggaaaaaaggggagaaaagaagaggggggaagagaggggggaggttttttttttttttccccccccccccccggggggggtttgtttttatttanggaaaaaggcccccaccaaaaaaaaaaaaagaggaatggggcggggggaggggggagggacctacacgatgcagcggccgcatgaacaggggcggcgcggggacaaggtgagggggaaagagacagaaggtggaggggcggaggggcgacggagggattgggggaggaggggcggaggggaaggctaacggaagtggagatatagaggaagacgggagggaagaggacacaatggggaagcgagaaggaagcgcgagggggtgaaagaggaagggggaggtgggaggttatgaggaaggattagggggcgacatgggngaaggactgaggaagcgaaaaaggcgagccaacaaataacgtggaagaaggagggcgcgggcgagcaatggggggggcgagacgaagatgagagacagaaaatgacggggggagatgggctagaccgtgagcagcggaaaggagatgggatggggagcggaggcgggaagtaaaaaacggcggcgccaaggcgcggattgaatgaggcgcgggcaaggaggtggcacgtcggaatgagcgcggcccgacgctgaggtgatcataatatggtagtagagctgtcagcntgggcagaaaagaaaagggtacaggagaggggtggaagaacgag

SEQ ID NO: 80791 - DNA, 884 bp, Zea mays
  misc_feature: Ceres CLONE 1566156
  misc_feature: Encodes the peptide sequence at SEQ ID NO. 80792
  misc_feature (353)..(353): n is a, c, t, g, unknown, or other
  misc_feature (377)..(377): n is a, c, t, g, unknown, or other
ggagctccccgcggtggcggccgctctagaactagtggatcccccgggctgcaggaattcgtctcacccctagaaaaacacattatgaccctggaatccagagtatcttaaaatttattctttatggtcaagtggaattgctagttctgtttcccccttagccatggaaatatatcattaatatttgatgtacaaatacataggttcatctgactaacaaaatctttttttagatataactaccgcagccgttgctaaacaagctttggagggacactgcatatatgatggtggttactgtaagcttcatctgtcatactctcgtcatactgatctcaatgtaaaggcacatngatgagagaagcagggactacacntctttcagaaccctaacgtgcagcctgcaaagctgcctgcacaaaaaccccagttcttaagtcctccgggagtgggttggcaaaacctgcatcaataccagctgctcctttttatgcaagccaggcaacttcaatcccatttgaagtttgaagggggcttcttgaaacccaacctgtgaggcggggattttttgatttggtctgaagggaatccccaaccaacattttagggccaaccccgggcccccaatatccgggttttggaaaaaaatccggggcccccccccataaaattttttggggtttccccccaaaaaaaaccttttttttttgcccccctcggggtggtcccccccaaaacacacaaaagggggggattatttttttttttcccccaaaaaaaaggggggtttggggccaaattttcccaaaaaaaacaaccccgcggggtgttttttctccccgacaaaattatgtgtgggcccacaaaaaaatattttcttttta

SEQ ID NO: 80792 - protein, 36 aa, Zea mays
  misc_feature: Ceres CLONE 1566156
GAPRGGGRSRTSGSPGLQEFVSPLEKHIMTLESRVS

SEQ ID NO: 80793 - DNA, 864 bp, Zea mays
  misc_feature: Ceres CLONE 1566157
  misc_feature: Encodes the peptide sequence at SEQ ID NO. 80794
  misc_feature (847)..(847): n is a, c, t, g, unknown, or other
gagctccccgcggtggcggccgcactacaactagtggatcccccgggctgtatgtcattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgcccggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctctttacgtccacggtcatgagcctgctcctggcgcgccccaacgtcaagctgttcaacgccgtggcccgtggaggacctcatcgtcaggggaagggcgcgttcgggggggttcgtcaccaactggggcgctcgtggccattgaaccacgaaacgcaagtccctgcatgggaccccaacggtcattngagggccaaaggttcta

SEQ ID NO: 80794 - protein, 237 aa, Zea mays
  misc_feature: Ceres CLONE 1566157
  misc_feature (64)..(233): Pfam Name: Thi4 Pfam Description: Thi4 family
  misc_feature (232)..(232): Xaa is any aa, unknown, or other
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVARGGPHRQGKGAFGGVRHQLGRSWPLNHETQVPAWDPNGHXRAKGS

SEQ ID NO: 80795 - DNA, 924 bp, Zea mays
  misc_feature: Ceres CLONE 1566160
  misc_feature: Encodes the peptide sequence at SEQ ID NO. 80796
  misc_feature (773)..(773): n is a, c, t, g, unknown, or other
  misc_feature (785)..(785): n is a, c, t, g, unknown, or other
  misc_feature (876)..(876): n is a, c, t, g, unknown, or other
  misc_feature (882)..(882): n is a, c, t, g, unknown, or other
  misc_feature (924)..(924): n is a, c, t, g, unknown, or other
ctggagctccccgcggtggcggccgctctagaatagtggatcccccgggctgcaggaattcgtctcacccctagaaaaaatactctgtctggctgcccgctagcttgctgccatccctcaccgtccctcccccagattccctctcctcgcgcgcggcattccgcatcggcgcatggcatggccaccccgggggccacctgcgccatctcgtccgcgctggcccgcccgcctgcgctcctcgactacgccgccatccacgcgtgcctgctccgcggcgacgcgcggcgctccctgccgctgctcgcgctgctgctccttctccacttccgcctcctcgccgccgcggcctcggcgcgcttcaccccggcggtgtcccgcctcgccgcgcgcctgcggctctcgccgtccatggccgccgtcacgctgctcgcgctcggcaacggcgcgcccgacgcgttcgcgtccgccgcggcgctcgggggcccccggggcatgcccagggccgggctcgccgccgtgctctccgcgggcgccttcgtctccgctttcgtcgtcggggccgtcgcgctcgtcgccgcgcccttcgccgtcccgccgccgtcgttcgcgcgcgacgtcttcttctacctcctcgccgcgtccgcgctgttctacgtttacctcagcgccgagatcttcctctggcaggccgtcgggtttgtgctcttctatgcctttctcgtggggctagtcttctacatggattttggggagcgcggacggggagaaaggcngtcagcgccgcngcagctgaactgggagatggtgagtggcagtgaccgtgtgggcgtggacctgccgatcaccgtggaggatcacaggcacaacgacgacccncctggngtgcgttgctctggaagattcaaggaagaaacaaatctgcan

SEQ ID NO: 80796 - protein, 248 aa, Zea mays
  misc_feature: Ceres CLONE 1566160
  misc_feature (52)..(185): Pfam Name: Na_Ca_ex Pfam Description: Sodium/calcium exchanger protein
  misc_feature (199)..(199): Xaa is any aa, unknown, or other
  misc_feature (203)..(203): Xaa is any aa, unknown, or other
MATPGATCAISSALARPPALLDYAAIHACLLRGDARRSLPLLALLLLLHFRLLAAAASARFTPAVSRLAARLRLSPSMAAVTLLALGNGAPDAFASAAALGGPRGMPRAGLAAVLSAGAFVSAFVVGAVALVAAPFAVPPPSFARDVFFYLLAASALFYVYLSAEIFLWQAVGFVLFYAFLVGLVFYMDFGERGRGERXSAPXQLNWEMVSGSDRVGVDLPITVEDHRHNDDPPGVRCSGRFKEETNL

SEQ ID NO: 80797 - DNA, 938 bp, Zea mays
  misc_feature: Ceres CLONE 1566163
  misc_feature: Encodes the peptide sequence at SEQ ID NO. 80798
  misc_feature (766)..(766): n is a, c, t, g, unknown, or other
  misc_feature (770)..(770): n is a, c, t, g, unknown, or other
  misc_feature (771)..(771): n is a, c, t, g, unknown, or other
  misc_feature (915)..(915): n is a, c, t, g, unknown, or other
  misc_feature (931)..(931): n is a, c, t, g, unknown, or other
tggagctccccgcggtggcggccgctctagaactagtggatcccccgggctgcaggaattcgtctcacccctagaaaaagctcgccctccacttccgccgccgccgcctcgctcctccctcgccgccgcttcctgccctcccgccgaagaagagcaagctcccgagccaccaccatcatgtcggcgttgggcgatgacccgatcagggaatggattcttacagaagggaaggccacgcagataaaagggatcaggtccattggtggtggctgcattaactccgctcagcgctatgataccgacgcgggccccttctttgtgaagaccaacagccgcattggtccagaaatgtttgaaggggaggctcttggtttgaaggcaatgtatgacacaaagtcgatccgtgttccgttgccatacaaggttggttctttacctacaggtggttcttttatcatcatggagtttattgaatttggtcgttcaaggggagaccagtcagatttgggaaggaagcttgctgaaatgcataaggctgctaaatctgataaaggatatggtttcccggttgacaatactattggaagcactccacaaattaacacttggactgatgactggattgagttttactccaagcatagattgggttaccagttggagttggcatcgagacgatatggagattcggccatactcgaaaaaagtcagcggttgatcaagaatatccgcccactttttgatggagcgggttattgagcatgcntgcnntcatggtgatctggggagcggaaacataagctctgatagcaatggggatcctggtatattggatcctggctgctactggtagtaaactgactgattttagtatccgattcaggatcatggggtaggggttgcaaagatgaattnaatgcccccttccagnaatttcc

SEQ ID NO: 80798 - protein, 193 aa, Zea mays
  misc_feature: Ceres CLONE 1566163
  misc_feature (9)..(194): Pfam Name: Fructosamin_kin Pfam Description: Fructosamine kinase
MSALGDDPIREWILTEGKATQIKGIRSIGGGCINSAQRYDTDAGPFFVKTNSRIGPEMFEGEALGLKAMYDTKSIRVPLPYKVGSLPTGGSFIIMEFIEFGRSRGDQSDLGRKLAEMHKAAKSDKGYGFPVDNTIGSTPQINTWTDDWIEFYSKHRLGYQLELASRRYGDSAILEKSQRLIKNIRPLFDGAGY

SEQ ID NO: 80799 - DNA, 844 bp, Zea mays
  misc_feature: Ceres CLONE 1566164
  misc_feature: Encodes the peptide sequence at SEQ ID NO. 80800
  misc_feature (797)..(797): n is a, c, t, g, unknown, or other
ctggagctccccgcggtggcggccgctctcgaactagtggatcccccgggctgcaggaattcgtctcacccctagaaaaaagacgaccactgtatgcttgtggaaatgggcagcagagcagctttcgtggtcgcgtttctcctgagggctatatatgcaggcacgcagatactcaccaaggctgccttcgatgaaggcatgaacacgtcggtctttgttttctacaggcatctgactggtatcctcttcttggtgcctattgcttttgtgcttgagaggtaaatcgatacgactcttgcctgtttactactactactacatagctgatgctgctcacaccatgacagaatgaattcaggcttcttgttttttttcaggaaaactgcccctccactgtcattcagagtctctctgaaattgtttttccatgcactatacgggtaggtgaaagcagtggttttgtctcttcatgcatgtttaaccacacaggtttcgtaatcttaagttttggaagctcctgtcagacacctatgctttgacttacatatgacttcgttcgagtgcataccttgtgcgaagctatcaagttcccagtgaattgttatacttaatattttctataaatctaatcaaatctgagaaactttggccggttatattatatcgatgattattttaggaccgagggagtatatgatatgtgcagaatttatcaaaaagattgctatttgagcccagtgaattgttctgttagtaaataaatggtagtactgtgtagcgagttttttttttttcgntcagtttgtgtccctttgtaacgctgcatagtcactaataattatga

SEQ ID NO: 80800 - protein, 58 aa, Zea mays
  misc_feature: Ceres CLONE 1566164
MGSRAAFVVAFLLRAIYAGTQILTKAAFDEGMNTSVFVFYRHLTGILFLVPIAFVLER

SEQ ID NO: 80801 - DNA, 911 bp, Zea mays
  misc_feature: Ceres CLONE 1566165
  misc_feature: Encodes the peptide sequence at SEQ ID NO. 80802
  misc_feature (751)..(751): n is a, c, t, g, unknown, or other
  misc_feature (853)..(853): n is a, c, t, g, unknown, or other
  misc_feature (879)..(879): n is a, c, t, g, unknown, or other
ggagctccccgcggtggcggccgctctagaactagtggatcccccgggctgcaggaattcgtctcacccctagaaaaacaccccgatcccgtccgtccggctagatctcgcctgcgctccgcttccccccatctcccacctagatcttgccgcgatgggcctcgccgccgccgcccgcgcggtcctcttcctcctcgccgtcgccggggtcatcttccgtccggcggtggcggagatcaagcaggagtccttcaaggacgactcccgcggttccattctcttcgagaagttcggcttcggcccccacggcatggtctcaatctccgtcaccggcgccaaggcctcctccgcgctcgctaagcccgatccggcacagctcggcttcttccttctctccgacgagtcgctcttcgaggccatctacgatcagccggcacccacggatctgaaccccaacccggagtcctccccgacctgcgtcctctccagcccctacgtgaagccgctcttcaccttcgcagagctcgatgacaagggtttccacaaccagactttccccatcacccaccccgacgagtacagcctctttttcgccaactgcgcgccggagaccagcgtcaccatggaggtccgcaccgacatgtacaacaccaacctggacggcaccaaggactacctctccgtcggcatggcctccgtcccggcgatctacgccttcttcgccgtctgctatgtcgtattcctggccggntggctctacgtcacccctctacgaatccgtcctctcgcgcagcgcatccacccactcatgtccgggcctggctcgtgcggcgatgctctactgcatctcggncggcgaggacagcactacatccagancgcgggacacgcacgggtgggacatcattgtc

SEQ ID NO: 80802 - protein, 252 aa, Zea mays
  misc_feature: Ceres CLONE 1566165
  misc_feature (242)..(242): Xaa is any aa, unknown, or other
MGLAAAARAVLFLLAVAGVIFRPAVAEIKQESFKDDSRGSILFEKFGFGPHGMVSISVTGAKASSALAKPDPAQLGFFLLSDESLFEAIYDQPAPTDLNPNPESSPTCVLSSPYVKPLFTFAELDDKGFHNQTFPITHPDEYSLFFANCAPETSVTMEVRTDMYNTNLDGTKDYLSVGMASVPAIYAFFAVCYVVFLAGWLYVTPLRIRPLAQRIHPLMSGPGSCGDALLHLGRRGQHYIQXAGHARVGHHC

SEQ ID NO: 80803 - DNA, 947 bp, Zea mays
  misc_feature: Ceres CLONE 1566167
  misc_feature: Encodes the peptide sequence at SEQ ID NO. 80804
  misc_feature (649)..(649): n is a, c, t, g, unknown, or other
  misc_feature (652)..(652): n is a, c, t, g, unknown, or other
  misc_feature (700)..(700): n is a, c, t, g, unknown, or other
  misc_feature (829)..(829): n is a, c, t, g, unknown, or other
  misc_feature (830)..(830): n is a, c, t, g, unknown, or other
ggagctccccgcggtggcggccgctctagaactagtggatcccccgggctgcaggaattcgtctcacccctagaaaaaacaagcaccagaccaattaactagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacngcngcggcgccaacgtcgtggcgcccggctacaccaagggcgacggcctangcgccgagatcgtcggcaccttcatcctcgtctacaccgtcttctccgcccacgacgccaagaggacgccagggactcccatgtgccgatcctcgccctccttcaatcggggtttgccgtggtcctcgnntcactgggcacatccctatcacgggcacggcatcaacccgcgcggagcttggcgccgccgtatttacaacagcacatgcctgggctgacactggatcttctgggtcgcccctcatcg

SEQ ID NO: 80804 - protein, 252 aa, Zea mays
  misc_feature: Ceres CLONE 1566167
  misc_feature (46)..(246): Pfam Name: MIP Pfam Description: Major intrinsic protein
  misc_feature (164)..(164): Xaa is any aa, unknown, or other
  misc_feature (165)..(165): Xaa is any aa, unknown, or other
  misc_feature (181)..(181): Xaa is any aa, unknown, or other
  misc_feature (224)..(224): Xaa is any aa, unknown, or other
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNXXGANVVAPGYTKGDGLXAEIVGTFILVYTVFSAHDAKRTPGTPMCRSSPSFNRGLPWSSXHWAHPYHGHGINPRGAWRRRIYNSTCLG

SEQ ID NO: 80805 - DNA, 943 bp, Zea mays
  misc_feature: Ceres CLONE 1566171
  misc_feature: Encodes the peptide sequence at SEQ ID NO. 80806
aagctggagctccccgcggtggcggccgctctagaactagtggatcccccgggctgcaggaattcgtctcacccctagaaaaaacatctcaagccaccatcgaccttcaagtctcgctacgtagcagtgcaataaaaaaagcagccgcaatggcgagcagcaccatggccctttcctccacggccttcgccggcaaggccgtgaacgtgccgtcgatcgtccgccttcggcgaggcccgcgtgacgatgcgcaagacggcagagaaggccaagccagcggcggcgtccgggagcccgtggtacggccccgaccgcgtgctgtacctgggcccactgtccggcgagccaccgagctacctgacgggcgagttcccggacgactacggctgggacaccgcggggctgtcggcggacccggagacgttcgccaataaccgggagctggaggtgatccactcccgctgggccatgctgggcgcgctcagttgcgtcttccccgagctgctcgcccgcaacggcgtcaagttcagcgaggccgtgtggttcaaggtcggctcccatatcttcagcgagggcgggctggactacctcgggaacccgatcctcatccacgcacagagcatccttgctatctgggcctgccaggtcgtgctcatgggcgccgtctaaggctaccgcatcgccggcggcccgcttcgcgaagtcgtcgacccgctcttaccctgcggcagcttctacccgctcggcctcgccgacgacccgaaagccttcgccgagctcaaggtcaaggagctctagaacaggcgcctcccccatgttctccaagttcggaattcttcgtcaaggcatcgtcaccggggaagggcccgcttcaaaaactcccttgacaacagtggccgaccccgttaacaaaaacgcttgtgcctagggcaccaatttggta

SEQ ID NO: 80806 - protein, 140 aa, Zea mays
  misc_feature: Ceres CLONE 1566171
  misc_feature (33)..(141): Pfam Name: Chloroa_b-bind Pfam Description: Chlorophyll A-B binding protein
MRKTAEKAKPAAASGSPWYGPDRVLYLGPLSGEPPSYLTGEFPDDYGWDTAGLSADPETFANNRELEVIHSRWAMLGALSCVFPELLARNGVKFSEAVWFKVGSHIFSEGGLDYLGNPILIHAQSILAIWACQVVLMGAV

SEQ ID NO: 80807 - DNA, 840 bp, Zea mays
  misc_feature: Ceres CLONE 1566172
  misc_feature: Encodes the peptide sequence at SEQ ID NO. 80808
  misc_feature (629)..(629): n is a, c, t, g, unknown, or other
tccccgcggtggcggccgctctagaactagtggatcccccgggctgcaggaattcgtctcacccctagaaaaaccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcgccgccgtcggtgccggcctccattgtcagccccctgctcaggacggggtaccatttccagccgccaatgaactggatcaacgaccccagcgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgaacagtacggctgctggtcgggctcggcaaccaatctggaagacggcacgccggcaatcctgtaccggggaacgacggggcgacatcaaataccagggcagggggtgggctctcccaaggaactttcaaaccgtgttttccnaatgggaaaaacccgaaaaaaaaacccggtgggaaaccccggggccgggggtttaaagcggaacaatttctccacaccccaaaacgttttgcccccccgggaaacttggaaattttgggggaacctttccccccccccccgggagatcttttttcttccccccccccttctttttggaaaaggaaaagaaaaaaccccctctcttcttggg

SEQ ID NO: 80808 - protein, 239 aa, Zea mays
  misc_feature: Ceres CLONE 1566172
  misc_feature (58)..(223): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (169)..(169): Xaa is any aa, unknown, or other
MGTRPRGVVLAPWAVVLVLVLALRLAGASHVIHRSLEAEAPPSVPASIVSPLLRTGYHFQPPMNWINDPSAPLYYKGWYHLFYQYNPKGAVWGNIVWAHSVSRDLINWVALEPAIYPSIPSEQYGCWSGSATNLEDGTPAILYRGTTGRHQIPGQGVGSPKELSNRVFXMGKTRKKNPVGNPGAGGLKRNNFSTPQNVLPPRETWKFWGNLSPPPREIFFLPPPLLFGKGKEKTPSLLG

SEQ ID NO: 80809 - DNA, 1165 bp, Zea mays
  misc_feature: Ceres CLONE 1566173
  misc_feature: Encodes the peptide sequence at SEQ ID NO. 80810
  misc_feature (31)..(31): n is a, c, t, g, unknown, or other
  misc_feature (32)..(32): n is a, c, t, g, unknown, or other
  misc_feature (271)..(271): n is a, c, t, g, unknown, or other
  misc_feature (282)..(282): n is a, c, t, g, unknown, or other
  misc_feature (283)..(283): n is a, c, t, g, unknown, or other
  misc_feature (285)..(285): n is a, c, t, g, unknown, or other
  misc_feature (597)..(597): n is a, c, t, g, unknown, or other
  misc_feature (709)..(709): n is a, c, t, g, unknown, or other
  misc_feature (801)..(801): n is a, c, t, g, unknown, or other
  misc_feature (1110)..(1110): n is a, c, t, g, unknown, or other
  misc_feature (1131)..(1131): n is a, c, t, g, unknown, or other
aaagctggagctccccgcggtggcggccgcnnctcaactagtggatcccccgggctgcaggtattcgtctcacccctagaaaaaacagccatcacacgcacgcatacacagcactttttgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccgtgcgcaagactgatggaaagnccaaaccaacnncntcccgcagcccctggtacggggccgaccgcgtcctgtacctgggcccgctgtgcggtcagcccccaagctacctgaccggccacccccccggcgactatgggtgggacaccgcgtggatgcccccccacccggaaactgttgtccagaaccccgagcccggacgtgacaccactacctcctaggccaagcctgggcgtcccccggagcgagacgttccccggagctagagggcccgcttacgaggcgtccagttacgggcagaagaccatgggtgccacaaagggagcggggatccgtaaatcctttcaagnggacgggcggggtcctaggtacttaccttccaagtgaacaccggaacgcgccggaagtaccgcggtgctcagccagccaagaacacgcggagtgcagtatctggggcaatcntagcgcaggagaagaggaggcgcgaccaatatctggagccagccctaaaggcgaagagtggagggataccacttcacacaacgaaggagggnagagggctacctgagcttaaaggggtaaagggatgttgtcacgaagtcgcggttatttggagactgacgaggtatggtatgagggcgccatgaagacggtgaacggtaagaaccactcactacacataaccccgaggaagtgtcgtaagaaacggaaggcatgacacggccgcccgtatagacaaattaacctccgacccagggtgcgacaccgggtttagacaatttgtatcggttgcccacatttactccgctccagttagtgagcggacataagacgacctacacgaagaaccttgtatagcacgnccggcggttaagcgtaaaacngaaataaaagacacacacacgagtggagaaggtt

SEQ ID NO: 80810 - protein, 103 aa, Zea mays
  misc_feature: Ceres CLONE 1566173
  misc_feature (39)..(39): Xaa is any aa, unknown, or other
  misc_feature (43)..(43): Xaa is any aa, unknown, or other
MAAATMALTSRALVGKPATSTRDVFGEGRITVRKTDGKXKPTXSRSPWYGADRVLYLGPLCGQPPSYLTGHPPGDYGWDTAWMPPHPETVVQNPEPGRDTTTS

SEQ ID NO: 80811 - DNA, 831 bp, Zea mays
  misc_feature: Ceres CLONE 1566174
  misc_feature: Encodes the peptide sequence at SEQ ID NO. 80812
ccccgcggtggcggccgctctagaactagtggatcccccgggctgcaggaattcgtctcacccctagaaaaacaggaagagcagcaccatcaccagctcttctccatcaagagtaacaggccatcgccttaccagttctgatcccaaatcatttacggcgtaggtgcctcttgctcaaaacccagccccacagcaatggagtgcgagaacggccgcgttgctgcaaccaacagcgattccctgtgcatggcgacgccccgcgccgacccgcttaattgggggaaggcggcggaggagctgatgggcagccacctggacgaggtcaagcggatggtggccgagtaccgccaacccttggtgaagatcgagggcgcaagcctcagcatcgcgcaggtggccgctgtggccaccggcgctggcgaggcccgggtcgagctggacgagtcggcccgtagccgggtcaaggcaagcagcgactgggtcatgagcagcatgatgaacggcaccgacagctatggcgtcaccaccggcttcggcgccacgtcgcacaggaggaccaaggagggcggcgctctccagagggagctcatcaggttcctcaacgccggcgccttcggcaccggcgcggacggccacgtcctgccggccgaagcgacgcgcgcggccatgctcgtccgcatcaacaccctcctccaggggtactccggcatccgcttcgagatcctcgaggcgatcgtcaagctgctcaacgccaacgtcacgccgtgcctgccgctccgcggcacggtcaccgcgtccggcgacctcgtgcggctctcctacatagctggc

SEQ ID NO: 80812 - protein, 212 aa, Zea mays
  misc_feature: Ceres CLONE 1566174
  misc_feature (54)..(212): Pfam Name: PAL Pfam Description: Phenylalanine and histidine ammonia-lyase
  misc_feature: SWISSPROT Homolog: EC 4.3.1.5 Phenylalanine ammonia-lyase
MECENGRVAATNSDSLCMATPRADPLNWGKAAEELMGSHLDEVKRMVAEYRQPLVKIEGASLSIAQVAAVATGAGEARVELDESARSRVKASSDWVMSSMMNGTDSYGVTTGFGATSHRRTKEGGALQRELIRFLNAGAFGTGADGHVLPAEATRAAMLVRINTLLQGYSGIRFEILEAIVKLLNANVTPCLPLRGTVTASGDLVRLSYIAG

SEQ ID NO: 80813 - DNA, 910 bp, Zea mays
  misc_feature: Ceres CLONE 1566175
  misc_feature: Encodes the peptide sequence at SEQ ID NO. 80814
aaagctggagctccccgcggtggcggccgctctagaactagtggatcccccgggctgcaggaattcgtctcacccctagaaaaaatctctctctcccgcgcgcgcgggtgagccggggaccctcctacgtctcgccaccctgctggtatagcccgccggtcgtccacgccatggccacccaatatgcgcggctctccctgccatgccgcctgccctcgccgctccctccgccggtgccgacgacgacccgccggctgccgcgcgccgcggcggcggcggcgtccacctccccgcggtgcccacgcgtcgggggcgcggcggccacgcgcgcccgcggcccgtgccggcctcgcgcctccgagggcgaagtgcagcagcaggaggcggaagcggaccaggtggtggacagcaacatgctgccctactgcagcatcaaccgcaaggagaagaagagcatcggggagatggagcaggagttcctccaggcgatgcacgccttctactacgaaggcaaggcgatcatgtcgaacgaggagttcgacaacctcaaggaggagctcatgtgggaagggagcagcgtcgtgatgctaagcccagatgagcagaagcttttggaaagccgcatggcgtatgtctcgggcaaccccatcatgaccgatgatgaaatcgatccactaaagctgagactaaagaaagaaggaagcgacattgtacaggaaggttccaagatgcagccctacggagtccgaaaggtcttacagggacttgactggtgaacaacttgaagaagttggctcctaaatgttccccgcaaccggttgtaaactccgggaacaattcgtccctttttggaaaaatttcccccgggaatttgaaatctacatttccttccttgaagttgcccggaaaa

SEQ ID NO: 80814 - protein, 201 aa, Zea mays
  misc_feature: Ceres CLONE 1566175
MATQYARLSLPCRLPSPLPPPVPTTTRRLPRAAAAAASTSPRCPRVGGAAATRARGPCRPRASEGEVQQQEAEADQVVDSNMLPYCSINRKEKKSIGEMEQEFLQAMHAFYYEGKAIMSNEEFDNLKEELMWEGSSVVMLSPDEQKLLESRMAYVSGNPIMTDDEIDPLKLRLKKEGSDIVQEGSKMQPYGVRKVLQGLDW

SEQ ID NO: 80815 - DNA, 833 bp, Zea mays
  misc_feature: Ceres CLONE 1566176
  misc_feature: Encodes the peptide sequence at SEQ ID NO. 80816
  misc_feature (646)..(646): n is a, c, t, g, unknown, or other
  misc_feature (713)..(713): n is a, c, t, g, unknown, or other
ccccgcggtggcggccgctctagaactagtggatcccccgggctgcaggaattcgtctcacccctagaaaaaaccccacccccaaaatcacacgaacccagagagtggattataaataagccctcccaaaccccttccatttcccgtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggtttgacacctacttctccatggccaggggcaacgccactgtccctgctatggagatgaccaagtggtttgacaccaactaccactttattgtcccggaattgggcccaaacaccaagttctcctatgcttctcacaaggctgttaacgaatataaggaggctaangcgctcggtgttgatacggtgccagtacttgttggaccagtctcgtacctggtgctctcaagcctgncaggggtgtggaggaagggatccctctttctttcccttctagcagcatcctttcagtctacagggaggtcattgcttagttgaaggcagctggggcttcatggaatcagttggatgaacc

SEQ ID NO: 80816 - protein, 194 aa, Zea mays
  misc_feature: Ceres CLONE 1566176
  misc_feature (2)..(194): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (145)..(145): Xaa is any aa, unknown, or other
  misc_feature (168)..(168): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAXALGVDTVPVLVGPVSYLVLSSLXGVWRKGSLFLSLLAASFQSTGRSLLS

SEQ ID NO: 80817 - DNA, 931 bp, Zea mays
  misc_feature: Ceres CLONE 1566177
  misc_feature: Encodes the peptide sequence at SEQ ID NO. 80818
  misc_feature (632)..(632): n is a, c, t, g, unknown, or other
  misc_feature (642)..(642): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
aagctggagctccccgcggtggcggccgctctagaactagtggatcccccgggctgcaggacttcgtctcacccctagaaaaaggatctctctgcccgtttcttggagcagagatggccgaaatgaccgtgactgtcgcggccgccaaaagcaccctccggacgtgccccggcgcccgccgtgctgcggttcttggtcggtggatgcctcttgcaccagcggcgcccgccaacttgaaattgttctctccagctgtgagggttccaagggctacttcccctgcggcggttgaggatgggagcaacactgatatagtccctatcccgaaagttataatagaccaagactcagatccggatgcaaccattgtagaaataaccttgggtgatcgtcttggcgatctccttgatacgatgagtgcgctaaagaacttggggctaaatgttgttaaagctagtgtctgtctcgattctactggcaagcatatcaagtttgctataactagagcgttcactggccgtaaaattgatgatccagagttgttagaagcagttcgactgacgatcattaacacatgatacagtatcatccagagtccagcagtcaattggctatgggggcaaactttgggncagaagcccntacgannngagtgatgtggatatagcaaccacatagatatccttgatgatggccctgaaagagccctactgtggtggaaacagcggatcgtccaggttacgggttgacccttgtaaaaaccttccggactcagcctttattgcccatctggaaatttgacacctaagggctactgggttaaaccaaaattccgttccgctccggggggaaaacttgcccagggtttttaaacggttctttaaaatacctgggcctttttttgaggggcccaaaaaaaagggaacccctc

SEQ ID NO: 80818 - protein, 154 aa, Zea mays
  misc_feature: Ceres CLONE 1566177
MAEMTVTVAAAKSTLRTCPGARRAAVLGRWMPLAPAAPANLKLFSPAVRVPRATSPAAVEDGSNTDIVPIPKVIIDQDSDPDATIVEITLGDRLGDLLDTMSALKNLGLNVVKASVCLDSTGKHIKFAITRAFTGRKIDDPELLEAVRLTIINT

SEQ ID NO: 80819 - DNA, 851 bp, Zea mays
  misc_feature: Ceres CLONE 1566178
  misc_feature: Encodes the peptide sequence at SEQ ID NO. 80820
  misc_feature (699)..(699): n is a, c, t, g, unknown, or other
  misc_feature (704)..(704): n is a, c, t, g, unknown, or other
  misc_feature (705)..(705): n is a, c, t, g, unknown, or other
ggagctccccgcggtggcggccgctctagaactagtggatcccccgggctgcaggaattcgtctcacccctagaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaaccacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaaacaccaccacctcttcggctgaccgtagtaccggccggcgcgcgaccgagctagctagctccggcgcacacaaccacacacctgtttaattctgtactgcatgcgtgtgtaaattgatggttcacattaatgagtccctctccngaccnntggtagctgcttgcttgtggtgagtgagagtgtgagactgaaggaaaaaaagtgggtgggcctggggctacctcaaaaagaggctgttccctgaactcgccttcgttttccctgcatgcgtgaataaattggtgtcaataataaag

SEQ ID NO: 80820 - protein, 131 aa, Zea mays
  misc_feature: Ceres CLONE 1566178
  misc_feature (41)..(120): Pfam Name: ABA_WDS Pfam Description: ABA/WDS induced protein
MSEEKHHHFFNHHKKDEEQPAGEYGYSETEVVTATGEGEYERYKKEEKEHKHKQHLGEAGAIAAGAFALYENHEAKKDPEHAHRHKITEEVAAAAAVGAGGYVFHEHHEKKKDHKDAEEASGEKKHHHLFG

SEQ ID NO: 80821 - DNA, 939 bp, Zea mays
  misc_feature: Ceres CLONE 1566179
  misc_feature: Encodes the peptide sequence at SEQ ID NO. 80822
ctccccgcggtggcggccgctctagaactagtggatcccccgggctgcaggaattcgtctcacccctagaaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacaccattggcaaggagattgttgacctatgccttgatcgcatcatgaagcttgccgacaactgcactggtctccagggcttcctcgtcctcaacgctgttggtggaagaacgggctctgggcttgggttccctcctcctagagcgcctgtccggttactacgggaagaagtccaagccttgggtttcccgggtaacccttcccccccagtttcaacctgcgggagttgagccaaacaacaggggaactggccaacccaccccctcctcaaggcaacggaaggggggtaaaccggctggaaattggagccatttaaaaattttggcggcaaatccctgtaaatttgggcgccaacatgaccaaccccaaaaaggttttgtgccccaagttattctcccccttattgccccccgggagtgttgaggg

SEQ ID NO: 80822 - protein, 183 aa, Zea mays
  misc_feature: Ceres CLONE 1566179
  misc_feature (49)..(172): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIMKLADNCTGLQGFLVLNAVGGRTGSGLGFPPPRAPVRLLREEVQALGFPGNPSPPVSTCGS

SEQ ID NO: 80823 - DNA, 879 bp, Zea mays
  misc_feature: Ceres CLONE 1566181
  misc_feature: Translation starting site: 312
  misc_feature (795)..(795): n is a, c, t, g, unknown, or other
ctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaaatacatcaagaatctcactgctgtgttggagccagagaaagcggatgagttcaaaaagggtgtcgagggtgcaaccaagtttctccttagcaagctgaaggacctcccattttttgttggtgagtccatgaaggatgatgcgtctgtggtattcgcctattacaaggatggtgccactaatccgacattcctctatttctctcatgtnctaaagagatcaagtgctaggcgtgccggcgaataagtacccatggtggggaccatctatgtactattatatatccaaaacttt

SEQ ID NO: 80824 - DNA, 993 bp, Zea mays
  misc_feature: Ceres CLONE 1566186
  misc_feature: Encodes the peptide sequence at SEQ ID NO. 80825
tggagctccccgcggtggcggccgctctagaactagtggatcccccgggctgcaggaattcgtctcacccctagaaaaacccggcctcctccgcccgcatccccgatcccgctcgctcgctcgctcgccgccagttgtccagcagctcggatcgtctcatacctcggcgaagatgagagagatcttgcacatccagggagggcaatgtggcaaccagatcggtgccaagttctgggaggtcgtgtgtgacgaacacggcattgacactacaggtcggtacactggcacttctgaccttcagttggagcgcgtcaatgtctactacaatgaggcctcctgtggccgctttgtgccccgtgctgttctcatggacctagagcctgggacaatggacagtgtccgcactggaccctatgggcagatcttccgccctgacaactttgtgtttgggcaatctggtgctggcaacaactgggcgaaggggcattatactgagggcgctgagctcattgactctgttctcgatgttgtgagggaagaagcccgagaactgtgactgcttgcaaggaattcccaggattgccccctccccttggtgggcgggaacgggatctggttatggggaccccctgttgattctccaaaaattcagggagggaattacccctggacccccatgaatgcttgaacttctccaggttttttcccccccccccaaaggtttctggaaaacggggggtgagaggcctttaaaagcccaccctttttctttgccacaattgggtttaaaaaaccccaaaaaaagttatgggttcttgtaaaaaaaagagccccctacaaaattttgcttcggggaatctttatatgtacccccccctaacttttgggggatttgaaaaccctttgttctccgccaaccccggaggggaccccctcgcgcccccaaaggctcccgggcggcctaaatccccccccccgggagaggggggtggg

SEQ ID NO: 80825 - protein, 127 aa, Zea mays
  misc_feature: Ceres CLONE 1566186
  misc_feature (45)..(128): Pfam Name: Tubulin Pfam Description: Tubulin/FtsZ family, GTPase domain
MREILHIQGGQCGNQIGAKFWEVVCDEHGIDTTGRYTGTSDLQLERVNVYYNEASCGRFVPRAVLMDLEPGTMDSVRTGPYGQIFRPDNFVFGQSGAGNNWAKGHYTEGAELIDSVLDVVREEAREL

SEQ ID NO: 80826 - DNA, 938 bp, Zea mays
  misc_feature: Ceres CLONE 1566188
  misc_feature: Encodes the peptide sequence at SEQ ID NO. 80827
ctccccgcggtggcggccgctctagaactagtggatcccccgggctgcaggaattcgtctcacccctagaaaaaatggaggactggctcttctactccctcaccactctcctctgcctcctctgctcgctcattctgcgggcgcgcacaccaggcaagaaggcccggcatgccgactcctcctccccgctccctcccctgccgccgggcccgacgccgctgccggtgctgggcccgctgctcttccttgcgcgccgcgacttcgacatcgagcccgtcctccgccgcatcgcgcgggaccacggcaaggtcttcacgttcgcgccgctggggcgggcgcgcccgggcatcttcgtggccgaccgcggcgcggcgcaccgcgcgctcgtgcagcgcggcgccgcgttctgctcccgcccgccctccacggactccagcgccgtgctcaccagcggcggccgctacgtcagctcctccccctaccgcgccacgtggcgggcgctgcgcccgatcctcgccctccggggtgctcaacccggggccggtcccgggccttcctccccccgccccccgttgggggcccgggggtcctccccccgccggggtccgcgcccaacggccgcccccgggggaaggctccctttccccttcattggaacccgttcccgtaacccaagttttgtgtctcccccggccacaatttgtcttggggggcaacccccctcggggaaaaaaccccccctcccggaaaatttagggccccccggggggagccccccggagggtccccagagtcaaagggtccccccccccccccggggtaaacaaatcctgttccccccacaccgggaaagaccccccccccccgcggcgggggaaagaccctcctcccctaaaaagagaaaaagggggcggggggcacggaaacccccccccccg

SEQ ID NO: 80827 - protein, 288 aa, Zea mays
  misc_feature: Ceres CLONE 1566188
  misc_feature: SWISSPROT Homolog: EC 1.14.14.1 Unspecific monooxygenase
MEDWLFYSLTTLLCLLCSLILRARTPGKKARHADSSSPLPPLPPGPTPLPVLGPLLFLARRDFDIEPVLRRIARDHGKVFTFAPLGRARPGIFVADRGAAHRALVQRGAAFCSRPPSTDSSAVLTSGGRYVSSSPYRATWRALRPILALRGAQPGAGPGPSSPRPPLGARGSSPRRGPRPTAAPGGRLPFPFIGTRSRNPSFVSPPATICLGGQPPSGKKPPLPENLGPPGGSPPEGPQSQRVPPPPRGKQILFPPHRERPPPPAAGERPSSPKKRKRGRGARKPPPP

SEQ ID NO: 80828 - DNA, 887 bp, Zea mays
  misc_feature: Ceres CLONE 1566189
  misc_feature (383)..(383): n is a, c, t, g, unknown, or other
  misc_feature (887)..(887): n is a, c, t, g, unknown, or other
tcaccgcggtggcggccgctctagaactagtggatcccccgggctgcaggaattcgtctcacccctagaaaaagacgaaaatacagaaacagaaaatggagtggtgcgggccggcggggagggggaggaatccaaagcgaacgccaggcaggcggcaggcggcaggcggcaggctcgcgagagagagccgtgcggctgccgaactccacaggcctatacgggtgtactagcactgtagcctactagccagcaagcacctcctggtgctatatgaccccccgcaccccacccaaaacccctccttttccgctccagacacagcagcccctcttgtaccagtaaaccgtgctgctatcccccgctagccgccgcgctgctgcggntcgcctccctcctccccagtccccgcgccccgccgccgccgccgccgcctcctctcgctccctccttttaccccgagcttaagctcgcgcgtacctgcctacctatccgtaagagaggaagaggggacaaggcccgggcgggcggtcggtcgggggggctctcggatctcgccgctgcctccccgttcgttcgttgggaatcccagccgtggtcgtccgccgagccggcctccggccccgggccggtgactgggttcggggtccgggtccctgacaccgtccctggtcggggaatcaaacacaaggatgtgctgccaaaaggtggcggtctcaacttctcatccccgtaaccggccgcaggttaaacaagggctgactggcgcgccgcccgttcaaaataggcgcgcccctggctgcgcccccgtccggcttgaagacgcggggggaatccccccggcgggaagacgttttcatatacaaccctcggggtgatgtcacacgccn

SEQ ID NO: 80829 - DNA, 1011 bp, Zea mays
  misc_feature: Ceres CLONE 1566193
tggagctcaccgcggtggcggccgctctagaactagtggatcccccgggctgcaggaattcgtctcacccctagaaaaacacgccttccaacctcctctgctgtccgagatctctccccactctctcggtcctctagcagatagctggggcccgacacatctagatgcggaggcacgaccaccaccaatcagcgtctgcgaaactggcggacgaggagaccgttcccgagtaggcgaaagcctgcaagacgctgctggaggacaagctcgtcctcgcgatcccgaccatccgcaacctcggcgtgtcctcggaatgagggggcccttcttccacccataacccgcatactcacgcgagacacgccaccaaagcgctagaatcagtgcgcccgaaggtttggaccccccacctcggacacgtgcatgatgaacatcctcttcaccgggcatcatggagacgtgtatattccttagggggaccggcccgcccggttccttcggggaaactgagccctcccactaacaagtgagatccaaaaccatccgaggcaccaacggccttccctgggggaagggtcccctaagggccggggtttttccaaggcgcccccaggcccccccccaccagaaaaccccccccaaaccccgaggccgaacgcgggttcctctcttttaataagcttttcccccaacccccttcccggaggggagggtgcctgaattttggggggggggggaaaacccctttgaccccctccggggggggagggtcgccctttctcttttggagaccccgaaaccctgggggtgtataaaacccccacaatcttgtgtttatttctcccacccctctgtttttgtttttgtgggaggcacccaacaggtgtgcgtgtgtgtggtggagggagatacccccccggagggatgtgttctccaaacgggggggagaaaatcagcctcctacaggaagattctatttttcaccgccctttacccgttggtcacgaggaa

SEQ ID NO: 80830 - DNA, 944 bp, Zea mays
  misc_feature: Ceres CLONE 1566196
  misc_feature: Encodes the peptide sequence at SEQ ID NO. 80831
  misc_feature (810)..(810): n is a, c, t, g, unknown, or other
  misc_feature (832)..(832): n is a, c, t, g, unknown, or other
ctccccgcggtggcggccgctctagaactagtggatcccccgggctgcaggaattcgtctcacccctagaaaaagtggttgcttcagcagctgctgtacgccaaaagaaaagccctactaaacaagaaaacgccaactgggtaactgccttaagtgtgctggtgaagctgtgtcttcttatttcagctactgcttggatggggcaggtgttctggagatggcaaagtggtgaattatcatttacaacactggatatggagaacaggctatccagggtggaagggttcaagaagacagccaagatgcttcagctacagttggatgttttggataaaaagctagaaaatgagattgacaaagcaaaaggggtcattgctaagcaatttgaggataagggtaataagatagagaaaaagatgaagattttggaagacaaaactgacaagttggacaagtcactggctgagcttagtgacatgggatttctttctaaaaatgagtttgaggagattttgagccagttgaagaaaaagaagggattcggtggtacagatgatgaaataagcttggatgatataaggctatatgccaaagatgtggttgagatggagatagcaaggcattccgcagatggccttggtatggtggattatgcattgggatctggtggtgctaaagtggtaagtcactcagagcctttcatgaatggcaagaactatttacctggtcgcagcaatgtgcacacacagcccaaagatgctgggagctagttttggcagcccagagaatgtttgcaatggaagaagtagntgggtttgtgaagtgagctaanaacagcatatcctgaagcgtcctctagacattgtgacagatgtggctatgaagatcaggctcaaatgatccaggtcgtgatggtccagaccctgatgtcaaaaagatccatg

SEQ ID NO: 80831 - protein, 255 aa, Zea mays
  misc_feature: Ceres CLONE 1566196
PRGGGRSRTSGSPGLQEFVSPLEKVVASAAAVRQKKSPTKQENANWVTALSVLVKLCLLISATAWMGQVFWRWQSGELSFTTLDMENRLSRVEGFKKTAKMLQLQLDVLDKKLENEIDKAKGVIAKQFEDKGNKIEKKMKILEDKTDKLDKSLAELSDMGFLSKNEFEEILSQLKKKKGFGGTDDEISLDDIRLYAKDVVEMEIARHSADGLGMVDYALGSGGAKVVSHSEPFMNGKNYLPGRSNVHTQPKDAGS

SEQ ID NO: 80832 - DNA, 817 bp, Zea mays
  misc_feature: Ceres CLONE 1566197
  misc_feature: Encodes the peptide sequence at SEQ ID NO. 80833
tggagctccccgcggtggcggccgctctagaactagtggatcccccgggctgcaggaattcgtctcacccctagaaaaaggggagcaacgcaagcactccacactgctgtgcagaacgagagccacaccatcagtagttagagcgaccaatagatgagttcctccccgtcctttggtctcctggctgtagcagcattactcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacgtccagttaggcgccaactgggtggagggcgtgaacggcggcaagatgaaccccatctggcccatcgtcaactccaccctcaagctccgcaacttccgctccgacttcgactacctcgctcagaacgtctacaatgaggacggtggcgtctacgatgaagattacgtccagaagagaattgaactggcggacagcgtggaagagatgggggagaagctctctgccactttgcacgccagtggcagagacgacatgtctatcctttgcatgcagcgcctcaacgacaccaaccggacgggccggcgacgctggtggacatggtggtggactactacaagttcgactacgagttcgcggagcccgccccccgtgacaagctgcagaacaacgggccttttcgcgacctttaaggactttggca

SEQ ID NO: 80833 - protein, 221 aa, Zea mays
  misc_feature: Ceres CLONE 1566197
  misc_feature: SWISSPROT Homolog: EC 1.5.3.11 Polyamine oxidase
MSSSPSFGLLAVAALLLALSLAQHGSLAATVGPRVIVVGAGMSGISAAKRLSEAGITDLLILEATDHIGGRMHKTNFAGINVQLGANWVEGVNGGKMNPIWPIVNSTLKLRNFRSDFDYLAQNVYNEDGGVYDEDYVQKRIELADSVEEMGEKLSATLHASGRDDMSILCMQRLNDTNRTGRRRWWTWWWTTTSSTTSSRSPPPVTSCRTTGLFATFKDFG

SEQ ID NO: 80834 - DNA, 1088 bp, Zea mays
  misc_feature: Ceres CLONE 1566199
  misc_feature: Encodes the peptide sequence at SEQ ID NO. 80835
  misc_feature (884)..(884): n is a, c, t, g, unknown, or other
  misc_feature (1032)..(1032): n is a, c, t, g, unknown, or other
tccccgcggtggcggccgctctagaactagtggatcccccgggctgcaggaattcgtctcacccctagaaaaaaagcgaaagctcaagcaaatacaagctctcagttagaccacactcaaaccagccacggacagcctcaaaatcccgagcaggagctcgctcgtagccccgagaacccgaaagctctgcagcgagatgtctcccgagctgaccggcaagatggccgccaaggccgccgccgccgctgcggcggtgaagcccgcgacgagggcgtacgtgacgttcctggcgggcgacggcgactactggaagggcgtggtgggcctggccaagggcctgcgcaacgcccgctcgggctatgggctgggggtgggccttctgcccgacgtgccccacccccaccgcgcgaatcctcgtcttcgcagggggtgtatccctcccgcgagatcgagacccgtgtaccccccctgaaaaaccagaacgcagttccgcccgggggggaacttcggtcatccaactaactcccaagctcccgccaactggggagatttcgtgggagtacctaagagagaaggggggttcccctggggcccccggacaatcccagaggggtccccgaggaaacccccgaacaagctcggtttcttagcccccgggataaggggggttcctctttttcctcgggggggggtaggatcctgttctgttttgcgctaaataaatgagcagtggaagaccaccttccccccccgcgaggattatagagtaaccggtgctatcgcactcaaatatattcgtcccagaacaaaaagagggggggtggcgccccatcatccactagaatggtggggggttttccccccccgcgcgctttatttttatngtacgattggaatatttcgcgtccacgttataacactttgttgcgcccgccgctcacgggtatgttttgctcgaaccacggctgtgggtggttctctccgccgccccgcctcttggtgagaaaggagtgaggtgttgtggacaaattntctgtaggtgggcgccaccttctgagatcacctaccggtgtgtttttgctaccgcc

SEQ ID NO: 80835 - protein, 91 aa, Zea mays
  misc_feature: Ceres CLONE 1566199
MSPELTGKMAAKAAAAAAAVKPATRAYVTFLAGDGDYWKGVVGLAKGLRNARSGYGLGVGLLPDVPHPHRANPRLRRGCIPPARSRPVYPP

SEQ ID NO: 80836 - DNA, 852 bp, Zea mays
  misc_feature: Ceres CLONE 1566202
  misc_feature: Encodes the peptide sequence at SEQ ID NO. 80837
ccccgcggtggcggccgctctagaactagtggatcccccgggctgcaggaattcgtctcacccctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgccttaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctgcccatcaacttcgatggactcgccaagggctttgacaccaggtgcaacgatatttgtggggccatacttgttcactggtagcgagactacttcagtttggtttgagggttctgaagtaaaaggagatgatgtggtttgtatcatcaagaacccagctaccttggctgggt

SEQ ID NO: 80837 - protein, 157 aa, Zea mays
  misc_feature: Ceres CLONE 1566202
  misc_feature (30)..(157): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKGFDTRCNDICGAILVHW

SEQ ID NO: 80838 - DNA, 881 bp, Zea mays
  misc_feature: Ceres CLONE 1566204
  misc_feature: Encodes the peptide sequence at SEQ ID NO. 80839
ctccccgcggtggcggccgctctagaactagtggatcccccgggctgcaggaattcgtctcacccctagaaaaactcgcccagatccacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgtcccgcggggtacccgtcttcgccgaggagcgcggcaagcacgccgccggcctctccactagggactaccccgcccatctcgccgtttgccggcgctggtggtcgcttcagaaggaaatcatcatccgacgcatatgagagggcaacccctccagggacgaccagccaccctcctcccttcgaagtgtgaaccggctgcaccctcacacttgttttgctccttgacaagcatctcttcacctataataaggtagaggcagggaggagagaagacgacatcaagaggggaacggggatgagttgcgggtttacctctgctgtgatatattgtaggtgccactatgtgtattgttcccccctatctactacgtggcataggttgtattctagtatgttgaaagctcatggtgccgtgctgtatcaataaggtgttatgcgcatagagtggctcaagaacagggctgcgtttgcgctttgccactggctgtgttgtatgttct

SEQ ID NO: 80839 - protein, 132 aa, Zea mays
  misc_feature: Ceres CLONE 1566204
  misc_feature (7)..(128): Pfam Name: Auxin_repressed Pfam Description: Dormancy/auxin associated protein
MGLLDKLWDDTVAGPRPDTGLGRLRKQPARPAAVKISDPAGDAAALVPPSPASGSEETPVKVTRSIMIKRPAGYPSSPRSAASTPPASPLGTTPPISPFAGAGGRFRRKSSSDAYERATPPGTTSHPPPFEV

SEQ ID NO: 80840 - DNA, 1091 bp, Zea mays
  misc_feature: Ceres CLONE 1566205
  misc_feature: Encodes the peptide sequence at SEQ ID NO. 80841
  misc_feature (1091)..(1091): n is a, c, t, g, unknown, or other
ctccccgcggtggcggccgctctagaactagtggatcccccgggctgcaggaattcgtctcacccctagaatttctccgagatcccgcccgtccggcttgatctcgattgcgctccgcttccccccatctccctcctagatcttggcaagatgggcctcgccgcggccttccgcgcggtcctcttcctcctcgccgtcgccggggtcatcttccgtccggcggtggcggagatcatgcaggagtccttcaaggacgactcccgcggttccattctcttctagaagttcggcttcggcccccacggcatggtctcaatctccgtcaccggcgccaaggcctcctccgcgctcgctaagcccgatccggcacagctcggcttcttccttctctccaacgagtcgctcttcgaggccttctacgattctgccgggtacccacggatttggaacccccaccccggagttcttccccgatcctggggtcccctccagcccccttcggggaaaacccgcttctttcacctttcgccaaaagccccgattgaacaagggggtttccgccatacccaagattttttccccagtgcccccatcacctcgaacgagagtaggaggcccccccctttttgtcacctaaatcggcgcccccccgaggaagaaaccaccccgtctcccccctgtgggatggcgtccccgcccccgcctcctttgtgttacaacacgccacacactccttggcggggcgcgcccccggagggaattaacctctgcccccggattgggggggtgtgctcctctcctgtcccggggggagagatgtaggccgcttttattatccctagtggtgggttgttcgccgctcatcgccggggagggtgggtggttgttttcgcgttccccgcccttgcggagtaatcataccttctctgcaagggtgggaccgcccctcactccattttatggggagcctccttcactgtgccggcgctattcttctatataacccgtcggcgggcagggaacaatactttgtcccgcacccgggcggggtatacggggggtgggggcttataccttgcagcgacgcacgn

SEQ ID NO: 80841 - protein, 45 aa, Zea mays
  misc_feature: Ceres CLONE 1566205
MASPPPPPLCYNTPHTPWRGAPPEGINLCPRIGGVCSSPVPGGEM

SEQ ID NO: 80842 - DNA, 835 bp, Zea mays
  misc_feature: Ceres CLONE 1566206
  misc_feature: Encodes the peptide sequence at SEQ ID NO. 80843
  misc_feature (685)..(685): n is a, c, t, g, unknown, or other
ctccccgcggtggcggccgctctagaactagtggatcccccgggctgcaggaattcgtctcacccctagaaaaaacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgacacgccggagacgcagcaggaccagatccgcctgctcaagcgcttcaacgttggcgaggactgccccgtcttcgacggcctctacagcttctgccagacctatgcgggtgcctccgtcggcggggccgtcaagctcaaccacggccacgacatcgcaatcaactggtcggggggcctgcaccacgtcaagaagtgcgaggcgtcnggcttctgctacgtcaacgacatcgtgctcgccatactcgagctgctcgagcatcacgagagaagtctgtatgtcgatatcgatatccaccatggcgatggagtggaaggaggctttctacactacgacaggggtatgactgtctcggtt

SEQ ID NO: 80843 - protein, 211 aa, Zea mays
  misc_feature: Ceres CLONE 1566206
  misc_feature (24)..(211): Pfam Name: Hist_deacetyl Pfam Description: Histone deacetylase domain
MDPSSAGSGGNSLPSVGPDGQKRRVCYFYDPDVGNYYYGQGHPMKPHRIRMTHSLLARYGLLNQMQVYRPNPARDRDLCRFHADDYINFLRSDTPETQQDQIRLLKRFNVGEDCPVFDGLYSFCQTYAGASVGGAVKLNHGHDIAINWSGGLHHVKKCEASGFCYVNDIVLAILELLEHHERSLYVDIDIHHGDGVEGGFLHYDRGMTVSV

SEQ ID NO: 80844 - DNA, 944 bp, Zea mays
  misc_feature: Ceres CLONE 1566208
  misc_feature: Translation starting site: 324
  misc_feature (789)..(789): n is a, c, t, g, unknown, or other
ctccccgcggtggcggccgctctagaactagtggatcccccgggctgcaggaattcgtctcacccctagaaaaaagctggtgctcagcgaccttgtagtccacgacctcacggaacaggccaggggtgagctcgcagtccttgctcccgtagacagccgcctggacgctggccatcatcttggctatctctcgtccggagaagccctgggtcttggccgccgcctcgcggatcaggtcgtcggtgacgcccttcaccacgatcttctggggctggcggcggaagaaacggagccagctcttctcgcgcttgtcgccggctctgatgacgtacttgtccaggtatagcttcaggagcttgaaccgctcgtcttccccgggcagggggaattccaggacctcgtcgatacggtcggcgacggccgagtcgagatcgccaggcctgttggtggcaagcgcaaggacgatgtccttggactggtcgcctgtgcggaagaggagagcgttcagggcactcctttgagcttcgctcatgtaagttttgtttcgtctgtagggtaccccaaaaaaaaaaacaaaaacggtctgagatgtcaacgctacagtttgcaagttaggggtgagaaactgagcactactcgcacaagaaaaagtatctgaaagattgtgttgcacttactcgcacaagaaagcatctgcttcatctatgaagaggagcaaacccctgttagatttctttcgccagtcaacaactgatgggatctggtgactgcctgtgatcctaatggtgncacatctccaccagtcattagtgcatatctaatccctgcaaatgtgggcacatttattggggcagccgtattcagacggttttatatggctgaatagattgggctttgatggaacattccgattgcgggctaaaaaaaaaaaaaaaaaaaaaaaa

SEQ ID NO: 80845 - DNA, 903 bp, Zea mays
  misc_feature: Ceres CLONE 1566211
  misc_feature: Translation starting site: 167
ggagctccccgcggtggcggccgctctagaactagtggatcccccgggctgcaggaattcgtctcacccctagaaaaaaggaacccactccaactgtgcggcgcgtccaaaaatacaaaaggcaagcgagcgagctccaagttcggctgctccaatttcactcggcatggctcctcaggcgtgggtcgtggcggagaacggcgaggacctccaacaacccatggaattcctgccgctctctaagcttgaatatgttggcgtgttgtattggcatttggaccctaagaagtctgaaagcgaggaggaactagcaaaaatccgcagagacagaggctacagttacatggatcttattgagatatgtcccgacaaactgggaaactatgaggagaaggtgaaaaactttcttctgtgagcacatgcaccccgacaaaaagatccgctattggcttgaagggcagcgggtactttggacctccccctacaaaaatgaaaagtggatctccaatttcggaataaggagaaggagacttggtccctccccacccagctggggattttttcattcgggttccaccccccgaaggggggttaaaataccccgaagcccccatggagggctttttccttttgggggaaaccaggtctggggaccccccctttaaaaccccccccctcaaggaggagcccaccccggggggagggaaaaaaaatttttctcaaaaaaatggtaaagggccggggcccatgggaatttttctctcttgggcggacacaccggaaataagggtgttttttccccctttcccccgggggataaaaaaaaaaaaggggggcacactctggggattttctggtgaccccccctctttgttagagctccccccctgaggggtgtggggg

SEQ ID NO: 80846 - DNA, 942 bp, Zea mays
  misc_feature: Ceres CLONE 1566215
  misc_feature: Encodes the peptide sequence at SEQ ID NO. 80847
aagctggagctccccgcggtggcggccgccctcccaactagtggatcccccgggctgcatgaattcgtctcacccctagaaaaaactcctgacctcacctctccgaactgcatcacctcccctcccgccacccacacgtgctcccatggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcaggacgacctcaagcggctggcggcggtgcgcgccgtcgagcaggtgaagagcgggatggtgctcgggctcgggacgggctccacggccgccttcgccgtcggcgagatcggcgcgctcctggccgcgggcaacctcgagaagatcgtcagcgtgcccacatccaagcgcaccttcgagcaagcgcagtcgctcggcatcccgctctccacgctcgacgacaacccgctcatcgacctcgccatcgacggggccgacgaaggttgaccctggacctcaacccttgtgaaaaggggggggtggggcttctctcttcgtggagaagaaggtgtgagggcaacatccggaccaggtttaataggtaatgggtggaaaaaaaagaaaaccactttgaaggagttagggaagggagaggtcacaacccttttccagtaggaaaattgggccaattatctggcggttacttcctcccttggtaaaaatcggcggggacatgtgataacgggggaaagagattttagccataacgaacagggtggaaaggggaatcaaacctcgcgggtaactgaaacaggtcgacattgattgcggtggagatttaaacgcaacgaacggccatattaagagacggttgtgggctattgaactggaaaatctccctctccaag

SEQ ID NO: 80847 - protein, 131 aa, Zea mays
  misc_feature: Ceres CLONE 1566215
  misc_feature: SWISSPROT Homolog: EC 5.3.1.6 Ribose-5-phosphate isomerase
MAATAISVRLHPTAARHVASARRARLGAVRAQSAPAAAAAALTQDDLKRLAAVRAVEQVKSGMVLGLGTGSTAAFAVGEIGALLAAGNLEKIVSVPTSKRTFEQAQSLGIPLSTLDDNPLIDLAIDGADEG

SEQ ID NO: 80848 - DNA, 859 bp, Zea mays
  misc_feature: Ceres CLONE 1566217
  misc_feature: Encodes the peptide sequence at SEQ ID NO. 80849
  misc_feature (740)..(740): n is a, c, t, g, unknown, or other
  misc_feature (773)..(773): n is a, c, t, g, unknown, or other
  misc_feature (793)..(793): n is a, c, t, g, unknown, or other
ctccccgcggtggcggccgctctagaactagtggatcccccgggctgcaggaattcgtctcacccctagaaaaacttccgaagcggcgcgggcggaagcgagggcagctcacaccaccgtgccgcgcgcgcgcgctctccacccaccacctaattccgccgccgagctcgccgacgcggccacccgcgatcgggcatttggacccgtccccgcccgccgcccgcacggcggctcgttgcgggaaagtttctcgaggccgtctgtgaccccgctccctcggccgcgagatcccgcccagccggtaatcggtcgcagaatggcgcagagcaactgggaagcggataagatgctcgacgtgtatatctatgactacctgctgaagaggaacctgcagacgacggccaaggctttcatgaccgagggaaaggttgctgctgatccagttgcaattgatgctcctggagggtttctgtttgagtggtggtctgtcttttgggatatattcatcgcaaggacaaatgaaaagcattctgaagttgcagcggcatatctagaggcacagcaaataaaagcaagagagcaccagcagcagatgcagatgcagcaattgcaacttatgcatcaaagacatgctcaacttcagcgaactaacgcgaatcatccttcacttaatggtccaataaatgctttaaattctgagggcattttggggccatcaacagctagtgtcttagctgccnagatgtatgaagagcgattgaagccccacattncatggagtctgagggatcancactttatgaagctagtagaatggctcttctcagtcagcaacaaccatgcagggcaatagttccag

SEQ ID NO: 80849 - protein, 178 aa, Zea mays
  misc_feature: Ceres CLONE 1566217
  misc_feature (10)..(36): Pfam Name: LisH Pfam Description: LisH
  misc_feature (142)..(142): Xaa is any aa, unknown, or other
  misc_feature (153)..(153): Xaa is any aa, unknown, or other
  misc_feature (159)..(159): Xaa is any aa, unknown, or other
MAQSNWEADKMLDVYIYDYLLKRNLQTTAKAFMTEGKVAADPVAIDAPGGFLFEWWSVFWDIFIARTNEKHSEVAAAYLEAQQIKAREHQQQMQMQQLQLMHQRHAQLQRTNANHPSLNGPINALNSEGILGPSTASVLAAXMYEERLKPHIXWSLRDXHFMKLVEWLFSVSNNHAGQ

SEQ ID NO: 80850 - DNA, 959 bp, Zea mays
  misc_feature: Ceres CLONE 1566218
  misc_feature: Encodes the peptide sequence at SEQ ID NO. 80851
  misc_feature (824)..(824): n is a, c, t, g, unknown, or other
  misc_feature (826)..(826): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (859)..(859): n is a, c, t, g, unknown, or other
  misc_feature (860)..(860): n is a, c, t, g, unknown, or other
  misc_feature (862)..(862): n is a, c, t, g, unknown, or other
  misc_feature (863)..(863): n is a, c, t, g, unknown, or other
  misc_feature (868)..(868): n is a, c, t, g, unknown, or other
  misc_feature (870)..(870): n is a, c, t, g, unknown, or other
  misc_feature (872)..(872): n is a, c, t, g, unknown, or other
  misc_feature (874)..(874): n is a, c, t, g, unknown, or other
  misc_feature (875)..(875): n is a, c, t, g, unknown, or other
  misc_feature (877)..(877): n is a, c, t, g, unknown, or other
  misc_feature (879)..(879): n is a, c, t, g, unknown, or other
  misc_feature (881)..(881): n is a, c, t, g, unknown, or other
  misc_feature (883)..(883): n is a, c, t, g, unknown, or other
  misc_feature (885)..(885): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (943)..(943): n is a, c, t, g, unknown, or other
ctggagctccccgcggtggcggccgctctagaactagtggatcccccgggctgcaggaattcgtctcacccctagaaaaactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaggactacgccggcaagatcacgtgctgcaaggtgaacacggacgacagccccaacgtggcgtctacctacggcatccgcagcatccccaccgtgctcatcttcaagggcggcgagaagaaggagagcgtcatcggcgccgtcccgaagtccacgctcaccaccctcatcgacaagtacatcggtagttcatgagcatgccatgccatgccatgcatacatgcatcgacgactaaacacatatgtgtatctctagtagcctttgcatacgggatatgatcaattcaagcagccagccgtctgctactgctgtgttatatataccatacctccatgtcgaaatcagagtacattaattagtttcagttcacgaatttcgatcngnatatatatatatatatatatatnnnnnnnnngnntnntgttntntntnntntntntntntttttttttnnnnnnnnnnnnnnnnnnnnnnnnaaaaaaaaaaaannnccnnnaaaanaaaaaaaaaaaaaaat

SEQ ID NO: 80851 - protein, 167 aa, Zea mays; identical to SEQ ID NO: 80749
  misc_feature: Ceres CLONE 1566218
  misc_feature (60)..(163): Pfam Name: Thioredoxin Pfam Description: Thioredoxin
  misc_feature: SWISSPROT Homolog: EC 1.8.1.8 Protein-disulfide reductase

SEQ ID NO: 80852 - DNA, 932 bp, Zea mays
  misc_feature: Ceres CLONE 1566220
  misc_feature: Encodes the peptide sequence at SEQ ID NO. 80853
  misc_feature (786)..(786): n is a, c, t, g, unknown, or other
  misc_feature (822)..(822): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaaaaagcgccccataggccgcagcgctatcgcgacgtcgccaccgcccaccggccaccaccacaaggcacacggggacgggcgcccgctccactaccactacctcccgtcagtcagatcccaatcaaaagaggagcatcgcagagctgtacgtatcacgcaggaggtagcgttccactcgcttcgcggtggccatggtctcgtctccttcccctcccttgcccaccggtgcctccgagccgaagcagcagcgaggcggcaccaaggcggcgccggagaaggccgacaagaagtacgcgcacgtcccgacgccgctccaccacggtcacggcggtgccagcaacaagacaacaccccgcggggccaaggacgccgccggcccggcggcgtacgtcgcggcggtgtccttctccgactgccgcttcaagcagcgcgccctcgcgccggcgtcgcccggcgccgtcatccgctcgctgttcgtctccctcacccgccgctccaccccgcgctcgtcgccgtcggccacgccggcctcggcaggcgccgacgcgggggacggcgagcagtggcgcctcgccgcggccgacctctcccgcaggctcgccgcggccacgcgcacgcgggacgaggcgctggaggagaccacgcgcctgaagcactccctcgccgagctggagcacaagctcgcgcgcctcgaggcgcgcgtgctnccgacccccgcggtcgcctttcccgtcgactccttnctcgcngcgtctcgaacgcccgcgccgccgtgcggaactcgcgcgcgcgctgtcccgccacctcgcagcccctcatgcccggcccgagctcgagacttcttcaacgcgcg

SEQ ID NO: 80853 - protein, 220 aa, Zea mays
  misc_feature: Ceres CLONE 1566220
  misc_feature (184)..(184): Xaa is any aa, unknown, or other
MVSSPSPPLPTGASEPKQQRGGTKAAPEKADKKYAHVPTPLHHGHGGASNKTTPRGAKDAAGPAAYVAAVSFSDCRFKQRALAPASPGAVIRSLFVSLTRRSTPRSSPSATPASAGADAGDGEQWRLAAADLSRRLAAATRTRDEALEETTRLKHSLAELEHKLARLEARVLPTPAVAFPVDSXLAASRTPAPPCGTRARAVPPPRSPSCPARARDFFNA

SEQ ID NO: 80854 - DNA, 914 bp, Zea mays
  misc_feature: Ceres CLONE 1566227
  misc_feature: Encodes the peptide sequence at SEQ ID NO. 80855
  misc_feature (720)..(720): n is a, c, t, g, unknown, or other
  misc_feature (764)..(764): n is a, c, t, g, unknown, or other
  misc_feature (909)..(909): n is a, c, t, g, unknown, or other
ggagctccccgcggtggcggccgctctagaactagtggatcccccgggctgcaggaattcgtctcacccctagaaaaaattcctcctctccctctccacggcccacgcccaccgccccatccaccccgaaaccctagcggatcgtcgccatggccgcggccgcgctccttcgccgcatccccgccgcgcgggccccggccacggccttcatggcggcgcgcccggtctccgattccacggcggcgctcaccatcgagacatctgtccctttcacctcccacctcgtcgacccgccctcgcgcgatgtcaccaccacccccgccgagctcgtcaccttcttccgcgacatgtccctcatgcgccgcatggagatcgctgccgactccctctataaggccaagctcatccgcgggttctgccacctctacgacggccaggaggccgtcgccgtaggcatggaggccgccatcacccgctccgattccatcatcaccgcctaccgcgaccactgtacctacctcgcccgcggaggggacctcgtctccgccttctccgagctgatgggccgcgagggcggctgctcccgcgggaagggcggatccatgcatttctataagaaggatgccaatttctacggcgggcacggcatcgtcggcgcgcaggtgcccctcggatgcggcctcgccttcgctcagagtacaagaaggaggagacggccancgttggccctctatggtgacggggtgcgctaacaggggacagcntcttgaggctctcaacatttcggccctctggaagctgccccgccatattggtttgcgagaacaaccattatggtatggggacaggcggatggtagggcagcgaagagtcctgcctactacaagcgtggcgaactatgtgcctggnatgaa

SEQ ID NO: 80855 - protein, 200 aa, Zea mays
  misc_feature: Ceres CLONE 1566227
  misc_feature (65)..(200): Pfam Name: E1_dh Pfam Description: Dehydrogenase E1 component
  misc_feature: SWISSPROT Homolog: EC 1.2.4.1 Pyruvate dehydrogenase (acetyl-transferring)
  misc_feature (191)..(191): Xaa is any aa, unknown, or other
MAAAALLRRIPAARAPATAFMAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQSTRRRRRPXLALYGDGVR

SEQ ID NO: 80856 - DNA, 968 bp, Zea mays
  misc_feature: Ceres CLONE 1566228
  misc_feature: Encodes the peptide sequence at SEQ ID NO. 80857
  misc_feature (898)..(898): n is a, c, t, g, unknown, or other
ctggagctccccgcggtggcggccgctctagaactagtggatcccccgggctgcaggaattcgtctcacccctagaaaaaaaccgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaagaaggccgccgcggcggcggcggcggcggcggcggcgaagcctgccacgagggcgtacgtgacgttcctggcgggcgacggcgactactggaagggcgtggtggggctggccaagggcctgcgcaaggtccgctcggcctaccccctggtggtggccgtgctgcccgacgtgcccgagtcccaccgccgcatcctcgtctcgcagggctgcgtcgtccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacggcctgttcgagctcgagaaggggtacttctacgcggtgatggactgcttctgcgagaagacgtggagccacaccccgcagtacaggatcggctactgccagcagtgcccggaactaggtggcgtggccagcggcgtacgccgagctgggcccctcgccgtcgctctactcaacgccggcatgttcgtgcacgagcccagcgtggccaccgtcatgcgctcctcgtacaccctcgcgtgactccgcccacccccctcgcagagcaggactcctgaactgtttnctcaggatcagtacaggccgatccccacgtggtacacctcgtgctgccatgctctggaggcacccgagaa

SEQ ID NO: 80857 - protein, 216 aa, Zea mays
  misc_feature: Ceres CLONE 1566228
  misc_feature (33)..(216): Pfam Name: Glyco_transf_8 Pfam Description: Glycosyl transferase family 8
  misc_feature: SWISSPROT Homolog: EC 2.4.1.186 Glycogenin glucosyltransferase
MAPELMTAKMTAKKAAAAAAAAAAAKPATRAYVTFLAGDGDYWKGVVGLAKGLRKVRSAYPLVVAVLPDVPESHRRILVSQGCVVREIEPVYPPENQTQFAMAYYVINYSKLRIWEFVEYERMVYLDADIQVFENIDGLFELEKGYFYAVMDCFCEKTWSHTPQYRIGYCQQCPELGGVASGVRRAGPLAVALLNAGMFVHEPSVATVMRSSYTLA

SEQ ID NO: 80858 - DNA, 944 bp, Zea mays
  misc_feature: Ceres CLONE 1566229
  misc_feature: Translation starting site: 186
  misc_feature: SWISSPROT Homolog: EC 3.4.22.1 Cathepsin B
  misc_feature (749)..(749): n is a, c, t, g, unknown, or other
  misc_feature (941)..(941): n is a, c, t, g, unknown, or other
ctggagctccccgcggtggcggccgctctagaactagtggatcccccgggctgcaggaattcgtctcacccctagaaaaaggagtacttcaattggcgttggccgaagaagaggagaagcgaagcaagcagcttcgagaacaagggggagggggaggaccaagcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttgggcttttggtgctgtggagtgcctccaggaccgtttttgcattcacctcaacatgagcattttactttcagtcaatgacctactggcatgctgcggttttatgtgcggcgatgggtgtgatggaggctatcctatagaggcatggcgctactttgttcaaaatggtgttgttacgggatgagtgtgatccatacttcgnacccggtcggttgcaagcatcctggatgcgaacctgcttttcctacaccaaagtgtgaaaagaatgcaaggagcagaacccagtttggcaggaaaagagcatttcagcattgatgcgtacagaaataattcagatcacatgacataatggcagaggtctacaaatggggccctgtagaagttgcttccccangta

SEQ ID NO: 80859 - DNA, 839 bp, Zea mays
  misc_feature: Ceres CLONE 1566230
  misc_feature: Encodes the peptide sequence at SEQ ID NO. 80860
ctccccgcggtggcggccgctctagaactagtggatcccccgggctgcaggaattcgtctcacccctagaaaaaaacgacgcatcgagacccatgcaagggtaatgatgaagagtgcccacgaagcttgtgtgtccgcggtccgccttgtcccccacctcctataaaacgggagcgaagacggccctccccttggagacttgcaatcccatctgctccggacagagccctcgctccacaccgccggcgacctttttcctcctccgctcgaggagtgggccaacggagggagaccatatgggcgcggaggcagggcatgggcatccgcagcagcagcctccctcgtccctccgacccggcagggaggccgcggcgccgcccgcggtggtggggctgcagctctcggcgctgatcgaccacgtcgcgcgcgtcgactggtccctcctcgaccgcgtccctggcgaccgcggcggctcgcagcaggtatccattgatgagctgaatcatattcttgatgaagtgaatgcccacatccttccttcccgcaatgatctcactccggtaactacaatagccggtggaagtgttgccaacacaatccgtgggctctcagctggttttgggatatcaactggaataattggagcttgtggagatgacaaccagggacttctgtttgtcaacaatatgagctttagtggtgtagatctcacaagattaagggcgaaaaaagggcacaccgctcaggtagtctaatatctgaagccagaagttatcttttttgcccttattttactgcatagtggataaggctgaaaagctctattatagtgtgtgtgc

SEQ ID NO: 80860 - protein, 152 aa, Zea mays
  misc_feature: Ceres CLONE 1566230
MGAEAGHGHPQQQPPSSLRPGREAAAPPAVVGLQLSALIDHVARVDWSLLDRVPGDRGGSQQVSIDELNHILDEVNAHILPSRNDLTPVTTIAGGSVANTIRGLSAGFGISTGIIGACGDDNQGLLFVNNMSFSGVDLTRLRAKKGHTAQVV

SEQ ID NO: 80861 - DNA, 950 bp, Zea mays
  misc_feature: Ceres CLONE 1566231
  misc_feature: Encodes the peptide sequence at SEQ ID NO. 80862
ctggagctccccgcggtggcggccgctctagaactagtggatcccccgggctgcaggaattcgtctcacccctagaaaaaatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgggggcgccgctggactcaagcatgtggaagttccggtcccttcggccaaaaagaatgagcttctgctgaagctggaggcagcaagcatcaacccagtggactggaaggtgcagaaaggcatgctgaggcctttcctgcctcgtaaattaccttttatcccagtgactgatgtggcaggagtcgtggctgatgttggtccaggaatcaatgggttccaagccggagatcaagttgttgctatgctcaactcatttaacggaggtgggcttgcagagtatgctgtggcatcagaaaatctgaccgtcaagaggcctcctgaggtatctgctgccgaaggcgcagggctgcccatcgccgccagcactgccctccaggcgctcaggaccatcggcgccaagttcgacggtactggcaaggacatgaacgttctggtcaccgcgcatcaagtggcgtcggactctacgccgtgcagctcgcgaaacggctggtctcacgtcactgccacctgcggcgcgcagtacgtagagctggtgaagagcctgggcgtcgacaatgtgcttgactacaggaccccggaaggtgccagctgcagagcccctcagcagaaaatagaatgcgtcgtccatgccttgtgggaacaactggtcaactttt

SEQ ID NO: 80862 - protein, 228 aa, Zea mays
  misc_feature: Ceres CLONE 1566231
  misc_feature (28)..(114): Pfam Name: ADH_N Pfam Description: Alcohol dehydrogenase GroES-like domain
  misc_feature: SWISSPROT Homolog: EC 1.6.5.5 NADPH:quinone reductase
MRAVQYDSCGGGAAGLKHVEVPVPSAKKNELLLKLEAASINPVDWKVQKGMLRPFLPRKLPFIPVTDVAGVVADVGPGINGFQAGDQVVAMLNSFNGGGLAEYAVASENLTVKRPPEVSAAEGAGLPIAASTALQALRTIGAKFDGTGKDMNVLVTAHQVASDSTPCSSRNGWSHVTATCGAQYVELVKSLGVDNVLDYRTPEGASCRAPQQKIECVVHALWEQLVNF

SEQ ID NO: 80863 - DNA, 871 bp, Zea mays
  misc_feature: Ceres CLONE 1566232
  misc_feature: Encodes the peptide sequence at SEQ ID NO. 80864
  misc_feature (720)..(720): n is a, c, t, g, unknown, or other
ccgctctagaactagtggatcccccgggctgcaggaattcgtctcacccctagaaaaagctgagtctctcacctgctggcggaggcggcccccaaaagccaaattccccagcccacaccacctccacactccagtaagcaccccgcctcccccctcgatctccctcctccaattccttctgctgctgcgactgaatcgaattgctccactgctactaatctatatactactactgcttgctcctgtttcaatcgatcaatcatgccgcgcgtaggttttttccggcgcaaaggtaaccagcgaacacgagccccggtttcccgaccccctctcccagatccgcagcgcgcccgcgcgattccgtccgcccgacgcgagttcccctgtgtattttttttgtgatgatttttttgacctctttgcctggtctagggttagggtttgctgtcggcgatgtcggatcggcagccgtcggaggaaccggaggagcaggtggacctggagggggaccaccacggcatggacgacgacgacccctgggtaccgtcgccgcggaagccgggacaactcggaggagcccgaggaggataacgacaatgacgagcgccaccgccaaggccaaagaaaacccccgggatgggagcccgagccgggccggaaaaaaaaggcggggagatgaccgggcaaggggcccccactttcgcctgtgggtgggccccngggccgggagggagaggagccggttggggaagaactggttcccccgggccgccccaaggggtttagagggcctttattggttgggcgccgcgcccgggtaattcacgaggggggggaccctccttggaagttggtggtaaccgtcggggga

SEQ ID NO: 80864 - protein, 45 aa, Zea mays
  misc_feature: Ceres CLONE 1566232
MSDRQPSEEPEEQVDLEGDHHGMDDDDPWVPSPRKPGQLGGARGG

SEQ ID NO: 80865 - DNA, 607 bp, Zea mays
  misc_feature: Ceres CLONE 1566233
  misc_feature: Translation starting site: 123
  misc_feature: SWISSPROT Homolog: EC 3.2.1.14 Chitinase
gggctccccgcggtggcggccgctctagaactgtggatcccccgggctgcaggaattcgtctccccctagaaaaaaaacacaccacccaaactaaacaacaccagcttctctaaagatcacaatgatgagagccctggcggtggtggccatgctggccacctgccttcttcgctgtgcccgctcgcgccgagcagtgcgggtcgcaggccggcggcgcgctgtgccccaactgcctgtgctgcagccagttcggggtggtgcggcagcaccctccgaactactgccggccagccgggtgcccagagcccagtgcaaccggcagcctgccggcaaccacccccgaaaccccccccgaaccaaccggccggcctttggcctttccatttaattccccccgaaattcggctttcttttaaaacccaaaaattgccttggtttggccccccccaaaaaaaaaaacccggggggtttggccccccccccccaaaaaaggggggtttttttttttaccacccccctttaacacccgggggggggggtttttttttttttatggcccgggggggggggggggccacaaaaaaggggggttgttttccccccgcg

SEQ ID NO: 80866 - DNA, 952 bp, Zea mays
  misc_feature: Ceres CLONE 1566235
  misc_feature: Encodes the peptide sequence at SEQ ID NO. 80867
  misc_feature (952)..(952): n is a, c, t, g, unknown, or other
cccgcggtggcggccgctctagaactagtggatcccccgggctgcaggaattcgtctcacccctagaaaaaaaaccacctcccaaactaaacaacaccagcttctctaaagatcacaatgatgagagccctggcggtggtggccatgctggccacctccttcttctctgtgcccgctcgcgccgagcagtgcgggtcgcaggccggcggcgcgctgtgccccaactgcctgtgctgcttcccgttcgggtggtgcggcaacacctccgactactgcggcagcgggtgcctgagccagtgcagcggccgctgcggcagcaccccgaaccctgcgagcagcggcggcgtggcgtccaacatccccgagtcgctcttcaaccagatgctgctgcaccccacccacgctgtgtggcccgccaacggcttctacacctacgcgggcttcatcacggcagccaactcgttcccgggcttctgcaccacgggtgcgccccacatggaaaagcgcgagctggcagatttcctggagcatacgtccccacaaacgaccggcgggtgggcgaacggccccgacggggccctacgcctggggtttactgctctcatgaagaaccagggccggtgcgtcccgggcccgcacttctggctagctccagcgaccaatttggcctgtgctccccggcggaagaaattaataaggtccgcggggcccattccggattctcctaaaattataaccttcgggcccccccagccatgagtaattggccccggggatcttctccaatccggaatatggggggcagccaaccccaccttgttcttttataacccccacctggtttcagtataaacaccccgtctgctcattgtgttatgccaccactttttaaacggggtcatggacacacctctcccgcttaatcctcgtccgaagggtaccagggtttcan

SEQ ID NO: 80867 - protein, 213 aa, Zea mays
  misc_feature: Ceres CLONE 1566235
  misc_feature (22)..(61): Pfam Name: Chitin_bind_1 Pfam Description: Chitin recognition protein
  misc_feature (81)..(202): Pfam Name: Glyco_hydro_19 Pfam Description: Chitinase class I
  misc_feature: SWISSPROT Homolog: EC 3.2.1.14 Chitinase
MMRALAVVAMLATSFFSVPARAEQCGSQAGGALCPNCLCCFPFGWCGNTSDYCGSGCLSQCSGRCGSTPNPASSGGVASNIPESLFNQMLLHPTHAVWPANGFYTYAGFITAANSFPGFCTTGAPHMEKRELADFLEHTSPQTTGGWANGPDGALRLGFTALMKNQGRCVPGPHFWLAPATNLACAPRRKKLIRSAGPIPDSPKIITFGPPQP

SEQ ID NO: 80868 - DNA, 777 bp, Zea mays
  misc_feature: Ceres CLONE 1566237
  misc_feature: Encodes the peptide sequence at SEQ ID NO. 80869
acccgcggtggcggccgctctagaactagtggatcccccgggctgcaggaattcgtctcacccctagaaaaacgctcccactcgtcttctccctccctagtcgctccccaaatcggatctccaggccggcagaagttgagcggactgactggtcactgtagttcgatcgaatccgagtagggctgatacagttcgattcggcgggaggcatggcgtccgaaaagcacttcaagtacgtcatcctcggcggcggcgtcgcggcggggtacgcggcgcgggagttcgccaagcagggagttaagcctggggagcttgcaatcatctccaaggaggctgtggctccttatgagcgtcctgccctaagcaaaggttacctctttcctacgaatgctgcaagactcccaggattttatgtatgtgtgggaagtggtggagagaagctattgcctgagtggtactcagagaaaggcattgagctgatccttagtacacaaattgtcaaagctgatctttccaccaagactctgactagtgccactggagccaaacttttaacaattgaagaattttgggccatttggtcaagggggccccccccgggaaaaaaaaaaccccccctcttttttttggcccaccccccgggggggggttgttttttttccaaccaccccttttttttttttgtgggggagaaaaagaaaaataattgtttgttgtgtgccccccccgggcggggggggttgtggtgttttttttcttcttcctacaaaagagaaa

SEQ ID NO: 80869 - protein, 189 aa, Zea mays
  misc_feature: Ceres CLONE 1566237
  misc_feature: SWISSPROT Homolog: EC 1.6.5.4 Monodehydroascorbate reductase (NADH)
MASEKHFKYVILGGGVAAGYAAREFAKQGVKPGELAIISKEAVAPYERPALSKGYLFPTNAARLPGFYVCVGSGGEKLLPEWYSEKGIELILSTQIVKADLSTKTLTSATGAKLLTIEEFWAIWSRGPPPGKKKPPLFFLAHPPGGGCFFSNHPFFFFVGEKKKNNCLLCAPPGRGGLWCFFSSSYKRE

SEQ ID NO: 80870 - DNA, 971 bp, Zea mays
  misc_feature: Ceres CLONE 1566238
  misc_feature: Encodes the peptide sequence at SEQ ID NO. 80871
  misc_feature (843)..(843): n is a, c, t, g, unknown, or other
  misc_feature (884)..(884): n is a, c, t, g, unknown, or other
ctggagctccccgcggtggcggccgctctagaactagtggatcccccgggctgcaggaattcgtctcacccctagaaaaaatcactccctcgcctcccccgctgtgccggcctgcacacacagacacacacaccacagcctacagcgcttctgctgctccagctcctcgtactaccgcgcccgcgcgctgctcgttccccggcctctgcttgcttggctcgtcgagcccagaggttggtggagaggcggggcttattgccccagataggagatcggggacgcgggagggcgcgtcgcgctcgggccggtctcggttcagcgggatcacttggccgtggccgtggtcgggcctccggcgcccatgtggtgagccaagccaggcttttgttgcccggggggcagagatcttgcacttgcagcagtgaagccggcggtgcggtccggtccggtccggagccgagcggcgcccaccgccatggccggcagcgacgaggtcaaccgcaacgagtgcaagggggcggtgccgatccacacatgggtcctcatctccaacttcaagctggcgtacaacatgctccggcgggcggacggcaccttcgaccgcgacctggccgagttcctggaacggctggtggcgcccgacgcgcgggcccaggaaggggtctcctccttcgtacacgtgatcgacacgtcgaccggcctggatgtcgtcatctaccgcgccgcccgcatacatcacggctgcggctgcgccacctgcccatcctggacttctcggctgcacgcgtgcggcggcggcggcgccgtttcccgtcatcctctttcttcacggcggcagcttcncgcactcgtcgtccggcacgccatctactacacctgtgccngcgctgcaagctgacaaagggcttggtggtgtccgtgaactacggcgcgcccccgagcacgggtacccgtgcccgtacgatgacggg

SEQ ID NO: 80871 - protein, 140 aa, Zea mays
  misc_feature: Ceres CLONE 1566238
  misc_feature (123)..(123): Xaa is any aa, unknown, or other
  misc_feature (137)..(137): Xaa is any aa, unknown, or other
MAGSDEVNRNECKGAVPIHTWVLISNFKLAYNMLRRADGTFDRDLAEFLERLVAPDARAQEGVSSFVHVIDTSTGLDVVIYRAARIHHGCGCATCPSWTSRLHACGGGGAVSRHPLSSRRQLXALVVRHAIYYTCAXAAS

SEQ ID NO: 80872 - DNA, 941 bp, Zea mays
  misc_feature: Ceres CLONE 1566240
  misc_feature: Encodes the peptide sequence at SEQ ID NO. 80873
  misc_feature (815)..(815): n is a, c, t, g, unknown, or other
  misc_feature (897)..(897): n is a, c, t, g, unknown, or other
ggagctccccgcggtggcggccgctctagaactagtggatcccccgggctgcaggaattcgtctcacccctagaaaaactcaatgcatcaatagaccaacaaaatatgcatctaaaatctgtggaggacttatgccaatcttatgttgattcccatgacaaggctacttctgagctgaaaaagaagattttggcttcaaaatcattatacatgtcacatatggaagctttcctaaatgttgtcctcgtacataaagcaagtgcaaatggcacactagaagatatatcatcactgtctgctgcaagctgctgtagtcttgaccagctactagtttgtgttgagggagaggcacagaatgtatttaatgacatccataatttgttaaccatccaccgaagcgaaatgacgcacttcactcaagaattaagggagagtttccaaataagcttggataggacaaatgaaatgtccacctatattattgggctctttgacaagtacgttgaggaaacctccaaattgcacagtcactcaaataatactcatgaagcacaaatgaaaagcattgaagactttcagatggtttatgaggagcaatcaaaatcagtggagcagaagcttttagcggagataagcagtttagtatctaaacatattactcgacaaagagagttggtgggcgttagattgagctctctgggcgatgctgcccgtggaaataaggcatttttggatgacacacatcggccatggagtttgtcacaaagatgctaagaagaaagtggaacgtttgcagagcagctgaaatgactgcnaagctggctccagctttctgcagctagcatagcgcatgaaaccatgcttcaggatgcgcatgccctggtgactcgccgtccngcatggaagaagtccctgctgctgtaagatcccagcaaaagcaa

SEQ ID NO: 80873 - protein, 257 aa, Zea mays
  misc_feature: Ceres CLONE 1566240
GAPRGGGRSRTSGSPGLQEFVSPLEKLNASIDQQNMHLKSVEDLCQSYVDSHDKATSELKKKILASKSLYMSHMEAFLNVVLVHKASANGTLEDISSLSAASCCSLDQLLVCVEGEAQNVFNDIHNLLTIHRSEMTHFTQELRESFQISLDRTNEMSTYIIGLFDKYVEETSKLHSHSNNTHEAQMKSIEDFQMVYEEQSKSVEQKLLAEISSLVSKHITRQRELVGVRLSSLGDAARGNKAFLDDTHRPWSLSQRC

SEQ ID NO: 80874 - DNA, 935 bp, Zea mays
  misc_feature: Ceres CLONE 1566244
  misc_feature: Encodes the peptide sequence at SEQ ID NO. 80875
  misc_feature (352)..(352): n is a, c, t, g, unknown, or other
  misc_feature (398)..(398): n is a, c, t, g, unknown, or other
ccccgcggtggcggccgctctagaactagtggatcccccgggctgcaggaattcgtctcacccctagaaaaagaacgccatccgttccatttcttatcccctcctcctcccagtcccagccatcgcctcccgatggcgtccctcgtcacgctccccgccatcgccttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcgggagtgacgacgaggacgaagaagggccgtacnggagcgacgccgacgaagggtttcagggggaacgaagaggagctcnccatttgcaggctcggcctgcccaacgagctcgtccgcacccttcagaagcgcgggataccccacctggttccccatacgggagggctgggttggtttcccgctcctttggggggccggaccttgatttgctaaaaccaaaaacccgggaacccgggaaaaaaccccttgcccttttgggaattcccccggggacccaaaaaatttattgggggacaaaaaaaaaagggggccgggaaaaaaaaggggagagggggccccccccccccgggggttttggggttttctcccccccccccccagaaagaatggttccccaaaaaatattttgaaaaagggaaaaaaaaaggaagattccccccccccccttttgttggccgggggggtttttttttgagggggggttctcttataaaaattggccgcccaaaaaaagagccctcccccccgggggggggaaattttatttttgtttgccacccccccgcgggccccccttttttttttttatataagagggggggggcccccccccttg

SEQ ID NO: 80875 - protein, 198 aa, Zea mays
  misc_feature: Ceres CLONE 1566244
  misc_feature (74)..(74): Xaa is any aa, unknown, or other
  misc_feature (89)..(89): Xaa is any aa, unknown, or other
MASLVTLPAIAFSNPATASGAVRLRAAAFRCWALRRRGWAVAAAVASPNSVLSEHAFKRLQLGSDDEDEEGPYXSDADEGFQGERRGAXHLQARPAQRARPHPSEARDTPPGSPYGRAGLVSRSFGGPDLDLLKPKTREPGKKPLALLGIPPGTQKIYWGTKKKGGREKKGERGPPPPGGFGVFSPPPPERMVPQKIF

SEQ ID NO: 80876 - DNA, 938 bp, Zea mays
  misc_feature: Ceres CLONE 1566246
  misc_feature: Encodes the peptide sequence at SEQ ID NO. 80877
  misc_feature (696)..(696): n is a, c, t, g, unknown, or other
  misc_feature (767)..(767): n is a, c, t, g, unknown, or other
ctggagctccccgcggtggcggccgctctagaactagtggatcccccgggctgcaggaattcgtctcacccctagaaaaactctcttcttctccccttccacccaaagccttgacctcacgtctgagagcaaaccagacgaaacaaaccctcctgggctgcttccccttttcgatccccatggcgcaggacgacatcccggagtcctccgcctccggatcccccacctcctccgccccggcggctcgcctcaacgccgccgcgcccgagtttaccccccgatccgccgcccagcaccacggcaacaacgcccatcgccgcggcccgcaccaccaccatcagccgcaccaccacccccactaccaccctcaccagcactaccagccgcggcaccagcaccatcaggcccaggccgaggatgaggggagcgccgccgcgacggcggaggatagggagggccccgctggtgcggtgcagccgcagcaccggctgcccgaacccgaggcccgcaagctcgtcaagcaggttgaattttacttcagcgatatcaatttggccacaactgaacatctgatgaagttcatcgctaaggatccagatggatttgtgccaatttctgtagttgcatcttttaggaagatccgagagatagtttatgatagatccttgttggttgctgcattacgcacatcatctngagctggttgtttcagaggatgggaaacatgttaaacgcttacagcccttcaatgccgaagaagttcagtnctcgtattgttggtgctgaaaatttacctgaggatcaaaagcatcagactctgatgaagattttctcaagctggtggggaagtatgacccatgtctatacctggttacacaaatagttgcgactcagaatacatagtaatctcatggagagctataatgtattctggaatg

SEQ ID NO: 80877 - protein, 183 aa, Zea mays
  misc_feature: Ceres CLONE 1566246
  misc_feature (112)..(171): Pfam Name: La Pfam Description: La domain
  misc_feature (173)..(173): Xaa is any aa, unknown, or other
MAQDDIPESSASGSPTSSAPAARLNAAAPEFTPRSAAQHHGNNAHRRGPHHHHQPHHHPHYHPHQHYQPRHQHHQAQAEDEGSAAATAEDREGPAGAVQPQHRLPEPEARKLVKQVEFYFSDINLATTEHLMKFIAKDPDGFVPISVVASFRKIREIVYDRSLLVAALRTSSXAGCFRGWETC

SEQ ID NO: 80878 - DNA, 911 bp, Zea mays
  misc_feature: Ceres CLONE 1566248
  misc_feature: Encodes the peptide sequence at SEQ ID NO. 80879
  misc_feature (677)..(677): n is a, c, t, g, unknown, or other
  misc_feature (680)..(680): n is a, c, t, g, unknown, or other
  misc_feature (867)..(867): n is a, c, t, g, unknown, or other
ggagctccccgcggtggcggccgctctagaactagtggatcccccgggctgcaggaattcgtctcacccctagaaaaagcctgccttttcttctctcgtccaccctaggtctcagtctctgtctctgtctctgctcgcgctcttgtggagctactaggtgaccgtcgcggccgccctacgccacgtgctcgatccagcctcgtcggcttcttcgcacccgtcaccggcggtcagcacccaccaggttcatagatggcagagacggtgttcaccccctctttggaagggatgaagcatgtgaaggcggagaacggagtcattctcaccaagcccttccttgatgtctgcaagcaaatcttgcctgtcctggataaatttggagctgctatggcaattgtaaagaatgatatcagcggcaatatcacaaggctggaaaacaagtattcttcagatccatcgaagtatggacacttgtacagcatggttcaggaagaagttcaaaacaagaccgcgaaaggttcctcaagctgcacaaatggtcttctgtggctcacgagggccatggatttccttgttgagttgttccgtaacctgcttgagcatccagactggaccatgactcaagcttgcactgattcatacaccaagaccctcaagaaatttcatggctgggctgnccnagtctagtttacggtggccatgaagctctctcctaatagagataaatttatgggaggtcatagtggaactggtgatatcaatgcagatatggagaattttgcacaaccttctctcctttttccaagaaatcacgagtttctggcgagcgttggtcttgatgatatgaaggctcgtaagcgatctccnaggtgtgataacaacaaataactgtcttatcaactcagtgttga

SEQ ID NO: 80879 - protein, 144 aa, Zea mays
  misc_feature: Ceres CLONE 1566248
  misc_feature (10)..(145): Pfam Name: GLTP Pfam Description: Glycolipid transfer protein (GLTP)
  misc_feature (142)..(142): Xaa is any aa, unknown, or other
  misc_feature (143)..(143): Xaa is any aa, unknown, or other
MAETVFTPSLEGMKHVKAENGVILTKPFLDVCKQILPVLDKFGAAMAIVKNDISGNITRLENKYSSDPSKYGHLYSMVQEEVQNKTAKGSSSCTNGLLWLTRAMDFLVELFRNLLEHPDWTMTQACTDSYTKTLKKFHGWAXXV

SEQ ID NO: 80880 - DNA, 871 bp, Zea mays
  misc_feature: Ceres CLONE 1566249
  misc_feature (605)..(605): n is a, c, t, g, unknown, or other
  misc_feature (606)..(606): n is a, c, t, g, unknown, or other
ccgcggtggcggccgctctagaactagtggatcccccgggctgcaggaattcgtctcacccctagaaaaagttgcccttttcccgttccctgccccttcttctccgtctttctccggtcggctttggagaaagaggtgatgtgaggttcccatcactcacgcctggctgggtagctagatgctcccgggccgtctttattacggctgtcgccggtctgggctgcggtcggcggcggaggggagtcttctggcggagatatgagagggttgttttggtgaggtctatgagctggtaccagaactgctcataatattcagggaaaaaaaaaaggcaacatggcggaatcgaaggtcgcaagtctggatgcccgaacgacgaagatcagaaacgtccccatcgcagtgaccccagaagggttctggtgctgcccgtcgcaagccgtgctccagaagacggcgaagagccaaaacccgcaggcgaagacgaagcccagagggggtgcctcgcctctcgcaccaaaggcggcaccaccaatcagagggcgccccacatctcgtccgagaggaggacgcactcgactccgacgagggcgaagacctactcnnaggagcaaaggtgcttgccgtcggcaaaggaccctgcggctaaaaaaaagcccactaatcccccaaaggcggggaacgaaaggccccaaaaccccccaaggttctttttgggttccgccccatctcaaaaaaaggatttaaaaggggggctttatttaaaagaacggttttccgggaaaaaaaaaggtcccaaaaaaccccccttgtgaaaaacaccccctttttgtaaaaaacctctcggggattcctccgcgaaaaaaaaaaa

SEQ ID NO: 80881 - DNA, 960 bp, Zea mays
  misc_feature: Ceres CLONE 1566250
  misc_feature: Translation starting site: 262
  misc_feature (798)..(798): n is a, c, t, g, unknown, or other
  misc_feature (842)..(842): n is a, c, t, g, unknown, or other
  misc_feature (921)..(921): n is a, c, t, g, unknown, or other
  misc_feature (935)..(935): n is a, c, t, g, unknown, or other
  misc_feature (936)..(936): n is a, c, t, g, unknown, or other
  misc_feature (949)..(949): n is a, c, t, g, unknown, or other
ttggagctccccgcggtggcggccgctctagaactagtggatcccccgggctgcaggaattcgtctcacccctagaaaaaggacctcaacgccgagcagcaggccatcgaggctgtcgccaggagcctctgctggaccaaggtcaaggaagccggcgacatcgccgtctggcagaaaccctacaaccacgccggctgcaaggcttccaagtcgccgcccttctgctcgcgcaagaatccagacgcggcatggtacgacaagatggaggcctgcataacgccgctgccggaggtctctagcgccagagacgtcgccggcggcgcggtgaagaaatggccgcagcggctcacggccgtgccgcccagggtctcccgcggcaccatcgagggcgtcacggccaggtcgttcgcgcaggacaccgcgctgtggcggaagagggtccgtcactacaagtcggtgatcagccagttcgagcagaaggggcggtaccgtaacgtgctggatatgaacgcgcgcctgtggcgggttcgccgcggcgctggcggcggcgggcgaccccctgtgggtcatgaacatggtcccgaccgtggggaacacgaccacgctcggggccatctacgagcgcgggctcatcggaagctaccaggactggtgcgatggcatgtctacctacccgaggacctacgatctcatccatgcggactcggtgttcaccctgtacaggaacaggtgcgagatggaccgcatccttctggagatggacaggatcctgaggcccaggggcacggtgatcatcanggaagacgtggacttgctggtgaagtcaagaccctggcgacgtnatgaagtggggagagcagatcgtcgaccacgagacggccgctcctcaggtagagaatctcctggttgtgatacgtactnactgccatgatgcnntgacagatcatanccagacgtgat

SEQ ID NO: 80882 - DNA, 1038 bp, Zea mays
  misc_feature: Ceres CLONE 1566251
  misc_feature: Translation starting site: 173
  misc_feature (1015)..(1015): n is a, c, t, g, unknown, or other
ctcaccgcggtggcggccgctctagaactagtggatcccccgggctgcaggaattcgtctcacccctagaaaaatgctttcttagaggtgggttggcttctcctccccctccggttcgggttcgggttcgtgaggttctccagggttcgggttcgtgggtgagcggatccagatggccgcctccgatgttgagtaccgctgcttcgtcggctgcctctcctgggccactgacgaccactccctccacaacgccttcagcacctacagcgaagtcctcgagtccaatatcatcctcgatcgggagacgcagaggtcccgcggcttcggcttcgtcaccttctccccgatgaggccattgcgaaccccatcgagggcttgaacggtaagggactggacggccgctacatccccgtccaggtggcccattacccgcggttggccttgaaggcccccacctgtgggttacgggggttgtccgttggaagcctgcagccttcctcgtttggcaggccccccctttttgtttgtggcccccccccggggagggggcgggcggcttacagggggccggtggggggtttacagatggtgttttggcccccggtttacaccgggggggacaccctgggggcgggggttataagggaacctccccacggggaaactggggagaaaactgtaccgggggggggcccccccccccccccaaaatttatcgttgtttccctcacccgtgtattgttttccccccttccttcaagagggttttttctctccctccccggttcccgtttttgtgtctttctcccccctcttctgtgtttttttatatataaagggcgcgtcctccggggcacccttttttattattctgggtgtaacacccgcgtttttttcccgattcccactgtcttccacaccacctggatccttcgcctttcgttgtattattatttttccccctctctaggaggtgttatgtccggtttttctctataaagagaaaatgtgggtntctcttgaagcgcacataaaaaa

SEQ ID NO: 80883 - DNA, 906 bp, Zea mays
  misc_feature: Ceres CLONE 1566258
  misc_feature: Encodes the peptide sequence at SEQ ID NO. 80884
  misc_feature (798)..(798): n is a, c, t, g, unknown, or other
  misc_feature (799)..(799): n is a, c, t, g, unknown, or other
  misc_feature (870)..(870): n is a, c, t, g, unknown, or other
ctggagctccccgcggtggcggccgctctagaactagtggatcccccgggctgcaggaattcgtctcacccctagaaaaaatccccccgcgtagaggagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgccgtctggcaagaagaccctccgcaagggcacagcggtcatcaccggcgcgtcgtccggcctcggcctcgccacggcgaaggccctcgcggagacaggcaagtggcacgtcatcatggcctgccgcgacttcctcaaggcgtcgcgcgcggccaaggcggccggcatggacaaggacagcttcaccgtcgtgcacctggacctcgcctccctggacagcgtccgccagttcgtcaggaacgtgcgccagctggagatgcccatcgacgtggtggtctgcaacgccgccgtgtaccagcccaccggcatagtagcgtcctacaccgccgacagcttcgagatgagcgtcagcgtcaacccactcgggcacttnnctctcgcgcgcgagctcctcagcgaacctcagtccctcgactacccctctaagcgctcatcatcgtcggcntcatcaccgggtacacgacacgcctggccgggaacg

SEQ ID NO: 80884 - protein, 234 aa, Zea mays
  misc_feature: Ceres CLONE 1566258
  misc_feature (84)..(232): Pfam Name: adh_short Pfam Description: short chain dehydrogenase
  misc_feature: SWISSPROT Homolog: EC 1.3.1.33 Protochlorophyllide reductase
  misc_feature (198)..(198): Xaa is any aa, unknown, or other
  misc_feature (199)..(199): Xaa is any aa, unknown, or other
MALQAATSFLPSALSARKEGSVKDSASFLGVRLAADGLKLDTTALGLRTVRVSRSADIRAQTAAVSSPSVTPASPSGKKTLRKGTAVITGASSGLGLATAKALAETGKWHVIMACRDFLKASRAAKAAGMDKDSFTVVHLDLASLDSVRQFVRNVRQLEMPIDVVVCNAAVYQPTGIVASYTADSFEMSVSVNPLGHXXLARELLSEPQSLDYPSKRSSSSASSPGTRHAWPGT

SEQ ID NO: 80885 - DNA, 1147 bp, Zea mays
  misc_feature: Ceres CLONE 1566260
  misc_feature: Encodes the peptide sequence at SEQ ID NO. 80886
  misc_feature (31)..(31): n is a, c, t, g, unknown, or other
  misc_feature (39)..(39): n is a, c, t, g, unknown, or other
  misc_feature (46)..(46): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
ctacgcgccgttctgtttttacaacccccgntgtaagcnttagatnaaatntnnttttttttttaaagctggagctccccgcggtggcggccgctctagactagtggatcccccgggctgcaggaattcgtctcacccctagaaaaaagcagccagctcccactcgaaccgaccgtccgcccagaactatctcgctcgtccgcgttcagctcagctactccaatttcgcaacaagttgcaagcaataaccgaccaaggacgacgaacgggtcgatggccacgctctcctcctgcagtcgcctgagtagcggcaccggcgcctcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtccccccccacgtgggcggagttcgagctcgggcgggcgccggtctactggaagaccggcagtgggctcccgcccctcggcgtggcgagggggctgacccttgttctacaacccgggcggcgacgaatacggcccccgaaccaaggtgttcctggcgtggggcttcaaccggcgggcttcgaaccaagccccatcacggtgcggggggcagaggccggaagcaggatcaacccttccaaggaaggggggggccaaagtcccgaaccccgtccccttggtacacccgttcacgggataataccgggtgcccgggaacccacgtcccactaaagcccgtagaatcgttcccttccctttcaaccaaaggggtggccccgaagtgggggacgggggtccccttaacccgcttccaaggtttcaggggtgtccccccaatgccctgtggcataaaaaaaaagctgggtggagagcgttcttgtcaatgaaagggccctgggggggaaataaccttcccactggggggggggccgcccgggttcccgtggcccatttgtccccggtaaaaggaaaatttgtccctttccacaagttggccctgtggtacggtcttcccccaagaaaggaggggggatccggggcaaaacctggacctggggaggggaaggggggaccccgcctccacaag

SEQ ID NO: 80886 - protein, 172 aa, Zea mays
  misc_feature: Ceres CLONE 1566260
MATLSSCSRLSSGTGASAIHRQPARAGAVLVVTCRRSSSATVRAAAAATAAAPAAVELQNKGVSPPTWAEFELGRAPVYWKTGSGLPPLGVARGLTLVLQPGRRRIRPPNQGVPGVGLQPAGFEPSPITVRGAEAGSRINPSKEGGGQSPEPRPLGTPVHGIIPGAREPTSH

SEQ ID NO: 80887 - DNA, 759 bp, Zea mays
  misc_feature: Ceres CLONE 1566262
  misc_feature: Encodes the peptide sequence at SEQ ID NO. 80888
  misc_feature (375)..(375): n is a, c, t, g, unknown, or other
acccgcggtggcggccgctctagaactagtggatcccccgggctgcaggaattcgtctcacccctagaaaaaagaagacgcctccccgctccgcgttccccagcgccagcggtaaccccacccaactcctctgagctgtgacacagctgtcctcctccccccactccaggcgctcacacaccctccacttccctccacaggaatccgccgccataatctcctccgctccgctccaccccgcattgcaggattgcgccgagcacgagcaccctcctccccgaagcctcttctttgctctgctttcggtggtatggtgggcccgggggtatgcaactacaccggggtcttctgcgcgccgccgtcggcgaagcggcntcagtggtgggcaagggcaaggcggcggagctggccgtgtcggtgggacccgtcctggcggttccctagccaaccggctgcggaacccttacttcgcgctggcaaacctgaaagcaaaaggccattcttctccgaacccggggggttccccccccccaacggggggggccccgcgggggaattcaaaccaccccccggggaaggtctcccctttttgggggggccttgaacccttaaaacccggggggaaaaattttcggggggtataccccccccccccccggggaaaaattttgggccttgtgtcctttcttaaaaaaacctccgctggggggggggccccccccccccctcaaaaaaccccccaaaaaccggcgttttttt

SEQ ID NO: 80888 - protein, 38 aa, Zea mays
  misc_feature: Ceres CLONE 1566262
MQLHRGLLRAAVGEAASVVGKGKAAELAVSVGPVLAVP

SEQ ID NO: 80889 - DNA, 923 bp, Zea mays
  misc_feature: Ceres CLONE 1566263
  misc_feature: Encodes the peptide sequence at SEQ ID NO. 80890
  misc_feature (753)..(753): n is a, c, t, g, unknown, or other
  misc_feature (756)..(756): n is a, c, t, g, unknown, or other
ggagctccccgcggtggcggccgctctagaactagtggatcccccgggctgcaggaattcgtctcacccctagaaaaacatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagtagctaaaggaaggaaaatcaaccgagaccccgttagtagcggcgagcgagagcggaacaagggttttcatcaaaagaaatccgaagcggtttcattcgatttgttgtggattggatgatggaaaaaccagcaagcagcaagcgtacgctgtgttgccgtagcgcgccctacggagttgtacaaagtcagcattggggcgcaagcataggcaacacaggacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaagggggaccacccctctagcctaagtattccctcatgaccgatagcgtacaagtaccgtgagggaaaggtgaaaagaacccccatcgggggagtgcaaatagagaccctgagatcccgatgcgaacaatcantcnaaaggaaccggaacggcgggccgcactcactcctaacggcgttacctttccgcatgatgggtcagccgaggaaaaggggaacagccggcttttagccctttgggtggaaggcgcctttccagaggggggaaaggaaaaaatttacgttccttccatatttgaaccca

SEQ ID NO: 80890 - protein, 54 aa, Zea mays; identical to SEQ ID NO: 77039
  misc_feature: Ceres CLONE 1566263

SEQ ID NO: 80891 - DNA, 950 bp, Zea mays
  misc_feature: Ceres CLONE 1566266
  misc_feature: Encodes the peptide sequence at SEQ ID NO. 80892
  misc_feature (860)..(860): n is a, c, t, g, unknown, or other
aaagctggagctccccgcggtggcggccgctctagaactagtggatcccccgggctgcaggaattcgtctcacccctagaaaaagtacaacaagtccggcaacgacggctacgacagcgggtacaacagatcgggcaccaccaacgacgacgaatacggccgtggcaccggcggcgggtacggcagcaagccctctggcgacgacgcgtacgccggcggcggcggtggcgggtacggcaagcagtccggtggcggcgcggacgagggcggagagtacggctcctcccgggacgactcggagaagtacaggaaggaggagaaggagcacaagcacaaggagcacctcggcgagatgggcgccctcgccgccggcgccttcgccctgtacgagaggcacgaggcgaagaaggacccggagcacgcgcagcggcacaagatcgaggagggcgtggcggcggtggcggccctgggcagcggcggcttcgcgttccacgagcaccacgacaagaaggaggccaaagaccgtgttagagacagccggggaagaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaactcaataaaagaatcagccgggggtttgattgtccgtctatgtatatcatgtgtagttactgatgatgtgtgtgcatggtacttcgtacgcgtgtttggtgatcgatgtgttgggtgtgtgtgtctctgcatggacattttcctactctgcgttttttctctctctacgatatagnataatatgtggtgtggtctatatatgtggtgcacctggttttcgctcggctttttatcacgcttttgagataaaagctttctcttcatct

SEQ ID NO: 80892 - protein, 168 aa, Zea mays
  misc_feature: Ceres CLONE 1566266
  misc_feature (1)..(62): Pfam Name: ABA_WDS Pfam Description: ABA/WDS induced protein
MGALAAGAFALYERHEAKKDPEHAQRHKIEEGVAAVAALGSGGFAFHEHHDKKEAKDRVRDSRGRGGVRPPRRGEEEAPLLRLIGLLLDRSTCVRRLLPRTRRSMHGGRTNSIKESAGGLIVRLCISCVVTDDVCAWYFVRVFGDRCVGCVCLCMDIFLLCVFSLSTI

SEQ ID NO: 80893 - DNA, 911 bp, Zea mays
  misc_feature: Ceres CLONE 1566268
  misc_feature: Translation starting site: 220
  misc_feature (760)..(760): n is a, c, t, g, unknown, or other
  misc_feature (823)..(823): n is a, c, t, g, unknown, or other
  misc_feature (843)..(843): n is a, c, t, g, unknown, or other
  misc_feature (868)..(868): n is a, c, t, g, unknown, or other
ggagctcaccgcggtggcggccgctctagaactagtggatcccccgggctgcaggaattcgtctcacccctagaaaaaaggttgcggccgaaccagagccccgtcccaactccaccacctctcttctctacggcgcgagcaagggcggcgccggccgcggcgtcggcgggaaccgggcctcgctctcccagtctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatgggtggagtttctgctgctgtctccaagacagctgcagctccgattgagcgtgtcaagcttttgattcagaaccaggatgaaatgctcaagactggcaggctttctgaaccgtacaagggtattggggactgctttggccggacaatcagagatgagggttttgtctcactgtggagaggaacacagctaatgtcatccgttacttccccacacaggcattgaactttgcgttcaaggatcacttcaagcgcatgttcaactttaagaaaggacaagatgggtnactggaagtggtttgctgggaatctgggctctggtggagctgctggtgcttgctctctattcnttgtctatctctggactacncccgtacgcgttgggcaatgatgcnaggctgcaaagaaaggtgggtgagagcagttcaatggactcgt

SEQ ID NO: 80894 - DNA, 973 bp, Zea mays
  misc_feature: Ceres CLONE 1566270
  misc_feature: Encodes the peptide sequence at SEQ ID NO. 80895
  misc_feature (479)..(479): n is a, c, t, g, unknown, or other
  misc_feature (555)..(555): n is a, c, t, g, unknown, or other
tggagctcaccgcggtggcggccgctctagaactagtggatcccccgggctgcaggaattcgtctcacccctagaaaaaacaagcagcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaaagaaggaggtgctttcactggtgaagtcagtgctgagatgctcgtcaaaccttgggtgtccctggggtcattctttggacactnctgaaaggagagctctgctggggagaatcaaatgaatttggtgggagacaaggttttgcgtatgcccctgtctcangggaccaaaaggccattggcatgggtggggtgaaaacccttgaccaagaggggaggctggggcctaccaatggaaaggttgttggcggccccaaaacaaaagccaatggccgggaaaaaatcaagggacgggaccaacccttatttgttggccctattaacccaattttggggccatttgaaaaaccgggaaaaatttgcccccccctgttcaagggtcatgaaaatgtccccccccccccggggggtagggggtaaaaaacaaaggcccccccccccggggtgggggaaaacccccgaggaaccccctcgggggggccttttaacgcgggggaaatccgaaaaaaccccccccccccccccgggggcgaagagggtttctcctggggggggaactctttataaaccgagaattccct

SEQ ID NO: 80895 - protein, 97 aa, Zea mays
  misc_feature: Ceres CLONE 1566270
  misc_feature (5)..(98): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKEGGAFTGEVSAEMLVKPWVSLGSFFGH

SEQ ID NO: 80896 - DNA, 935 bp, Zea mays
  misc_feature: Ceres CLONE 1566272
  misc_feature: Encodes the peptide sequence at SEQ ID NO. 80897
  misc_feature (627)..(627): n is a, c, t, g, unknown, or other
ctggagctccccgcggtggcggccgctctagaactagtggatcccccgggctgcaggaattcgtctcacccctagaaaaactagaaaaagatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgcccccggagatcttcgggcagatgggcatcatccccccggagaccgcgctgccgtggttcaagacggcgtcatccccgccgcgggcacctaacattactgggccgactcctacaggctccncgtctttaaaagggcgctcatgggctttcgcgagcacccccgccctccaggactggtacaaccccgggctcattgggaaagcagaaactcccccgggccccaaaaagttccctggcgggctccgggaaaccgtccttaccccggggggccccctttttaaccccttgggttttggaaaaacccaaaaaggaataaaatggccccacgcccaaggaaaataaaaaaggggggggggcccatggttcccacaaccccgggttttctttccaggggggttctcccccggggggggccgcttttaaaaaaaa

SEQ ID NO: 80897 - protein, 139 aa, Zea mays
  misc_feature: Ceres CLONE 1566272
  misc_feature (55)..(132): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPGDLRADGHHPPGDRAAVVQDGVIPAAGT

SEQ ID NO: 80898 - DNA, 942 bp, Zea mays
  misc_feature: Ceres CLONE 1566275
  misc_feature: Encodes the peptide sequence at SEQ ID NO. 80899
  misc_feature (764)..(764): n is a, c, t, g, unknown, or other
ctggagctccccgcggtggcggccgctctagaactagtggatcccccgggctgcaggaattcgtctcacccctagaaaaactccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgcgctctgtgacgcccggaacgttcttgggagagcgcgagcgaggtcttgtctcttctcggtgcgggtcgctgtgccatgtgatgtgatgtgacgctggatcgttttgggtccgaccaacgggagaagagcggcctgtggtcgccngtcgccgccgtgtgtgggctggatggcctgctttcctgtgctcctcctatatatcagatgtactccctcccaagagcagggtttcgctaccttttcgtactcgctacagctacagctagtacgtactatactaaataaaagctgcagtttcttctaaaaaaaaaaaaaaccgagaccc

SEQ ID NO: 80899 - protein, 95 aa, Zea mays; identical to SEQ ID NO: 58232
  misc_feature: Ceres CLONE 1566275
  misc_feature (1)..(89): Pfam Name: LEA_3 Pfam Description: Late embryogenesis abundant protein

SEQ ID NO: 80900 - DNA, 928 bp, Zea mays
  misc_feature: Ceres CLONE 1566280
  misc_feature (239)..(239): n is a, c, t, g, unknown, or other
ctccccgcggtggcggccgctctagaactagtggatcccccgggctgcaggaattcgtctcacccctagaaaaaaatcgagcatcgcagagataggcgtcttcgtactcgcctacctccgcggctcaaacctttcccccttctcccaattccctccgtcggccgccgctccatcccgtacgtacgacaccatgagggagtgcatttcgatccacatcggccaggccggtatccaggtcnggaaacgcgtgctgggagctgtactgccttgagcatggcattcaggctgacggtcagatgcccggtgacaagacattggggaggtgagatgttccacactcttcatgaaaggtgctggaaagccggcccgtgctgtttccccgacctgaacccctgtcttcatgacgcaagaccggcacctaccccaggtttttcacccttaacagcctctccgtgggaaggaggaagccccccatcaactttggccccggggcaccaacacccattgggaaaggataattgtttaaccctatgccctttgttccccttttggggaaagtttgggcgaaaaaaagtgggctctgggtgccccccgaggggtttccccccgttttttttaaaaacaatttttgggggggagagaaaaagggggccttctggcctctttggttcccccccccccttaaaaaaccccgtgctttttttttacccccgggaaaaagaccccacaacgtggggggtgtcccagggggcacaccctccccccacaagttttttttctcgcggggggtgggggccccccaaaaattgtgttggtgcctcccccctcccccccccctagaacaaaagtggggggggtttccccggagaaaaaaggagcccctttaaaatatttgcgcccccacccctctttttggtgtgcccccctc

SEQ ID NO: 80901 - DNA, 935 bp, Zea mays
  misc_feature: Ceres CLONE 1566282
  misc_feature: Encodes the peptide sequence at SEQ ID NO. 80902
ggagctccccgcggtggcggccgctctagaactagtggatcccccgggctgcaggaattcgtctcacccctagaaaaaaccccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgctgccggcctcgctgcagcccgagtccccgggggtcttcttctccgccgccgccgccgccgcgcccctgggcaccgcccaccgccgcatcgccatcgccgtcgacctctccgacgagtccgcctacgccgtgcgctgggccgtcgccaactacctccgccccggggacgccgtcatcctgctccacgtgcgccccacctccgtgctctacggcgccgactggggcgccgtcgacgtctccctccccaaccctagcgccgccgcctccgaggacggcgacggcgactgcgagaccgccgccgccgcgcgccgggatgaggacgactacaacggcttcacggcacccaaggcgaccacttcgcccgccccgttcaaggacgccggcatcccctacaaaattcacattcgccggggaccacgactgaaaggaccgcctcgcctccagggcgagcgcctcttgctcagggcggtattcctggggagcaggggttccggcccccccccggaggacaccaaggggagggtccggaaagttaaaaaacttattgtgggcccaattggtttttccccccgtgtgggggggggcccttccccgaataacggctctctcccaagggggggggaggcccccctggtttttcccccccccgtttggggccctataaaattttcttaacccgcgtggcccgggaga

SEQ ID NO: 80902 - protein, 253 aa, Zea mays
  misc_feature: Ceres CLONE 1566282
MQAPPAPSSVDLPLAVAPPPVKAPTPRPPLPASLQPESPGVFFSAAAAAAPLGTAHRRIAIAVDLSDESAYAVRWAVANYLRPGDAVILLHVRPTSVLYGADWGAVDVSLPNPSAAASEDGDGDCETAAAARRDEDDYNGFTAPKATTSPAPFKDAGIPYKIHIRRGPRLKGPPRLQGERLLLRAVFLGSRGSGPPPEDTKGRVRKVKKLIVGPIGFSPRVGGGPSPNNGSLPRGGEAPLVFPPPVWGPIKFS

SEQ ID NO: 80903 - DNA, 876 bp, Zea mays
  misc_feature: Ceres CLONE 1566283
ctcaccgcggtggcggccgctctagaactagtggatcccccgggctgcaggaattcgtctcacccctagaaaaaattggacgtcatccatagaactcatatcgtattcccattttttgtcggcggagattcctctccatatctctcatcgctaaaagcgtggaaacgccactgagtctccgggggacaagcaaacctatcatctccttcttcccgtccttcctcatcccatccgatcaatacttttgggagcaaattctaaatcgctgcctaaattgtggccggttgaacggtgtttccaccccgtcccctcgttgcacaccgggaggaagacgactccgccgtcaactccatccgatcggcgtagggtcgctcgggtggctacaactttggtcccccctcccctttgggaggaacccggcgcgtggcatgctgcgggttcccccgcccgctggatcccagtcacccgtggcggcgtctcgctccgcgtgccctcgcgctgccagctccatggcgaccgccgcctatcttacctacctgcgcgcaggctgaacgcgtcctgcagtgctcgtcaaaagctctctctacatgttgtacgatcgcggtaaatttctgcctgactctggatggggcagatcattctcgtgataaatcagagcgaaggactagacggcacaatggaatacttcagaagggacagcaaatcatattacgggccttgaactgtgcaaattctatagcaaaactggaggtaatgtttttggaggaaaaaggccccggatcttggggcaagctcgggtttgcatctgccgcgaggtgccgccgtccaacaacaggtgattatcgtcaagaaaggcttcttttcccccgggggcct

SEQ ID NO: 80904 - DNA, 935 bp, Zea mays
  misc_feature: Ceres CLONE 1566286
  misc_feature: Encodes the peptide sequence at SEQ ID NO. 80905
  misc_feature (726)..(726): n is a, c, t, g, unknown, or other
ctccccgcggtggcggccgctctagaactagtggatcccccgggctgcaggaattcgtctcacccctagaaaaacaggcagtccaagcccggcggcaccgccgcggccgcgcccaccccaccgtggccatggccgtcctgcgcaaccaagccacagacggcgtccttccggcggcaaggcagcgacaacggccatgaccggccgtgcaccacggccgccagccgccgcttcgacgaagcagcagcagcagcagcaacaggcgttggcggacggctgcggccgccgcgcggggccgccgcgccgggcgacgagatgtacaagacggtcaactccgtctacttcgacgccgccgactcctgccgctccttcttcttcttcgacgacgacggcggcggcggggacgcggcggacgacgacgtcctcgacgacgacgggagcttctcaacgacgacggcgtcggaggagtggtccgaggccgtgatccgcagcctcggccggacctccaccggccgcttcttcttcgacgcgggcccggcggcgcccgtcgcggagtcgaccaactccatcctcgccgcctccaagtcatcgaagcctctctatgaggcgccccccagcaagctgccgcgggcggcgatgtctcctcccgcggcgggagtggtgctaaccgacgacgacggggtcagcgaggccgagacggagacagaggtgccgtcgacgtcgtcgtcnctggtggaggagagcgtggcggtggcgctggactcggaacgaccggttcgcgaactccgcgcgtccatgcacgagatgtgggcgcgcacggcctcgcaactgggggggcttcaggaaatgctgctctggtacctcccatcaacgggaagaaaacaacccgcttcttcgcggggccttcgttaaactcctcgtggcctggcccgaggaat

SEQ ID NO: 80905 - protein, 198 aa, Zea mays
  misc_feature: Ceres CLONE 1566286
MYKTVNSVYFDAADSCRSFFFFDDDGGGGDAADDDVLDDDGSFSTTTASEEWSEAVIRSLGRTSTGRFFFDAGPAAPVAESTNSILAASKSSKPLYEAPPSKLPRAAMSPPAAGVVLTDDDGVSEAETETEVPSTSSSLVEESVAVALDSERPVRELRASMHEMWARTASQLGGLQEMLLWYLPSTGRKQPASSRGLR

SEQ ID NO: 80906 - DNA, 902 bp, Zea mays
  misc_feature: Ceres CLONE 1566287
  misc_feature: Encodes the peptide sequence at SEQ ID NO. 80907
  misc_feature (713)..(713): n is a, c, t, g, unknown, or other
  misc_feature (806)..(806): n is a, c, t, g, unknown, or other
ctccccgcggtggcggccgctctagaactagtggatcccccgggctgcaggaattcgtctcacccctagaaaaagttcgctccacacgcgccaccaccagagacctcccgctggttacaccaatggaggccgtcctacggcatccatcgctctcgcgcaccaggcctccgaacctgaaccctcccacaacgccatctccatcccttcatgcaccatctcttctccgcctccgcgcgcgccggctcatcgccgctgcggtgttccaggaccagaagccgaaggagccagcaagcaagggaggtgatgacgaggaggaggcgtacggcgaggtggaccgcatcgtctccagccgcacagtcagcagcccggtgttcgcggaggacggctcggccaccgccgccgtcgccacggagttcctggtggagtggaaggacgggcacgagccgtcgtgggtgcccgcggaggccatagccgcggacgtggtggccgagtacgagacgccgtggtggacggcggccaagaaggcggactcggaggcgctggcggcgctgctcgcggacgagacgttgcggcgggaccccgacgcggaggacgcgcaggtgcgcaccgcggcgcacttcgccgcggggctggggtccgaggagtgcctgcgcgcgctcggcgcggctggagcgaacgtgggccgtctggagcgctcggggggctggctcacnccgctacacatggcggtcgggtacaggcgcccgggcgccgtgcgcgcgctgctggagctgggcgccgaaccggtaggctccgactggcatgtncgcacgccgctggaactgggtcaggaaggtgctcgcagggcggcccatggctaccccggcgacgtcccagctcggcaggggctggaggcggccaat

SEQ ID NO: 80907 - protein, 260 aa, Zea mays
  misc_feature: Ceres CLONE 1566287
  misc_feature: The sequence is a functional homolog of SEQ ID NO 1813 in the 10/374,780 US patent application
MEAVLRHPSLSRTRPPNLNPPTTPSPSLHAPSLLRLRARRLIAAAVFQDQKPKEPASKGGDDEEEAYGEVDRIVSSRTVSSPVFAEDGSATAAVATEFLVEWKDGHEPSWVPAEAIAADVVAEYETPWWTAAKKADSEALAALLADETLRRDPDAEDAQVRTAAHFAAGLGSEECLRALGAAGANVGRLERSGGWLTPLHMAVGYRRPGAVRALLELGAEPVGSDWHVRTPLELGQEGARRAAHGYPGDVPARQGLEAAN

SEQ ID NO: 80908 - DNA, 928 bp, Zea mays
  misc_feature: Ceres CLONE 1566296
  misc_feature: Encodes the peptide sequence at SEQ ID NO. 80909
  misc_feature (671)..(671): n is a, c, t, g, unknown, or other
  misc_feature (722)..(722): n is a, c, t, g, unknown, or other
ctggagctccccgcggtggcggccgctctagaactagtggatcccccgggctgcaggaattcgtctcacccctagaaaaacacccctcgttgtcatctcatatcctgagccagagatcaaagaaaccagagggagcgaggcatggcagcaggcttgcaggtgtttggccagccggcgtctactgatgtctccagggttctgacatgcctgtttgagaagaaactggagttcgatcttgtccgcatcgatacgttcaagacgcatcacaagcttcccgagttcatcaggcttcgggatcctaatgggcaagtgaccttgaagcacggcgacaaaactctcgttgatttgagggacatctgccggtacgtctgcacccagtttccaaacgatggaaacaagagcctttacggatccggcgctctagaacgggcgtcgatagaacagtggcttcaggcggaggctcagaacttcgggccccccagctccgcgctcgtcttccagctggcgttcgtccctcacctcactcacctgggcgttcgtcaggaccctgccgtgatcgccgagaacgaggataagctgaagcaggtccttgatgtctacgacgagatactctcgaggaacgagtacctggctggcgacgagttcaccctggccgaactctcccacctccngaactcgcactacatcgtgaacaccgagagaggaaggaagctcttcactancaagaagaacgtggcccagtggtacgagaagctctcgaagcgcgagacgtggaagcaggtcgctaagatgcagaaggaacatcctggtgcgtccgagtgattgctttgtcttggggggagctgcagtgcaccatcatgaatggcttcatcgtctgggtcggcctggctctacagtcaatttggttttgaaggatccttgggtaatt

SEQ ID NO: 80909 - protein, 226 aa, Zea mays
  misc_feature: Ceres CLONE 1566296
  misc_feature (110)..(209): Pfam Name: GST_C Pfam Description: Glutathione S-transferase, C-terminal domain
  misc_feature (3)..(78): Pfam Name: GST_N Pfam Description: Glutathione S-transferase, N-terminal domain
  misc_feature: SWISSPROT Homolog: EC 2.5.1.18 Glutathione transferase
  misc_feature (177)..(177): Xaa is any aa, unknown, or other
  misc_feature (194)..(194): Xaa is any aa, unknown, or other
MAAGLQVFGQPASTDVSRVLTCLFEKKLEFDLVRIDTFKTHHKLPEFIRLRDPNGQVTLKHGDKTLVDLRDICRYVCTQFPNDGNKSLYGSGALERASIEQWLQAEAQNFGPPSSALVFQLAFVPHLTHLGVRQDPAVIAENEDKLKQVLDVYDEILSRNEYLAGDEFTLAELSHLXNSHYIVNTERGRKLFTXKKNVAQWYEKLSKRETWKQVAKMQKEHPGASE

SEQ ID NO: 80910 - DNA, 921 bp, Zea mays
  misc_feature: Ceres CLONE 1566298
  misc_feature: Encodes the peptide sequence at SEQ ID NO. 80911
aaagctggagctccccgcggtggcggccgctctagaactagtggatcccccgggctgcaggaattcgtctcacccctagaaaaagatcgtagaagcaggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacagcgactccctggtgttccacttctcgggcatcggcgcgcaggtggcggacgacgaccgcgaccaggcggacaggtaccaccaggccatctgcccgctggacgcgttccaaaacgggcccatcctggacgaacaagatcaccaaggcatccggggcccccttggggcacggcccaaggttgcaccccggggtgaacccctgcttacagcccccgggcctggaactcccctaccaggtcccaatgtcaagaacaggttttgccccgggaaggcaaaagaccccccccagggccccgttaagggacacgcgaaggacaccccggattct

SEQ ID NO: 80911 - protein, 250 aa, Zea mays
  misc_feature: Ceres CLONE 1566298
  misc_feature (65)..(224): Pfam Name: Peptidase_C14 Pfam Description: Caspase domain
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYSDSLVFHFSGIGAQVADDDRDQADRYHQAICPLDAFQNGPILDEQDHQGIRGPLGARPKVAPRGEPLLTAPGPGTPLPGPNVKNRFCPGKAKDPPQGPVKGHAKDTPDS

SEQ ID NO: 80912 - DNA, 905 bp, Zea mays
  misc_feature: Ceres CLONE 1566300
  misc_feature: Translation starting site: 121
ctggagctcaccgcggtggcggccgctctagaactagtggatcccccgggctgcaggaattcgtctcacccctagaaaaaggacgaagcagcgcagcagcagagagccagagaccagagtatggccgccctcgccgccgcctccacggacgccttcgccgcagaaggcacacgcgcgcctctccgtggcctgctctcgccgccaccggcgacagcagcagcgtgtcactgcgcgtcctccgtgaagacgttctccgccgcgctggcgctgtcgactgtgctgctgtcctcgggcgccacctcccctccgcccgcggccgccgacatcgcggggctgaccccgtgcaaggagtccaaggcgtacgcgaagcgcgacaagaactcgatcaagaagctcaccgcgtcgctgaagaagtacgcgcccgacagcacccccgcgctcgccatcaacgccaccatctagaagaccaagcgccggttagagaactacgggaagttcgggctgctgtgcggcgcccaccgcctgccgcacctcatagtcagcggcgaccagcggcactggggcgagttcataaccccgggactgctcttcctctaaacgccggctggatccggtgggtcggcatgagctacctcatagccatcagcggcgagaagaagcccgccatgagggagatcatcatcgacgtagagctcgccaaccgactcctccccagggggttcatctgggccgtcgacgccatacacgagctcatccacatgggacctcatcgtcgaacgactgggacatcgggccacaaactagctgcggcttgttcacccgccatgcactgtgcataaataaatgcctgccccctagcatggcgcccctggaatatcagcgtggggaaacatgggaagggctga

SEQ ID NO: 80913 - DNA, 828 bp, Zea mays
  misc_feature: Ceres CLONE 1566302
  misc_feature: Encodes the peptide sequence at SEQ ID NO. 80914
  misc_feature (787)..(787): n is a, c, t, g, unknown, or other
ccccgcggtggcggccgctctagaactagtggatcccccgggctgcaggaattcgtctcacccctaaaaaaaacgccacagaaaaaacgcaggtgtcgaaacacattttcttgctccagagaatttaaaccgctgcgaattcaattcgaaagccccaagagagcatccatggcttccgctaccacctccatctcgtcgcaccccgccgccctccgcgacgtcaaagctgcgaggattggcgggctgaggcagcagcaggcgagcgtggccccgtcggcggcggcagcgcgtggccagcgcgctcgggcggtgcgatcgctgcgcgcggcggagcctgcgaggcagccggtggcggcttccgcggccgcggcggcgccggccgcgcccgtggccgaccaggcggcggcccttgcggccgtggactacgaggccctggcgcgtgagctggagggcgcgtcgccgctggagatcatggatcgggcgctggccatgttcggctccgaaatcgccatcgccttcagcggcgcggaggacgtggcgctgatcgagtacgccaagctgacggggcgtccgttccgggtgttcagcctggacacggggcgtctgaacccggagacgtaccagctattcgacaaggtggagaagcactacggcatccgcatcgagtacatgttcccggacgcgagcgaggtgcaggagctggtgcgcaccaagggcctcttctccttctacgaggacggccaccaggagtgctgccgggtgcgcaaggtgcggcccctgcgcaggncgctcaaggggctcagggcgtggatcaccggccagaagaaa

SEQ ID NO: 80914 - protein, 220 aa, Zea mays
  misc_feature: Ceres CLONE 1566302
  misc_feature (112)..(220): Pfam Name: PAPS_reduct Pfam Description: Phosphoadenosine phosphosulfate reductase family
  misc_feature: SWISSPROT Homolog: EC 1.8.4.9 Adenylyl-sulfate reductase (glutathione)
  misc_feature (207)..(207): Xaa is any aa, unknown, or other
MASATTSISSHPAALRDVKAARIGGLRQQQASVAPSAAAARGQRARAVRSLRAAEPARQPVAASAAAAAPAAPVADQAAALAAVDYEALARELEGASPLEIMDRALAMFGSEIAIAFSGAEDVALIEYAKLTGRPFRVFSLDTGRLNPETYQLFDKVEKHYGIRIEYMFPDASEVQELVRTKGLFSFYEDGHQECCRVRKVRPLRRXLKGLRAWITGQKK

SEQ ID NO: 80915 - DNA, 861 bp, Zea mays
  misc_feature: Ceres CLONE 1566303
  misc_feature: Encodes the peptide sequence at SEQ ID NO. 80916
ctccccgcggtggcggccgctctagaactagtggatcccccgggctgcaggaattcgtctcacccctagaaaaaactcaccttcacaaacattgcaaaagcactcctctcttcgtcctccccctccctcctccatcccattccataccattccgccaaagaagaaccacagacgctcgctcccaactcccaagccaagccggatcccaaaatcggcacagcgcacccactccgctcagtcccttcgttcacccccatccatccagccagccagccagccatgggcggcaaggactgcggcaaccacggcgaggacgacctgcggcggtcgtgccggcgcctgctagcgatcctcctagtcctggccctgatcgtgggcgtgatcgcgctgatcatctacctggtggtccgccccacgcacccgcgcttctacctgcaggacgcgtcgctgcagcagctagacctctccaacgccaccaccaccaccaccacctccgcgtcctcgtccctcctctccacgacgctgcaggtgacgctggcctcgcgcaacccgaacgagcgcgtgggggtgtactacgaccggctggacgtgtacgcgtcgtacaagtaccagcaggtgacggtggccgcggcgctgccgcccgtgtaccagggccacggcgacgtggacgtgtggtcgcccgtgctctccgggccccggggtcccctttgcggccctaccttggcaaagcgcttcggcaggaatggcaggggggggtacctccgtcctccaggtcaagggcccaacggcccctggcaatgaaagggccggaacctgggatatccgggccactaaccaccttcttcggtaaacctggccccg

SEQ ID NO: 80916 - protein, 173 aa, Zea mays
  misc_feature: Ceres CLONE 1566303
  misc_feature (40)..(163): Pfam Name: Hin1 Pfam Description: Harpin-induced protein 1 (Hin1)
MGGKDCGNHGEDDLRRSCRRLLAILLVLALIVGVIALIIYLVVRPTHPRFYLQDASLQQLDLSNATTTTTTSASSSLLSTTLQVTLASRNPNERVGVYYDRLDVYASYKYQQVTVAAALPPVYQGHGDVDVWSPVLSGPRGPLCGPTLAKRFGRNGRGGYLRPPGQGPNGPWQ

SEQ ID NO: 80917 - DNA, 951 bp, Zea mays
  misc_feature: Ceres CLONE 1566304
  misc_feature: Encodes the peptide sequence at SEQ ID NO. 80918
  misc_feature (503)..(503): n is a, c, t, g, unknown, or other
  misc_feature (684)..(684): n is a, c, t, g, unknown, or other
ggagctccccgcggtggcggccgctctagaactagtggatcccccgggctgcaggaattcgtctcacccctagaaaaagtcgaacacagagtcacttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcatcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgccgcgacttcctcaanggcggcaaggcggccaagggcgccggcatggcggactgcagctacaccatcatgcacctggacctgggcctcctcgacagcgtgcggcagttcgtggacagcttccggcgcgccggcaggccgctcgactcgctcgtctgcacgccggcatctaccggcccagggaaagaaccccaacttncacgcgggacggatacaaaagaacgtcgggttcaacaacctggggcatttccccctgggggcccggccccgggaaaaatggaaaatccaaatacccgtcccccccctttttatcttgggtccataccgggaaaacaaaagcggggcggggaaaccccccccaggggggggggggaaacccccggccccccgggggggggcgccgggcaaaaaaggttctctcaattaaagagccccaaaaatctccagggcccccaagggtaaaaaa

SEQ ID NO: 80918 - protein, 257 aa, Zea mays
  misc_feature: Ceres CLONE 1566304
  misc_feature: SWISSPROT Homolog: EC 1.3.1.33 Protochlorophyllide reductase
  misc_feature (110)..(110): Xaa is any aa, unknown, or other
  misc_feature (171)..(171): Xaa is any aa, unknown, or other
MALQAALLPSTLSSVPKKCSIAVAAKDTAFLSVSQKKVQAASLSVRTRVATTAPVATPGSSTAAKDGKKTVRQGVVVITGASSGLGLAAAKALAETGKWHVVMACRDFLXGGKAAKGAGMADCSYTIMHLDLGLLDSVRQFVDSFRRAGRPLDSLVCTPASTGPGKEPQLXRGTDTKERRVQQPGAFPPGGPAPGKMENPNTRPPPFYLGSIPGKQKRGGETPPRGGGETPGPPGGGAGQKRFSQLKSPKNLQGPQG

SEQ ID NO: 80919 - DNA, 974 bp, Zea mays
  misc_feature: Ceres CLONE 1566305
  misc_feature: Encodes the peptide sequence at SEQ ID NO. 80920
  misc_feature (894)..(894): n is a, c, t, g, unknown, or other
ccccgcggtggcggccgctctagaactagtggatcccccgggctgcatgaattcgtctcacccctagaaaaaattcctgaccagcgccatagcagagagggagagatagaactcaccaggggagaggggtggtgaagggaatgcgcatggaggcgcactcgacccgtctggcgctctggtatcctctccccccggcagggaacgcatagaatgaaggagagtccctatgaggaggaggggagaatgcatgtccgtcgcgggcgggaccacgacgaccatgtgtcccggaagctcaagagcatcgacgtgaacaagctcgacaacggccgcaggtaggacatcccgctgaccctcgtcaagtaccacgtctggaagggcatgctgttcctccaccaccaaccagacgttccagcaactcgcggaccgctacatatgtccggcaaacctgctggttgtaccttgccccaggcggttccagcttctgtagcgggggataccgcggacgactgctcatccgggcttccattggaacttacactttgacgggcccattttgtccggccccctttccctctaccgtaagccctgatttttgggcgcggataacctccccccctttgggagatttggtccctccttcgcccctcccttcccatcgggcaggggttacccctctttgaaaatttaaactagccccgtccgcggaatcattgtgggtgcccccccccccgcaaaattgcaacccgttatggcgcgatcaacctctgatttataaaaggggcagggtgtcgttaaggagttatagctcggcggggagcctctttccgtggagctctcatcctcccttgtccttagaggtgtcttagtgtcccttgtatggggataaggcggcgngccttttctcgaaagggatataccgttgtaaggacttgctccgacagtgttattcatgcctccctacacgttgtgtatgt

SEQ ID NO: 80920 - protein, 41 aa, Zea mays
  misc_feature: Ceres CLONE 1566305
MKESPYEEEGRMHVRRGRDHDDHVSRKLKSIDVNKLDNGRR

SEQ ID NO: 80921 - DNA, 842 bp, Zea mays
  misc_feature: Ceres CLONE 1566309
  misc_feature: Encodes the peptide sequence at SEQ ID NO. 80922
  misc_feature (692)..(692): n is a, c, t, g, unknown, or other
  misc_feature (751)..(751): n is a, c, t, g, unknown, or other
ctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcaacttccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctgaataaaacacaaccaccaactcgcgatccatcgatttgcagaacaccacccaacagccaaaccatcactcgatcggtagacatggataaggcctacatcgncgccctctccgccggcgccctcttcttgctccactacctccctggccggcgggcccgcngcaagggcaaagccaaagccaagggctcgcggcggcggctcccgccgagccctccggcgatcccgttcctgggccacttcacctcgtcagg

SEQ ID NO: 80922 - protein, 93 aa, Zea mays
  misc_feature: Ceres CLONE 1566309
MAYYQEVDYCSEEVRSVAPAGFGRHGGGVQQHVVKEKFEEVDTVSRAGANHHHHHGHHGGHGFVVRETRVEEDINTCTGNFHERRESFLARAN

SEQ ID NO: 80923 - DNA, 920 bp, Zea mays
  misc_feature: Ceres CLONE 1566310
  misc_feature: Encodes the peptide sequence at SEQ ID NO. 80924
  misc_feature (729)..(729): n is a, c, t, g, unknown, or other
  misc_feature (730)..(730): n is a, c, t, g, unknown, or other
  misc_feature (775)..(775): n is a, c, t, g, unknown, or other
  misc_feature (897)..(897): n is a, c, t, g, unknown, or other
  misc_feature (905)..(905): n is a, c, t, g, unknown, or other
  misc_feature (907)..(907): n is a, c, t, g, unknown, or other
  misc_feature (913)..(913): n is a, c, t, g, unknown, or other
  misc_feature (918)..(918): n is a, c, t, g, unknown, or other
ctggagctccccgcggtggcggccgctctagaactagtggatcccccgggctgcaggaattcgtctcacccctagaaaaatttggctactccgcctccgctctcccccctgctgcgcgctactcgccagatctcgcggtgctggtagcggtgaaaatatctgagatcgagcgaagctagctttttttcatcgatatggcgcttgtactgcatgctggcagtagtaacaaaaatgcattcaaaacactaatcgccgcggattacagcggcatcaaggttgagttggtaaaagactttcaaatgggggtttccaacaaaacaccagagttcctcaagatgaaccctattgggaaggttcctgtcctggagacacctgatggtcctgtctttgagagcaatgcaatagcaagatatgttactcgcttgaaggctaacaacccactttacggatcttcactgattgattatgcccatattgagcagtggatggactttgctgcgacagaggttgatgccagcattggaaagtggttgtacccacgtatggggttttatccctatgctgctgtgacagaagaatcagccattgctgctttgaaaagagcattcggttccctgaacacccatcttgcatcaaacacattccttgttgggcattcagtgacacttgcggatattgtgctgacatgcaatctttatatgggctttagccgtatcttgactaagagtnntacctcagagttccctcaatattgagagtacttctgggacatggntaaccagccaaacttcaaaaggtcattggtgacgtgaagcaggcagaagctgtgccacttgttgcaaagaagattgctccgcccaagagcagaagccctaagtagccaaaaaggtagcccgntagcctangnagctgnataancc

SEQ ID NO: 80924 - protein, 186 aa, Zea mays
  misc_feature: Ceres CLONE 1566310
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (179)..(179): Xaa is any aa, unknown, or other
MALVLHAGSSNKNAFKTLIAADYSGIKVELVKDFQMGVSNKTPEFLKMNPIGKVPVLETPDGPVFESNAIARYVTRLKANNPLYGSSLIDYAHIEQWMDFAATEVDASIGKWLYPRMGFYPYAAVTEESAIAALKRAFGSLNTHLASNTFLVGHSVTLADIVLTCNLYMGFSRILTKSXTSEFPQY

SEQ ID NO: 80925 - DNA, 892 bp, Zea mays
  misc_feature: Ceres CLONE 1566312
  misc_feature: Encodes the peptide sequence at SEQ ID NO. 80926
  misc_feature (804)..(804): n is a, c, t, g, unknown, or other
  misc_feature (831)..(831): n is a, c, t, g, unknown, or other
  misc_feature (866)..(866): n is a, c, t, g, unknown, or other
ctggagctccccgcggtggcggccgctctagaactagtggatcccccgggctgcaggaattcgtctcacccctagaaaaaagagcacgagacacccaagaaacacacagaagcgaggagcactacttgttggttggattctcttcagtctagcagctagtccagttaagtttcagacacatggggagcattggcagaggcacggccaactgcgccaccgtgccgcagccgccgccgtcgacagggaagctcatcacgatcctgagcatcgatggcggcggcatccgcggccttatcccggcgaccatcattgcgtacctcgaggccaagctccaggagctggacggcccggacgctcggatcgccgactacttcgatgtgattgccgggacgagcaccggcgccctgctcgcgtcgatgctggcggcgccggacgagaacaaccggccgctgttcgccgccaaggacctcaccacgttctacctcgagaacggcccaaagatcttcccacagaaaaaggctgggttgctgacgccgctgaggaacctgctgggcctggtgcggggccccaagtacgacggcgtgttcctgcacgacaagatcaagagcctgacgcacgacgtcagggtggcggacacggtgaccaacgtcatcgtgccggcgttcgacgtcaagtccctgcagcccatcatcttctcgacgtacgaggccaagaccgacaccctcaagaacgcgcacctctccgaatctgcatcagcacgtcgggcggcgcccacctacttcccggcgcacttctttcagacgnatggcaccgacggccggccccccccgnagtaccacctcgttgtaacggcggcgtcgcggccnaacaacccaacatgggtcgtcatgtc

SEQ ID NO: 80926 - protein, 237 aa, Zea mays
  misc_feature: Ceres CLONE 1566312
  misc_feature (28)..(237): Pfam Name: Patatin Pfam Description: Patatin-like phospholipase
  misc_feature: SWISSPROT Homolog: EC 3.1.1.5 Lysophospholipase
  misc_feature (209)..(209): Xaa is any aa, unknown, or other
  misc_feature (218)..(218): Xaa is any aa, unknown, or other
MGSIGRGTANCATVPQPPPSTGKLITILSIDGGGIRGLIPATIIAYLEAKLQELDGPDARIADYFDVIAGTSTGALLASMLAAPDENNRPLFAAKDLTTFYLENGPKIFPQKKAGLLTPLRNLLGLVRGPKYDGVFLHDKIKSLTHDVRVADTVTNVIVPAFDVKSLQPIIFSTYEAKTDTLKNAHLSESASARRAAPTYFPAHFFQTXGTDGRPPPXYHLVVTAASRPNNPTWVVM

SEQ ID NO: 80927 - DNA, 966 bp, Zea mays
  misc_feature: Ceres CLONE 1566313
  misc_feature (775)..(775): n is a, c, t, g, unknown, or other
ctggagctccccgcggtggcggccgctctagaactagtggatcccccgggctgcaggaattcgtctcacccctagaaaaatttggcattgtgcacctgcaaattggaatgaagtgtgctggaaacagcaccagaacatgttcccaagccgtgctgacgcttgtgagcatttgaagacagagatctgatgatcatgcagcatattgcttttttataattaaggtccaatgacctgtctttgttatcgtatataaacataatactgcatacattcttcttcatgaaggggacaggtttggtacaatgacgagagctgtctcaggttcaaaggctctgccttggtttatatcttcttcagcaccgggtctgcccttcctgtatatgccaaataaattgttttttagctggatattatttcatttccacctcaatcccctccaatctccaaaaaaggttgtcatgtccagttagccgctggtgctctcagtgagacaggacaggaaccttcatgcatccgacgatggcgttgcaaattcttctctagctgtttcatgccacatatgtcacactgggcatgttgatggtaggattgattatgcatcttgaggcattcatgtttgaaaagaacttaatgcagccaggttcacagcagacgacggccatacgctgacacgatgaagtcattagatgctgcggacaccgattaaagctcattgagctcacgcaatcagttgtgggcgatgctgttgacgtggctcgtgccgctgccgtgctgncttcgaggcgtgtgcatggccatttacgtggagaaggagcccagtgcgcggtgcagtacgtcgccattgctgtcgagaaggtcgagctgtgaagacctcacaccctgggacaatgtgatttccagtacatgttagcatccagaatctttgtgatacacttttcagaatgaggaggcatctacctgctactt

SEQ ID NO: 80928 - DNA, 976 bp, Zea mays
  misc_feature: Ceres CLONE 1566314
  misc_feature: Translation starting site: 155
ggagctccccgcggtggcggccgctctagaactagtggatcccccgggctgcaggaattcgtctcacccctagaaaaacccgcagagccgccgacaacgctctctaccgtccgagaccccaagcaccagcgcggcggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttgggggcatgaatttttaccactgataaactcagatccctagtgaagaagtggcagacattaatcgaagcccatgttgatgtcaagacaaccgacactacatgttgcgtttgttctgcatcggcttcccaagaggcgcccaaacaaatcaagaaaaactggcttgctcaaggatcccaatatcctcaaatccccccgaaaaaggttgaaaatttgaatcaaccgggcttctcatggggacccgaaaaaaattgtttccaaattccttcccaaaatttttgggaaaggaatttgaaaaatttcccccccggtttttccccctttaaaaaagctttctcccccggggggaaaatttccggggcccccacagtttttttgggaaacacccggggggtcctgggcccaccaaaaaaaaatttggtggtaaaaattaaaaacccccccagaaaaaaaaaaagggggcggagggtgtcctccccccaaatatttttttccttcctttttataggaaaagagggaaaga

SEQ ID NO: 80929 - DNA, 659 bp, Zea mays
  misc_feature: Ceres CLONE 1566315
  misc_feature: SWISSPROT Homolog: EC 4.99.1.1 Ferrochelatase
gagctccccgcggtggcggccgctctagaactagtggatcccccgggctgcaggaattcgtctcacccctagaaaaacttcacctgcgttccccgggtcccgacaaggccgctggtaccagtcccggcccgcctgcgcacttctcccacccccgcgccgccttcggcgccggcgagccctcccgacgctcctcgagcgatccgtccctctcgcggcccttctctcagccgcttccagcccaaggggaggagagggagaggatgtggtctgtcgagccaggtcgagcacgagggggcgtcgatggaagatggggggaggggtggagggccgggccgtcgcatttccctaagagacccgcgccttagaactccgccagggtcaatcttgtcaggacacacacagtttaaccctaccccccctggcaaaccgttcaggaattttctgttaaatgcaaccttggggggggggtttttcaaacccctttgcctggacttggggggcttccctttttgggggggaaacttcttttcggctttttaaagggggggttcctttaccttccccccaaacccggaaggggggaaaaaaaaaaacctgttttttgtgttggggcccaagtggaaaaaaaaaaatgcgggggggggtgttctcctctttga

SEQ ID NO: 80930 - DNA, 785 bp, Zea mays
  misc_feature: Ceres CLONE 1566317
  misc_feature (271)..(271): n is a, c, t, g, unknown, or other
  misc_feature (279)..(279): n is a, c, t, g, unknown, or other
  misc_feature (331)..(331): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (703)..(703): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (744)..(744): n is a, c, t, g, unknown, or other
  misc_feature (746)..(746): n is a, c, t, g, unknown, or other
  misc_feature (748)..(748): n is a, c, t, g, unknown, or other
  misc_feature (749)..(749): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
ggagctccccgcggtggcggccgctctagaactagtggatcccccgggctgcaggaattcgtctcacccctagaaaaaaaaaaactgactgattgtctgattgtgattgcggcagcaccgccgaccacgagcccgccgaaaggctcctccgcctgccgttccagggtgcagtgccgccattgctcatctccccgtggtgcggaggtccacccgggcgccaattggtctcctctttcgttggcagactgagtggcatccaatcctgaatcanaatttggnaaaggggggggcttgggggtttgctcgtgttatcgctacatgttctttcatngcctggttagtggcgttgcttctggtcgaaacaaagctcttatgtggcgcacaagaggttccccatcctaccaaaatatacccttcttagaaaaagggaaaaggggtttgcccttttccaaaaggggaaacaattggctccccacaaccgggggttcttatttcccctcccgggggggtttttttttgggggaagaaaggcggttttataggaaaatcctgggggggtacccccccccaaaaaaaaaaaacctgggggggcccccaggggggagaaaagatttttttttttttttgggcgggggggggaaaaaaaaccctttttttttttttccccccccaaaaaaaaaaaggcnnnnggggggaggggggngaccacaaccccccccccccccccccccnnnnnnnannncncncnncggtnnntgttttttttttttttttataaataaaaa

SEQ ID NO: 80931 - DNA, 909 bp, Zea mays
  misc_feature: Ceres CLONE 1566323
  misc_feature: Encodes the peptide sequence at SEQ ID NO. 80932
  misc_feature (239)..(239): n is a, c, t, g, unknown, or other
  misc_feature (257)..(257): n is a, c, t, g, unknown, or other
ctccccgcggtggcggccgctctagaactagtggatcccccgggctgcaggaattcgtctcacccctagaaaaaatcaccaagccgaaccacagagctcccccacacccacagcggggtgaagcgaatcgcatcaaattcgaccgaagaatcgcgccgctcggcccggccaccatgagcttctcgtccatgagcaagcagcaggtgctggacgccggtgacggggagggggaggaggtnatggagttcattgggggnctgccggaggaggtggccgataagtgcctcctccacatgtccttcctctaccacggcctcttccgcaccgtctcctccacctggaacctcttcctcacggacgccctggtcaagccactgttgtttcatgacgccccctctttcgagaccgaggacacggggtcggtggggcttgctcttcgcccacgactttgaccccatgttgcggggcctctcgggccatgtagttcaacctggttactcgaggaagtggatacctgctcccgccggtaaccttggaggggcccagcccagcgtcgttcacttgaagggggggctgcccccgaacaaggcgtagaactaacctgggttggcgtgcgtccaagaaggcccggtgacagggagagttacttaaacttgtttgtggttaaaaaggccttcccggtaacgatttatgatggaggttgtttgaataggggagatcccccgggagaaacctggatagcctgggggtatttttacatgggaacgtggggaaaatcggagagaacaaaaggggggacccatttggggtggtttccttttgaggggcccctctgggcgcatggtgtgtgtttttcttattaaaagtcaagccatgggttttagtaagagttcccttcatagagtaaat

SEQ ID NO: 80932 - protein, 92 aa, Zea mays
  misc_feature: Ceres CLONE 1566323
MSFSSMSKQQVLDAGDGEGEEVMEFIGGLPEEVADKCLLHMSFLYHGLFRTVSSTWNLFLTDALVKPLLFHDAPSFETEDTGSVGLALRPRL

SEQ ID NO: 80933 - DNA, 967 bp, Zea mays
  misc_feature: Ceres CLONE 1566324
  misc_feature: Encodes the peptide sequence at SEQ ID NO. 80934
  misc_feature (708)..(708): n is a, c, t, g, unknown, or other
ctccccgcggtggcggccgctctagaactagtggatcccccgggctgcaggaattcgtctcacccctagaaaaaatcactaccaccgctctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgccccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatggagaagatctggcatcacaccttctacaacgagctccgtgtggctcccgaggaacaccccgtcctcctcactgaggcgcccctgaacccaaaggctaaccgtgagaagatgacccagatcatgttcgagaccttcaacacccccgctatgtacgtcgccatccaggccgtcctgtctctgtatgccagtggtcgtaccacaggtatcgtgctcgactcgggagatggtgtcagccacactgtccccatctacgagggatacgccctcccccacgcatcttncgtctcgacctggctgggcgcgacctcaccactacctcatgaagatcctgactgaacgcggctactcctttcacaccactgctgaacgggaaattgtcagggacatgaaggatgagctcgcctacattgccctggactacgaccggtagatggagactggcaatgacagctcttctgttgagaagaactaccagctgcctgaacgaaagtcatcaacattgttgctgagcgctcccgctgcccgtaggtctcttcatgc

SEQ ID NO: 80934 - protein, 195 aa, Zea mays
  misc_feature: Ceres CLONE 1566324
  misc_feature (4)..(195): Pfam Name: Actin Pfam Description: Actin
  misc_feature: SWISSPROT Homolog: EC 2.7.10.2 Non-specific protein-tyrosine kinase
  misc_feature (178)..(178): Xaa is any aa, unknown, or other
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHASXVSTWLGATSPLPHEDPD

SEQ ID NO: 80935 - DNA, 1333 bp, Zea mays
  misc_feature: Ceres CLONE 1566326
  misc_feature: Encodes the peptide sequence at SEQ ID NO. 80936
  misc_feature (324)..(324): n is a, c, t, g, unknown, or other
  misc_feature (917)..(917): n is a, c, t, g, unknown, or other
  misc_feature (919)..(919): n is a, c, t, g, unknown, or other
ctctgatttaatttttttaatacccccccccactgtctttatgattcgtgtagttatatggtggtgaaagctggagctccccgcggtggcggccgctctagaacagtggatcccccgggctgcttgaattcgtctcacccctagaaaaatcactaccacagctctctcttcctctcctccatctctcaacgcctgaagctcaccgcacctcccctcctcgccgcggatcccccactactccggtagaaaatggctgacgctgaggatatccagcccctcgtctgctacaacggaactggcatgttcaatgtttgggtttccggntacgacaccccaaaggccatcttccccagcatcgttgggcgcccgctcctcaccggcgtgatggtggggattgggcaaaaagaatcctacttctgcaaccacgcgcttccttaaagggttttctgcacctcaagttccccccccccccccccaaccccatccaactgggacgacagggaaaaaaaaccagacatcaatcctttcaaaaacaagcccccgcggtggttgcctcgaaggaatataccccgtatcctccgcattcgagggttccccctgaaacccccgcagggccaccccgcgtgaaacagaacacccccatataaagatggatccgaaaagcgatcgaaacagacccccccataaagtgtcacatttcgtatcatcacccaagtcacagcctcctagtcccctctgcactaattccccccctgttcttcttataccctctcccaatgatttattgtgggcatgctgcatactctcccgaagaattatactttctgatatcgcgatccctacaacctggcggtaacccactcgtccttcccgctgagagggagggatatattgcgctagcccctccccgctctctncnctttcaggtcgctatatgacctatcttccttctctcttccctttatcactctctatttatacgcatagagcgcgcgcccgatatatccatctcaatacacaacacgatcgaccttcgctgtagagaggagggaacgctcccttactatcaccgaactacaagagagggagatcatctcctctacacgtatccgcaccaccatatctgatattattttatgagcaaactacaacaattgtataccgcatcgatatattctcgcgacagacacgaaatacccctcgcgttcgcactgatagcacccgtccgcactgactatctagacacgcacgaatacataagatgcagtcgcgccgtaatatcacacgacccggcactgcgctctactgttaaagatactcaccaccctctttt

SEQ ID NO: 80936 - protein, 62 aa, Zea mays
  misc_feature: Ceres CLONE 1566326
  misc_feature: SWISSPROT Homolog: EC 2.7.10.2 Non-specific protein-tyrosine kinase
MADAEDIQPLVCYNGTGMFNVWVSGYDTPKAIFPSIVGRPLLTGVMVGIGQKESYFCNHALP

SEQ ID NO: 80937 - DNA, 945 bp, Zea mays
  misc_feature: Ceres CLONE 1566329
  misc_feature: Encodes the peptide sequence at SEQ ID NO. 80938
  misc_feature (789)..(789): n is a, c, t, g, unknown, or other
ctggagctccccgcggtggcggccgctctagaactagtggatcccccgaggctgcaggaattcgtctcacccctagaaaaaaaaaaaaaaaaaaaaaaaaaaaaaaaaaaaaaaaaaaggctggtgaggtgtggagcctcagcacgacgggtattgcgcccacacgcgacgccaaacgaaacagctagccagcccccattcttctccggctccggtgcattccgtgtcctgtcctgtcctgtcctgatggaagcagcaatggctgccacgtcctccctactccttgcctccggctccaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaccgccgtctcgtcgtcgtcgtcatcggaaagatgggttctcgaccctgcaggagacggtgactggcgccacatcggctacaaagtcgcgcgccctggggcgatcgagatagtctcggaggacacggcggtgaccgtgggccgggtcgccgacaaggcggacatcgtgctccccgtcgccacagtttcaggcgctcacgcccggctgggagagaggggcggcagcctgctggtgacggacctggacagcaccaacggcacctacatcaacgagcgccggctcaaaccgggcttccccgcgtccgtcgaccccggaggctactcatcttcggtgacatccacttggccatgntccgtgtaaggaaaacggtggtggtggaggcccccatacttgtaccgagaaggccagggactcagcagagacaccgcagctgaagaaattgacaactgtggctttatacagtaacgtacccattttacaaatacaggggaccggatccatcactcc

SEQ ID NO: 80938 - protein, 183 aa, Zea mays
  misc_feature: Ceres CLONE 1566329
  misc_feature (108)..(163): Pfam Name: FHA Pfam Description: FHA domain
  misc_feature: SWISSPROT Homolog: EC 1.14.13.90 Zeaxanthin epoxidase
  misc_feature (181)..(181): Xaa is any aa, unknown, or other
MEAAMAATSSLLLASGSRRWPATLPPSPWPQQQRLVFCLAARTRPLDSKRGSWRRSSSATGGRSTAVSSSSSSERWVLDPAGDGDWRHIGYKVARPGAIEIVSEDTAVTVGRVADKADIVLPVATVSGAHARLGERGGSLLVTDLDSTNGTYINERRLKPGFPASVDPGGYSSSVTSTWPXSV

SEQ ID NO: 80939 - DNA, 869 bp, Zea mays
  misc_feature: Ceres CLONE 1566330
  misc_feature: Encodes the peptide sequence at SEQ ID NO. 80940
  misc_feature (47)..(47): n is a, c, t, g, unknown, or other
ctggagctccccgcggtggcggccgcatcatactagtggatcccccngggctgttacaattcgtctcacccctagaaaaaaggggatcagtcccacaggtaggggagggaaacaaacacccaaatcaaacccgcgcgtcgccagccgcagccgcagcaccaatgtcgtgcgtcgccgcgctcttcgcctccccggcgctcctccccttcccctccaccacctcgtccatggcctcctgctcgtgccgcctccgccccgccgtcgtcgcccgcgcgccgcgccagcagccgcggggccggcgcgcgctccggcgcttcgatgaggtggaaggggtgtcgaagaaacggcgcggcatcggaggcggtggcggcgtcggcgctggcgggtcgcagccgtcgtcctcgcgcagggacagggggctttccgtcgatttcaaggagccgcaggttgctgagtttgatgatcttgaagaggacaaattccttaatgctgtcgtcaaggtctattgcactcatatcgcacccgattatggtcttccttggcagaagcaaaggcaacattcaagtagtgggagtgcttttatgattggggatggtaaactcttgacaaatgcgcattgcgttgagcacgacacccaggtcaaagtaaagagaaggggagatgacaaaaaatatattgccaaggttttagctaggggtggggaaagcaaacttgccatggctatttgtttgagaattaaaaagtcttgggagaggaaaaaaaggcacttcatttttggtcagtttgccatgccttttagagattcaagaaacggttgggggggatatacctgggttggtgggagaacacatatattctgtaaaacaaaa

SEQ ID NO: 80940 - protein, 236 aa, Zea mays
  misc_feature: Ceres CLONE 1566330
MSCVAALFASPALLPFPSTTSSMASCSCRLRPAVVARAPRQQPRGRRALRRFDEVEGVSKKRRGIGGGGGVGAGGSQPSSSRRDRGLSVDFKEPQVAEFDDLEEDKFLNAVVKVYCTHIAPDYGLPWQKQRQHSSSGSAFMIGDGKLLTNAHCVEHDTQVKVKRRGDDKKYIAKVLARGGESKLAMAICLRIKKSWERKKRHFIFGQFAMPFRDSRNGWGGYTWVGGRTHIFCKTK

SEQ ID NO: 80941 - DNA, 923 bp, Zea mays
  misc_feature: Ceres CLONE 1566331
  misc_feature: Encodes the peptide sequence at SEQ ID NO. 80942
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (867)..(867): n is a, c, t, g, unknown, or other
  misc_feature (869)..(869): n is a, c, t, g, unknown, or other
  misc_feature (871)..(871): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
ctggagctccccgcggtggcggccgctctagaactagtggatcccccgggctgcaggaattcgtctcacccctagaaaaactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaggactacgccggcaagatcacgtgctgcaaggtgaacacggacgacagccccaacgtggcgtctacctacggcatccgcagcatccccaccgtgctcatcttcaagggcggcgagaagaaggagagcgtcatcggcgccgtcccgaagtccacgctcaccaccctcatcgacaagtacatcggtagttcatgagcatgccatgccatgccatgcatacatgcatcgacgactaaacacatatgtgtatctctagtagcctttgcatacgggatatgatcaattcaagcagccagccgtctgctactgctgtggtatatataccatacctccatgtcgaaatcagagtacattaattagtttcagttcacgatttcgatcagtaatatatatatatatatatatannnnnnnnnnnntnnnnntntntntnnnnnntnnnnntnnnnnnnnnnnnnnnnnnnnnnnaaaaaaaaaaaaaaa

SEQ ID NO: 80942 - protein, 167 aa, Zea mays; identical to SEQ ID NO: 80749
  misc_feature: Ceres CLONE 1566331
  misc_feature (60)..(163): Pfam Name: Thioredoxin Pfam Description: Thioredoxin
  misc_feature: SWISSPROT Homolog: EC 1.8.1.8 Protein-disulfide reductase

SEQ ID NO: 80943 - DNA, 827 bp, Zea mays
  misc_feature: Ceres CLONE 1566332
  misc_feature: Translation starting site: 151
ctccccgcggtggcggccgctctagaactagtggatcccccgggctgcaggaattcgtctcacccctagaaaaaagctctgagacttttcacaaggagcagagaggacaccgcaccagcccgttctcgttgcactcggggcaccgcctgaatgtggccgcctcctcgacgaacaccttgcagctgccggagcactcctcgcagggcacgaaccgcacgccgccgcagccggagcacgcctccagggcaacgcccttgccgcccgggcagctcggcgggggcgccatctcgcaggcctcgagcgcctccgacagctcgccggcctcgtgcatccggcggacctcctcggcgccgcccaggtgcctgccgtccgcgaacacctgcgggagcctgcccgcgctggagccgcccagcgcggcgtggagctcgtccttgaaccccgcgtgcatcgacaggtctcgctcgtcgacgcgcacgccgtagctctggaggacggacctggtggaccagcagtcctcgtacgtcttgcggacgccgtggaggctggtcaggtacaccaccaccttccgggcgctgtccggcgggggcggcacggccggcggcggcggcgccagcttggcgagcttcgcgtcgatcctctgctggaacgcgctgacccgcgcgcgcacgatgcccgggaacctctgtatctcgcgcttcctaacgcccacctcgtcgccgccgccccccgcgcccgggccgtcaggcttctcgtccaacgccttccggaacgcggcgacgacgacgtccggatcgaacgcgggcgaccctggggccggcttctcccgc

SEQ ID NO: 80944 - DNA, 948 bp, Zea mays
  misc_feature: Ceres CLONE 1566335
  misc_feature: Encodes the peptide sequence at SEQ ID NO. 80945
  misc_feature (833)..(833): n is a, c, t, g, unknown, or other
  misc_feature (835)..(835): n is a, c, t, g, unknown, or other
ctccccgcggtggcggccgctctagaactagtggatcccccgggctgcaggaattcgtctcacccctagaaaaaaagctccctctgcctgcctttataaatcaccggggcagagcgcctcagtgacacacgccgctgctcctagaaaccaccgccgagcccaaccgcacaagcgcgcgaggcaggagagagagagaggcggggagcaaaacaatggaggggaaagaggaggacgtgcgcctgggcgccaacaagttctcggagcgccagcccatcgggacggcggcgcatggcgccgctgacgacaaggactacaaggagcccccgcctgcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaatggcttccagcaggtactttacatgtgcaacggtggtggcgcctatgttgtcgcacctggctacacaagggtgatggccctggcgctgagattgtggcacttcatcctagtctacacggtctctcagccacgatgccagaggaatgcagggaccccatgntnctatcgtgcccactgcaattggggtcgcgtggtgctgggtcactgtcacatcccattactgaactggcatcaccagctaggaccttgcgctgcatcatctaaacaggatcagc

SEQ ID NO: 80945 - protein, 245 aa, Zea mays
  misc_feature: Ceres CLONE 1566335
  misc_feature (47)..(222): Pfam Name: MIP Pfam Description: Major intrinsic protein
  misc_feature (207)..(207): Xaa is any aa, unknown, or other
  misc_feature (208)..(208): Xaa is any aa, unknown, or other
MEGKEEDVRLGANKFSERQPIGTAAHGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVNGFQQVLYMCNGGGAYVVAPGYTRVMALALRLWHFILVYTVSQPRCQRNAGTPXXYRAHCNWGRVVLGHCHIPLLNWHHQLGPCAASSKQDQ

SEQ ID NO: 80946 - DNA, 952 bp, Zea mays
  misc_feature: Ceres CLONE 1566337
  misc_feature: Encodes the peptide sequence at SEQ ID NO. 80947
ctccccgcggtggcggccgctctagaactagtggatcccccgggctgcaggaattcgtctcacccctagaaaaagatcgtagaagcaggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatccgctgggcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgaccgcgacgaggcggacgggtacgacgaggccatctgcccgctggacgcgttccagagcggggccatccttggacgacgagatcaacgaggtcatcgtgcgcccgctggtgcacggcgccaggctgcacgccgtggttggaccctgctacacggccacggtctggacctcccctatcagggcgcatgtccaggaacgggttctggcaattggtagaacaaaacccgccttcgggcgcttggatgcaccagcggaaggcaccccggctcctcggcggaacacggagggcaaggaactccccttatggccgaacc

SEQ ID NO: 80947 - protein, 230 aa, Zea mays
  misc_feature: Ceres CLONE 1566337
  misc_feature (65)..(219): Pfam Name: Peptidase_C14 Pfam Description: Caspase domain
MNFGGNGNATIRCKYCRASLSVIPGERAIQCAQCNCVTRIRRADRIRWARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDRDEADGYDEAICPLDAFQSGAILGRRDQRGHRAPAGARRQAARRGWTLLHGHGLDLPYQGACPGTGSGNW

SEQ ID NO: 80948 - DNA, 877 bp, Zea mays
  misc_feature: Ceres CLONE 1566338
  misc_feature: Encodes the peptide sequence at SEQ ID NO. 80949
  misc_feature (742)..(742): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaagacgagacgcgtggtagctagggttttggcctcgccgcgcacgcctcctgaagcttctagacgttcgaggaggaggaggggaggctcccgccgccgccgccgcagccatggcgtccaccaaggtgcagcgtatcatgacccagcccatcaacctcatcttccgtttcctccagagcaaagcgcgcatccagatctggctcttcgagcagaaggacctccggattgagggtcgcatcatcggattcgatgagtacatgaacttggtcctcgaagatgctgaggaaatcaacgtcaagaaaaacactaggaagacactgggccccacactcctcaaaggtgacaacataactttgatgatgaacagtggcaagtgaaagttcttatggcaggaacgatgtttggtgctcgcgttgagtatttctggcacgttgtactccatccattcagacttacatgtacctgctgttaatgacctgagtaaaattatgctagatgctggccacttgtgtgtgccatattggcatcttttcctgttccatgttcagctaaaaagagcagaggaaggagacgagagctgaaggctgcctgccctgtgttgtgtctggtggctccatctagagagctactagtactagtggtcggtctatggagggccggaaggacctcnaccacggtggcctcaccggggcaagggccgtccgcggccccngaaccgccggtgccccggtggccggtggccactaccaagaaagtatgggtttgaccaacgccggcggcggggttgacctcacccgcgcccccg

SEQ ID NO: 80949 - protein, 88 aa, Zea mays
  misc_feature: Ceres CLONE 1566338
  misc_feature (19)..(85): Pfam Name: LSM Pfam Description: LSM domain
MASTKVQRIMTQPINLIFRFLQSKARIQIWLFEQKDLRIEGRIIGFDEYMNLVLEDAEEINVKKNTRKTLGPTLLKGDNITLMMNSGK

SEQ ID NO: 80950 - DNA, 999 bp, Zea mays
  misc_feature: Ceres CLONE 1566339
  misc_feature (174)..(174): n is a, c, t, g, unknown, or other
  misc_feature (180)..(180): n is a, c, t, g, unknown, or other
  misc_feature (190)..(190): n is a, c, t, g, unknown, or other
  misc_feature (196)..(196): n is a, c, t, g, unknown, or other
  misc_feature (200)..(200): n is a, c, t, g, unknown, or other
  misc_feature (220)..(220): n is a, c, t, g, unknown, or other
  misc_feature (221)..(221): n is a, c, t, g, unknown, or other
  misc_feature (577)..(577): n is a, c, t, g, unknown, or other
  misc_feature (700)..(700): n is a, c, t, g, unknown, or other
  misc_feature (710)..(710): n is a, c, t, g, unknown, or other
  misc_feature (740)..(740): n is a, c, t, g, unknown, or other
  misc_feature (791)..(791): n is a, c, t, g, unknown, or other
  misc_feature (834)..(834): n is a, c, t, g, unknown, or other
  misc_feature (872)..(872): n is a, c, t, g, unknown, or other
  misc_feature (887)..(887): n is a, c, t, g, unknown, or other
  misc_feature (888)..(888): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (894)..(894): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (900)..(900): n is a, c, t, g, unknown, or other
  misc_feature (907)..(907): n is a, c, t, g, unknown, or other
  misc_feature (912)..(912): n is a, c, t, g, unknown, or other
  misc_feature (913)..(913): n is a, c, t, g, unknown, or other
  misc_feature (933)..(933): n is a, c, t, g, unknown, or other
  misc_feature (934)..(934): n is a, c, t, g, unknown, or other
  misc_feature (945)..(945): n is a, c, t, g, unknown, or other
  misc_feature (966)..(966): n is a, c, t, g, unknown, or other
ctccccgcggtggcggccgctctagaactagtggatcccccgggctgcaggaattcgtctcacccctagaaaaagaagacggttcgagtccgttctagaatctagacacggcaatgaagcccaggcctctcggttgcggttgcggttgcgtcccggcggcggtagggtgcgtcngctggncatgaagccnaactcnaagncgcccggggaaagaaggaannaggggtttccccaaattgcccaactggggggggggggggggaaggttaattgggaaaaccccccccccagaggggtttcccccccgggtaaacccccccgaggaggggggggttttaatgggggggccattaaaaaaaatttcccccccccgcgttggagggccctcaaaaagtgggggcccccccccggtttttataattaataaaagagaggggcccccctttataaaaaaaggaaaaaagaaaccccccccccccccccccaaacaaaaaaaaaaaaaaactcccccgcgggggggtttttttttttttttttctcccccccccaacaacaaacaaaaagaaagaggcggccnccccccgcagaaaagaaaaaaaaaaaaaaaccaccccccccccctgtcttttttttaaaaaaaaaaacagcgcgcgcggggggggggggggtttattaaaaaaaaaaaaaaaaaaaatccggntttttttttnttaacccactttcaataaaacaaaaacccncccggagggggggggggcgcgctccccccctcctcccttctatttaaaatnaggatatgggtggggggtgggatggtaaaataataaaaaaaanttatttgtttccctcgccctcgcccacctttctctttntttgtttctccttcnncnnntncnnntnttgaatnttttnncttttgtctttccttagccnnaaaaaacaaanacaaaaaaaaaagataggaangagagatagagacgagttctcttctctttttct

SEQ ID NO: 80951 - DNA, 871 bp, Zea mays
  misc_feature: Ceres CLONE 1566340
  misc_feature: Encodes the peptide sequence at SEQ ID NO. 80952
tccccgcggtggcggccgctctagaactagtggatcccccgggctgcaggaattcgtctcacccctagaaaaagagatatatccccgccttccctcgcgaaagctctcgtagagacgacgacgacgacgacgacgacgacgacgcgagaagtcgaggcgccgctgcttgctaggaccgagcttcaggaagtctccaacggccccggcgccggcacggcctgccccgcgccgccacagggattgattgtgatcagatctattctgtagtggtcagcggctgagggtgaaccgaagatgagcgttgtgggattcgatctcggcaatgagagctgcattgtggcagtcgcgcggcagcgcggcatcgacgtggtcctcaacgatgagtccaaacgcgagacacccgccatcgtctgcttcggggacaagcagcggttcatcggtacggcgggcgccgcgtcctcaaccatgaaccccaaaaactccatttctcagatcaagcgcctgctcggccgcaagttctccgaccccgagctccagagtgatctcgcgtccttcccgttccgtgtcacggaggggcccgatggatttcccttggtacatgtgcggtttctggggcgaggagcggacgtttacccccacccagctgcttgccatggtgctgtcccatctgaagggctttgctgaggggacctttagactgccgtttgtgattgctgcattgcctccccggggacctccaggatttgcacgccagggctgttcttggggccgcgcacaattgggggccctccgccctttgggctttttttaaggaaaaactgccccggctttggcttttggggatttttaaaaaggcacctcccggggcggc

SEQ ID NO: 80952 - protein, 129 aa, Zea mays
  misc_feature: Ceres CLONE 1566340
MSVVGFDLGNESCIVAVARQRGIDVVLNDESKRETPAIVCFGDKQRFIGTAGAASSTMNPKNSISQIKRLLGRKFSDPELQSDLASFPFRVTEGPDGFPLVHVRFLGRGADVYPHPAACHGAVPSEGLC

SEQ ID NO: 80953 - DNA, 971 bp, Zea mays
  misc_feature: Ceres CLONE 1566344
  misc_feature: Encodes the peptide sequence at SEQ ID NO. 80954
  misc_feature (735)..(735): n is a, c, t, g, unknown, or other
  misc_feature (750)..(750): n is a, c, t, g, unknown, or other
  misc_feature (755)..(755): n is a, c, t, g, unknown, or other
  misc_feature (762)..(762): n is a, c, t, g, unknown, or other
  misc_feature (782)..(782): n is a, c, t, g, unknown, or other
  misc_feature (825)..(825): n is a, c, t, g, unknown, or other
  misc_feature (881)..(881): n is a, c, t, g, unknown, or other
aagctggagctccccgcggtggcggccgctctagaactagtggatcccccgggctgcaggaattcgtctcacccctagaaaaacaggcagtccaagcccggcggcaccgccgcggccgcgcccaccccaccgtggccatggccgtcctgcgcaaccaagccacagacggcgtccttccggcggcaaggcagcgacaacggccatgaccggccgtgcaccacggccgccagccgccgcttcgacgaagcagcagcagcagcagcaacaggcgttggcggacggctgcggccgccgcgcggggccgccgcgccgggcgacgagatgtacaagacggtcaactccgtctacttcgacgccgccgactcctgccgctccttcttcttcttcgacgacgacggcggcggcggggacgcggcggacgacgacgtcctcgacgacgacgggagcttctcaacgacgacggcgtcggaggagtggtccgaggccgtgatccgcagcctcggccggacctccaccggccgcttcttcttcgacgcgggcccggcggcgcccgtcgcggagtcgaccaactccatcctcgccgcctccaagtcatcgaagcctctctatgaggcgccccccagcaagctgccgcgggcggcgatgtctcctcccgcggcgggagtggtgctaaccgacgacgaacgggtcagcgtagccgagacggagacagaagtgccgtcgacgtcgtcgtcnctggtggaagatatncgtgncgttgcncctgactctgacgaccgttncgcgacttccgcgcgtcatgcacgagatggtggcgcgcacggnctccgcgactggggcgggctgcagtagatgctgctcttgtacctcgcatcaacggnaagcacaacacgcgctcatcgttcggggcctcgttcaaactctcgtcgggctcgccacgaggagggccgctctccctcggcacaacgaaa

SEQ ID NO: 80954 - protein, 176 aa, Zea mays
  misc_feature: Ceres CLONE 1566344
  misc_feature (143)..(143): Xaa is any aa, unknown, or other
  misc_feature (145)..(145): Xaa is any aa, unknown, or other
  misc_feature (154)..(154): Xaa is any aa, unknown, or other
MYKTVNSVYFDAADSCRSFFFFDDDGGGGDAADDDVLDDDGSFSTTTASEEWSEAVIRSLGRTSTGRFFFDAGPAAPVAESTNSILAASKSSKPLYEAPPSKLPRAAMSPPAAGVVLTDDERVSVAETETEVPSTSSSLVEDXRXVAPDSDDRXATSARHARDGGAHGLRDWGGLQ

SEQ ID NO: 80955 - DNA, 898 bp, Zea mays
  misc_feature: Ceres CLONE 1566347
  misc_feature (237)..(237): n is a, c, t, g, unknown, or other
  misc_feature (238)..(238): n is a, c, t, g, unknown, or other
  misc_feature (269)..(269): n is a, c, t, g, unknown, or other
  misc_feature (270)..(270): n is a, c, t, g, unknown, or other
  misc_feature (286)..(286): n is a, c, t, g, unknown, or other
  misc_feature (488)..(488): n is a, c, t, g, unknown, or other
tggagctccccgcggtggcggccgctctagaactagtggatcccccgggctgcaggaattcgtctcacccctagaaaaaggagctgcgtcttccttccgtttcagcaccgcgcgcaatcggccgctcatcccctcttcctatcgcccgccgccgccgccgccgccgcccgtccgcttcagtacgacgtcgagcaaggggaggtaaaagttcgtttggcgtgcgccatgtttaagaanngtctctcagaagatatatctggacagaatcnnagttagggctctgtancacgaaagattcggcaaagtatcgctgatgagtaccccaggcctgaccttttgctagatgacttggctccaaaaaaagtcacctatgattgttgttaaatgccaaaatcatcttaatccttgtaaggtggataaagggtccccctattttccaatataccggaagggcccttaaatggccaacccggggggtttttttatanggtttccccgagttcctggaaaaaattccccaggggggaaaagggggcctcccaatttgtttcttcctggggccaaacaaaaaggggccccggggggggcactccccccggggggggcccctttaaacccaaaattccgggggaggaaaccccccggggggtttatggggggcaaaggaaaaaacacccccccccccgccgtttgggtttaaaaaaaaaagtgggccccaaaaaaaatatagggccccccccaccaaaagaggtggtggggggggaaaaaaaaccccccccctcaaaaaggggggcccccccaaaaaaagaaggaaacccccccccaaaaaaaaaatatctctccgcggggggggggactctccccccgcccacacactcttttggtggagagaaaaaag

SEQ ID NO: 80956 - DNA, 957 bp, Zea mays
  misc_feature: Ceres CLONE 1566349
  misc_feature: Encodes the peptide sequence at SEQ ID NO. 80957
  misc_feature (207)..(207): n is a, c, t, g, unknown, or other
  misc_feature (213)..(213): n is a, c, t, g, unknown, or other
  misc_feature (220)..(220): n is a, c, t, g, unknown, or other
  misc_feature (221)..(221): n is a, c, t, g, unknown, or other
  misc_feature (226)..(226): n is a, c, t, g, unknown, or other
  misc_feature (227)..(227): n is a, c, t, g, unknown, or other
  misc_feature (240)..(240): n is a, c, t, g, unknown, or other
  misc_feature (734)..(734): n is a, c, t, g, unknown, or other
  misc_feature (836)..(836): n is a, c, t, g, unknown, or other
  misc_feature (841)..(841): n is a, c, t, g, unknown, or other
  misc_feature (842)..(842): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (859)..(859): n is a, c, t, g, unknown, or other
  misc_feature (871)..(871): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (906)..(906): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
ggagctccccgcggtggcggccgctctagaactagtggatcccccgggctgcaggaattcgtctcacccctagaaaaagctcgccctccacttccgccgccgccgcctcgctcctccctcgccgccgcttcctgccctcccgccgaagaagagcaagctcccgagccaccaccatcatgtcggcgttgggcgatgacccgatcaggnaatggnatctacnngaggnnaggccccgcgatnaaaaggatcagccccttgggggggggcgccttactcccctcaggccttttaatccaaccggccccccttttttgggaaacacaccccgcctttggcccaaaaattttaaaggggggatctttttttttaaaaatttttttaaaaaaaagccccccccttgtccccccccaaaagggggggggttccccacgggggggggtttttttttcaaaagaatattatttatatatgttgttgggggggggcaccccccctttttgggggggagaggcgctctataaaaaagcgccccccccaaaaaaaaaaaaaggggcggggggccgggcgcttttttttaattttcccccccccaccccaagggggggggggggggggggtgggttgtttttcttcccccccccggagatggggggggggggggggggggggggggcaaaaataaaaaaacccccccccccccccacaaaggaggaggggggaaaaacccccccccnccccgcttttttttttgtttttgtgggcttgcgtgccgcggcgaggagggcggagaaaaaaaaaaaaaaaaaaaaaaaaaagagggcgcgggccgcttcctnccttnncttttnnnannnnttanaaatatgtaagnggatgaggggggggnnnnnnnnnnnnnnnnnnagngnnnnngaagagggggaggaggggggttttttttcttcttctcctcccacg

SEQ ID NO: 80957 - protein, 114 aa, Zea mays
  misc_feature: Ceres CLONE 1566349
  misc_feature (11)..(11): Xaa is any aa, unknown, or other
  misc_feature (13)..(13): Xaa is any aa, unknown, or other
  misc_feature (15)..(15): Xaa is any aa, unknown, or other
  misc_feature (17)..(17): Xaa is any aa, unknown, or other
  misc_feature (22)..(22): Xaa is any aa, unknown, or other
MSALGDDPIRXWXLXEXRPRDXKDQPLGGGRLTPLRPFNPTGPPFLGNTPRLWPKNFKGGIFFFKNFFKKKPPPCPPPKGGGFPTGGGFFFKRILFIYVVGGGHPPFLGGRGAL

SEQ ID NO: 80958 - DNA, 998 bp, Zea mays
  misc_feature: Ceres CLONE 1566351
  misc_feature: Translation starting site: 182
  misc_feature: Pfam Name: Fructosamin_kin Pfam Description: Fructosamine kinase
aagctggagctcaccgcggtggcggccgctctagaactagtggatcccccgggctgcaggaattcgtctcacccctagaaaaagctcgccctccacttgcgccgccgccgcctcgctcctccctcgccgccgcttcctgccctcccgccgaagaagagcaagctcccgagccaccaccatcatgtcggcgttgggcgatgacccgatcagggaatggattcttacagaagggaaggccacgcagataaaagggatcaggtccattggtggtggctgcattaactccgctcagcgctatgataccgacgcgggccccttctttgtgaagaccaacagccgcattggtccagaaatgtttgaaggggaggttcttggtttgaaggcaatgtatgacacaaagtcgaccaccccccgcggtgccatttcaggttggttctttacctaccggtgggtcttttatcatcatggagtttattgaatttggtcgttcaaagggagaccagtcagatttgggaaggaagcttgctgaaatgcataaggctgctaaatctgataaaggacatggtttcccggttgacaataccattgggaagcactccacaaagtaacacttggactggatgatcggattgaattttaccccaagccatagattggggtttaccgcttggagtcgggcatccaaacgatttggaaaattcggccttttctcgaaaaaggccagccggtggattaaaaatattccgcccccttttttgaatggacccgttattgaacccttgcttggcttcatgggtgattcgtggaagcggaaacctttagcctctgataccccatggggattcccggactatttgggattcccgcctggcatactgtaaggtaaaaactgactggattttttgttattcccaaatccaaggatcatttggtctcgtggttcgccaaaagggagggaaatttgcgcgtgtcccgccttcccccaaatgttgtccccg

SEQ ID NO: 80959 - DNA, 909 bp, Zea mays
  misc_feature: Ceres CLONE 1566353
  misc_feature: Encodes the peptide sequence at SEQ ID NO. 80960
  misc_feature (764)..(764): n is a, c, t, g, unknown, or other
  misc_feature (784)..(784): n is a, c, t, g, unknown, or other
agctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctcggcgaggtcgtcgacccgctctatcccggcggcagcttcgacccgctcggcctcgccgacgaacccgaagccntcgctaagctcagggtgaangagctcaagaacgccgccctcgccatgtctcccatgtcggatttctcgtcaggccatcgtcaccgggaaggccccgctcgagacctcgctgacaacattgcgaccccgtcacaacacgcttggcc

SEQ ID NO: 80960 - protein, 254 aa, Zea mays
  misc_feature: Ceres CLONE 1566353
  misc_feature (65)..(233): Pfam Name: Chloroa_b-bind Pfam Description: Chlorophyll A-B binding protein
  misc_feature (207)..(207): Xaa is any aa, unknown, or other
  misc_feature (213)..(213): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADEPEAXAKLRVXELKNAALAMSPMSDFSSGHRHREGPARDLADNIATPSQHAW

SEQ ID NO: 80961 - DNA, 963 bp, Zea mays
  misc_feature: Ceres CLONE 1566355
  misc_feature: Encodes the peptide sequence at SEQ ID NO. 80962
  misc_feature (573)..(573): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (712)..(712): n is a, c, t, g, unknown, or other
  misc_feature (771)..(771): n is a, c, t, g, unknown, or other
ctggagctccccgcggtggcggccgctctagaactagtggatcccccgggctgcaggaattcgtctcacccctagaaaaagtggcaacgagcagaggtgtgcctagctcatcgatcaacaagtgagtagtagcaccttcaccatggcagacaagaagaaggtggaggtcaaagagacgaaggtggaggtgaagacggccgtctacaaggtgtacgtccactgcggccagtgcgcgcgcgacatccagacgcagttcaccgagttccaaggggttgaagaggtgaaagtggacgccggggccgggaaggtgacagtgaagggcttcggcttcgacgtcgagaagctgaggaagaaagtcgagaagggttgccggaagaaggtcgagctgattccgcccgcgcctcccaaggacgacatggtcgttgatgtcaagaccaaaaaggaggagctcaaggtcataactgtaaagctgccgttgcattgccccgattgtgcagtcagggtcaaggaggttttgcttgagaacaagagtatctacgaggccaagacggatctcggcaagaacacgtgcanccatcgagggtgtcattgaggaggacaagctcgtcaagtacatctacgagaggatgcgcaagaagggcgtcgtcgacaaggtcgaagaagaggtgatcatcaaggaggagatgtcttataaaaaagcgnnnnttagggnaaagggggaaaaaaagggggaaaaggggaaagggaaaaaaaaaaaggaaaaaggccaangaaaaaagggtaaaggaagcttgtccaacaagggccaaggaagggtcatcgcccccttattttatttccccgtgaaagcacccccataaattttgttgaaattatatccaacccccttgggaccccgggggggggggggggggttcctggcctccctttttaggggaaaaggtttttccgccctaccggggg

SEQ ID NO: 80962 - protein, 149 aa, Zea mays
  misc_feature: Ceres CLONE 1566355
  misc_feature (19)..(84): Pfam Name: HMA Pfam Description: Heavy-metal-associated domain
  misc_feature (144)..(144): Xaa is any aa, unknown, or other
MADKKKVEVKETKVEVKTAVYKVYVHCGQCARDIQTQFTEFQGVEEVKVDAGAGKVTVKGFGFDVEKLRKKVEKGCRKKVELIPPAPPKDDMVVDVKTKKEELKVITVKLPLHCPDCAVRVKEVLLENKSIYEAKTDLGKNTCXHRGCH

SEQ ID NO: 80963 - DNA, 846 bp, Zea mays
  misc_feature: Ceres CLONE 1566356
  misc_feature: Encodes the peptide sequence at SEQ ID NO. 80964
ccccgcggtggcggccgctctagaactagtggatcccccgggctgcaggaattcgtctcacccctagaaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccaagctccggtccctgctcacgccgcgcctactggcggtgccgttcgcggacctcgccgcctcgtcgctcccgcgcggcgcgccgccgcacgccgtggcggcgttccacgacatgctcttccgcgcgtacgcggacgcgggcgcggcgtgccgcgcggccgaggcgctcgacgccgccgtgtcccgcctcggcagcctcgacccgcgctcgctcacgttctcgctgctctcgctccgccgcgccgggcgcctcgcggacgccgcgggcctcctggagcgggcgctcggctcgtgcccggggtccgtctcgccgttcgccgcgtccgtcgtcgtcgacgggctctgcaagtcggggcgcgtggacgacgcgcgccggctgctcgaccatatgcctcgccaccgcgggagcctgaatgcgctgtgctacaactcgcttgctggactggtacttgcgaacaaaggatgacggggcgggtccccggagattctagagaatctggggggaaccaagggcttctaagccgaccgtcggggacctattacaaacctttgggggatagtttggtcgaccggccaggggacatccagcaaggggtggaggggttctggtttaatgagaatgaag

SEQ ID NO: 80964 - protein, 181 aa, Zea mays
  misc_feature: Ceres CLONE 1566356
  misc_feature (132)..(166): Pfam Name: PPR Pfam Description: PPR repeat
MAGSAALPPLAAFASLLTARRFAAARSKLRSLLTPRLLAVPFADLAASSLPRGAPPHAVAAFHDMLFRAYADAGAACRAAEALDAAVSRLGSLDPRSLTFSLLSLRRAGRLADAAGLLERALGSCPGSVSPFAASVVVDGLCKSGRVDDARRLLDHMPRHRGSLNALCYNSLAGLVLANKG

SEQ ID NO: 80965 - DNA, 911 bp, Zea mays
  misc_feature: Ceres CLONE 1566357
  misc_feature: Encodes the peptide sequence at SEQ ID NO. 80966
  misc_feature (616)..(616): n is a, c, t, g, unknown, or other
  misc_feature (623)..(623): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
ctccccgcggtggcggccgctctagaactagtggatcccccgggctgcaggaattcgtctcacccctagaaaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcatgcggtgggcggcgggcagtgcccggccctggggtgcgcggcggacctcaacgccgggtgcccgccctcgcatccgtgctggccgggggngggcccntttttttnnnntttaatgggccccgccgggcttcttcaaggaagccgtgccccggtgaagcgcaccacgccccaccgacttggaaccccgtcccgcagcgggtggctgggcgcccggcgaaagctcaagggcgtctttctggcaagtccgccatgggtgaaacccctccccccgccgccgaaaacccaagcgcattccgccaccggtgggtcccggggaaaactagaagcctccctggccgtgtcctgcctgcccgggtgggaaacaccacggcccggtggtgtctct

SEQ ID NO: 80966 - protein, 264 aa, Zea mays
  misc_feature: Ceres CLONE 1566357
  misc_feature (34)..(198): Pfam Name: Thaumatin Pfam Description: Thaumatin family
  misc_feature (166)..(166): Xaa is any aa, unknown, or other
  misc_feature (171)..(171): Xaa is any aa, unknown, or other
  misc_feature (172)..(172): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPHAVGGGQCPALGCAADLNAGCPPSHPCWPGXGPFFXXLMGPAGLLQGSRAPVKRTTPHRLGTPSRSGWLGARRKLKGVFLASPPWVKPLPPPPKTQAHSATGGSRGKLEASLAVSCLPGWETPRPGGVS

SEQ ID NO: 80967 - DNA, 1242 bp, Zea mays
  misc_feature: Ceres CLONE 1566358
  misc_feature: Encodes the peptide sequence at SEQ ID NO. 80968
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (834)..(834): n is a, c, t, g, unknown, or other
  misc_feature (971)..(971): n is a, c, t, g, unknown, or other
tcgtgtataagcatccccacctctgtgccctccgttgtgctgtttctatttattatgccnnnnccccnnnnnnnccaaactggagctccccgtcgtggcggccgctcttaaatagaggatcccccgggctgcatgaggtcgtctgacccctgagaaaaaatgagcgacccacactaacacgtgccctccgcgctccgacctatctcgtatgccgccgagacgacccgatagcttggcctcgctcgcttgcctgcactcgccgggttcccctctctccataccgtactgcgatggcatgccgggagcgccctactacggtcgctacgaagtcctcgactaaatccaggagctttggcggacctgggcgcttcgtgccttccacctcgaccccccccgctggggcgtcaacgtgcccacctactcgtggtcccccgccaatttcacggcttaccggggtgtgctccggccgaagtgccccccactctaagctgttacctgtcgtccgggggccaccctcgctcacctgatacttaccggtgcagttggctacgaacacttccgggagccttcattgtaacttccaggagccctgcctggaatcaagggtgcatctccctcacacccgctgtgacccccggacttacctagtaaccccgggaagggaaaaaaggtccgctgcgaatatttggcgttcctcccaaaggctctgaagtcatgccttgttaggaactgaatcagtcggtcggcatgggctccgttcctttagacaacgcgagatggaattgtttactttctcccagcagggttgttctagtggggaggtcctctttctgnccaatagaacccacatggtgcgatccctggagcgcaccccatattgattatgtggcttgttcgaagacagtgagtaattatcggccttctcgctaatatcataatgttgactatcgccccggtgttccgcccgggcncccgcatggagagaggatctctcttgaagagaatcgccttttgttcgagacgatatagtatcatggagttgttcgcccgggattcggcaccgtgttcgcaagcggtaacagaatgagacctgcgactcctgaaggggggccaataaggggtccggaagttattggcggattcaagcggagacgatgtaatatggaagagcgtcaataggtgctattatactctaaaatgcgcgcgcagtgttgtagtgcgatatctactcttttgttcgag

SEQ ID NO: 80968 - protein, 43 aa, Zea mays
  misc_feature: Ceres CLONE 1566358
MPPRRPDSLASLACLHSPGSPLSIPYCDGMPGAPYYGRYEVLD

SEQ ID NO: 80969 - DNA, 977 bp, Zea mays
  misc_feature: Ceres CLONE 1566359
  misc_feature: Encodes the peptide sequence at SEQ ID NO. 80970
  misc_feature (514)..(514): n is a, c, t, g, unknown, or other
ggagctccccgcggtggcggccgctctagaactagtggatcccccgggctgcaggaattcgtctcacccctagaaaaaatttttcttcggcgcgtacctcttcctcttccacctcgtccactgccgcggcgaacaccatcgtggaagaagcggcggcggtggcggctgtatccgtttcgcagcataccggatccatctccgacgcgctacggcactatgggaagtgctaccgggagctctcgaaagtccgcctcagtgctcttgttgtggcaacttcgggggctggttatgtgcttggtagtggcaacatcgtggatattgctggactttgttgcacatgtgctggtacaatgatggttgcagcatctgcaaataccctcaaccaggtgttcgagataaaaaaaatgatgctaaaaatgaaaagggacatgcgacgtcccctggcatctggtcgcatcagtcctgcacatgctgcaatgtgggctacaagtgtgggagttgcaggaacagcttngtgggcctgaaaggctaatgactgggcagctgggcttgcagcttctaacttgggttctgtcccctttgtggtttaccccggtgatgccaatcccccccggtaatacaggggttggggggaaatcgtgggggccttccaccccttttggggtggggggcgaccttaacctgaacggccactaaaagcccgggaaccccccggcccctttggactttggggaaaacccccctttttggggcccctgggcctcttttgccaaaaaaataccccttcggggggagggtacaaaagtttttctttgtgggggccccccggggaaaaaacaaccgggggggggcgccaaaaaaattggctgaacgccccccgtggggttttttttaaaaaagggggggcgccacccaagggggttgtttttttaaaaccccccccccaagtagggcccccccaggagagttcatctttg

SEQ ID NO: 80970 - protein, 57 aa, Zea mays
  misc_feature: Ceres CLONE 1566359
  misc_feature (55)..(55): Xaa is any aa, unknown, or other
MMVAASANTLNQVFEIKKMMLKMKRDMRRPLASGRISPAHAAMWATSVGVAGTAXWA

SEQ ID NO: 80971 - DNA, 911 bp, Zea mays
  misc_feature: Ceres CLONE 1566364
  misc_feature: Encodes the peptide sequence at SEQ ID NO. 80972
  misc_feature (768)..(768): n is a, c, t, g, unknown, or other
  misc_feature (835)..(835): n is a, c, t, g, unknown, or other
ggagctccccgcggtggcggccgctctagaactagtggatcccccgggctgcaggaattcgtctcacccctagaaaaagctcgccctccacttccgccgccgccgcctcgctcctccctcgccgccgcttcctgccctcccgccgaagaagagcaagctcccgagccaccaccatcatgtcggcgttgggcgatgacccgatcagggaatggattcttacagaagggaaggccacgcagataaaagggatcaggtccattggtggtggctgcattaactccgctcagcgctatgataccgacgcgggccccttctttgtgaagaccaacagccgcattggtccagaaatgtttgaaggggaggctcttggtttgaaggcaatgtatgacacaaagtcgatccgtgttccgttgccatacaaggttggttctttacctacaggtggttcttttatcatcatggagtttattgaatttggtcgttcaaggggagaccagtcagatttgggaaggaagcttgctgaaatgcataaggctgctaaatctgataaaggatatggtttcccggttgacaatactattggaagcactccacaaattaacacttggactgatgactggattgagttttactccaagcatagattgggttaccagttggagttggcatcgagacgatatggagattcggccatactcgaaaaaagtcagcggttgatcaagaatatccgcccactttttgatggagcggttattgagcatgcttgcntcatggtgatctgtggagcggaacatagctctgatagcaatgggatcccctgtatatggatcctgcntgctactgtaagtaactgactgatttagtatcgattcaggatcatggtagtggttgcaaggatgaattactgtctc

SEQ ID NO: 80972 - protein, 225 aa, Zea mays
  misc_feature: Ceres CLONE 1566364
  misc_feature (9)..(221): Pfam Name: Fructosamin_kin Pfam Description: Fructosamine kinase
  misc_feature (198)..(198): Xaa is any aa, unknown, or other
  misc_feature (220)..(220): Xaa is any aa, unknown, or other
MSALGDDPIREWILTEGKATQIKGIRSIGGGCINSAQRYDTDAGPFFVKTNSRIGPEMFEGEALGLKAMYDTKSIRVPLPYKVGSLPTGGSFIIMEFIEFGRSRGDQSDLGRKLAEMHKAAKSDKGYGFPVDNTIGSTPQINTWTDDWIEFYSKHRLGYQLELASRRYGDSAILEKSQRLIKNIRPLFDGAVIEHACXMVICGAEHSSDSNGIPCIWILXATVSN

SEQ ID NO: 80973 - DNA, 967 bp, Zea mays
  misc_feature: Ceres CLONE 1566366
  misc_feature: Encodes the peptide sequence at SEQ ID NO. 80974
  misc_feature (841)..(841): n is a, c, t, g, unknown, or other
ctccccgcggtggcggccgctctagaactagtggatcccccgggctgcaggaattcgtctcacccctagaaaaaaagcgacgataagcgttcagaaagccatcgtccttacagacgagacacgagaggcagcgagccagcgaccggcaacagttttctcggaaggcagcctcttcctcgtcgccgccgacgtcacccgccgcggctgtcggggatgccggtcagggtggtcgataccgccacgccttcctcgcagccctccccagggcaagaagcaaatactggacacccatctcctcctagatgttcactcttaagtgctggaagatcttttgctggaactcagaatgtttcaagtctgcagaaggatgaagcatggaaagtgaatgtccgcatccatggttgtgatcttgaacagggttatctatgtggaacgatggaagcgcttaatgttccattagcagatacacctgtagtgacattctgggagggggagatagtggatgctaaaaattacacctttttcactggcaagtgggaggcatcgccagaggatgatataagacattggtccaagttcccatcatttatgcctcttctgagtcagattgagacagacggtggcaagtctctggactttagcaactatccttacatatatatgagatggaaagaacagtattttgtcaatgttggagttgactgtggggtaaccatcgctggtttctactacgtctgctttttctgtagtgatggctcacttagtggatttattatgatccaatagcagtccgtttcagaagctcaattgaagtgtacaatgaggaaattcctggatcacnttttcatcctatgagctgcagtgacaggggccaatgccctcggaagacaactttcggtgcaccaattagggggtactgaaccatactccccaatgctgccgttttggaaaaaaagaatgtggggtt

SEQ ID NO: 80974 - protein, 190 aa, Zea mays
  misc_feature: Ceres CLONE 1566366
MPVRVVDTATPSSQPSPGQEANTGHPSPPRCSLLSAGRSFAGTQNVSSLQKDEAWKVNVRIHGCDLEQGYLCGTMEALNVPLADTPVVTFWEGEIVDAKNYTFFTGKWEASPEDDIRHWSKFPSFMPLLSQIETDGGKSLDFSNYPYIYMRWKEQYFVNVGVDCGVTIAGFYYVCFFCSDGSLSGFIMIQ

SEQ ID NO: 80975 - DNA, 1079 bp, Zea mays
  misc_feature: Ceres CLONE 1566368
  misc_feature: Encodes the peptide sequence at SEQ ID NO. 80976
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (801)..(801): n is a, c, t, g, unknown, or other
acaagaacacaactttttttaagatcgggagagcatatatttaagggtgtgttnnnnccgattttttttattttggagctcccgcggtggcggccgctctagaatagtggatcccccgggctgcaggaattcgtctcacccctagaaaaaactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgaccccacgtgcggcggcttgggcgtgctgggcatcgcctgtgcccttcggcggcatgatcttcgtcctcgtctactgcaccgccggcattctcggggggccacattcaaaccccggcggtcacccttcgggcctctttcctgggggccgcaagggtctccccgggggggcgcggcgcctggctccatcattcgtggggccgaatttggcccttcgggcaccacattcttgggggggggtccggggcctttcggttaaaaggggcggtttttcccaaaaagacgggccccttaccttttccaaaaaagggtttaagggggtggggggggaggncccaaaaatttggtgttgaggccctccggggttatatccccccccgggggaaacgggggctttttggtttgcccacaaatatttttaggggaccctcttctggggttgtagttctaaaaccagggttttttctttcgcccccctaatcccttattgggtttatcccccccgaaaatcctcaaatttcccgggttgtgtggggtcccccccccccacattggtgtttttcacggttgttattgggggggcctgtgggtaccacattctcccttttaggg

SEQ ID NO: 80976 - protein, 161 aa, Zea mays
  misc_feature: Ceres CLONE 1566368
MGKDDVIESGAGGGEFAAKDYTDPPPAPLIDAAELGSWSLYRAVIAEFIATLLFLYITVATVIGYKHQTDASASGADPTCGGLGVLGIACALRRHDLRPRLLHRRHSRGATFKPRRSPFGPLSWGPQGSPRGGAAPGSIIRGAEFGPSGTTFLGGGPGPFG

SEQ ID NO: 80977 - DNA, 930 bp, Zea mays
  misc_feature: Ceres CLONE 1566370
  misc_feature: Translation starting site: 230
  misc_feature: SWISSPROT Homolog: EC 2.7.10.2 Non-specific protein-tyrosine kinase
  misc_feature (834)..(834): n is a, c, t, g, unknown, or other
  misc_feature (903)..(903): n is a, c, t, g, unknown, or other
ctccccgcggtggcggccgctctagaactagtggatcccccgggctgcaggaattcgtctcacccctagaaaaactgcattccccctttccccttccgtccgctgcattcctgctctcttgctctcctcgctctcagaccacagttgccgccgccgccgccctaagccagggtgctgaggctttcgttggcctcttcgccggcagcgagcacccaccagttctgtagaaatggctgatggtgaggacatccagcctcttgtctgcgacaatggcaccggaatggtcaaggctggttttgccggcgatgatgcaccaagggctgtattccctagcatcgttgggcgtcctcgtcacaccggtgtcatggtagggatggggcagaaggatgcatatgtttggtgatgaggcacagtccaagagaggtattctcacgctcaagtacccgattgagcacggtattgtaagcaactgggatgacatggagaaaatctggcatcacactttctacaatgagctccgtgttgccccggaggagcaccctgtgttgcttactgaggctcctttgaacccaaagccaacagggagaagatgacccagattatgttcgagactttcaatgttcctgccatgtacgttgcaattcaagcagtcctgtcactctatgctagtggccgtactactggtattgttctcgattctgggtgatggtgtgagccatactgtgcccattttatgaaggatatgccctttctcatgctattctacgtctggatcttgctggtcgggacctcaccgactcgctcatgaaattcccactgagaagggtgtatccntcccacctccgccgagcgagaaatggtagggacatcagggagaagcttgcgtattagctcttgactacnagcagaagttggagactgcaagaacgc

SEQ ID NO: 80978 - DNA, 826 bp, Zea mays
  misc_feature: Ceres CLONE 1566371
  misc_feature: Encodes the peptide sequence at SEQ ID NO. 80979
  misc_feature (826)..(826): n is a, c, t, g, unknown, or other
ccgcggtggcggccgctctagaactagtggatcccccgggctgcaggaattcgtctcacccctagaaaaaagcaacgcaagcactccgatccacgctgctgtgcagaacgagagagatatcatcagtagttagagcgaccaatagatgagttcctccccgtcctttggtctcctggccgtagcagcagtactcctagcactgaacttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcataagacgaacttcgccggcatcaacgtcgagttaggcgccaactgggtggagggcgtgaacggcggcaagatgaaccccatctggcccatcgtcaactccaccctcaagctccgcaacttccgctccgacttcgactacctcgctcagaacgtctacaaggaggacggtggcgtgtacgatgaagattacgtccagaagagaattgaactggcggacagcgtggaagagatgggggagaagctctctgccactttgcacgccagtggcagagacgacatgtctatccttgccatgcagcgcctcaacgaacaccagccgaacgggccggcgacgccggtggacatggtggtggactactacaagttcgactacgagttcgcggagccgccgcgcgtgaccagcctgcagaacacgtgcctctcgcgaccttcagcgacttcggcgacgacgtctacttcgtcn

SEQ ID NO: 80979 - protein, 227 aa, Zea mays
  misc_feature: Ceres CLONE 1566371
  misc_feature: SWISSPROT Homolog: EC 1.5.3.11 Polyamine oxidase
MSSSPSFGLLAVAAVLLALNLAQHGSLAATVGPRVIVVGAGMSGISAAKRLSEAGITDLLILEATDHIGGRMHKTNFAGINVELGANWVEGVNGGKMNPIWPIVNSTLKLRNFRSDFDYLAQNVYKEDGGVYDEDYVQKRIELADSVEEMGEKLSATLHASGRDDMSILAMQRLNEHQPNGPATPVDMVVDYYKFDYEFAEPPRVTSLQNTCLSRPSATSATTSTSS

SEQ ID NO: 80980 - DNA, 935 bp, Zea mays
  misc_feature: Ceres CLONE 1566372
  misc_feature: Encodes the peptide sequence at SEQ ID NO. 80981
  misc_feature (874)..(874): n is a, c, t, g, unknown, or other
ctccccgcggtggcggccgctctagaactagtggatcccccgggctgcaggaattcgtctcacccctagaaaaaaatcgtgcaatccggccgctggccgcatgccgcgacccgaagtgataagccaccgcccaccgccgctggcatgagcccgatggcgctgctcacaccactgcccattccccttctctcgccgtattgccaacgcgtctcgtctccgtcgcttctggcggccggggcagttatcagacctctcatttgtctttccccccacaatcaccgccaccacgatgcactctacccctctgtccccaatgtgtggccacgccaccggcgccgccgcaggggcgcagttgcttccgtcgaccaggaggagtctagtgcctcggaaaccgcagtcgctcccgaggaagacctggggccaccggtatcctctgatgcggctgccgaggacggggtcgcgacttctgcccagccggcggaggcgagcccggaggacctggagaacatccgcgaaattaaaagggtccgctgcttccagccttcgttgtctcgttttgcgtcactggaattagtgcatattgactttgctttcgtttgcttccgttgctaggtactggagctgctgaagaaaacagagacatgacctttggcgagtttaggcttacatcatgattgaggaccctagagatatagaagaaagagaacctcgggatagaggatcctgatgaaatactagggatgatttagctgacgctttggctgaagtaacgaaagaagattccagagaacgtgttgcacttcagttgcttgccaaggaaatggcagaatggcagaacatgagatagaagctcaaaaaagagagcaaccctggnaaacttgtcttgcaaaagcacaaatactggcatcaatcttgagaagctgctaaagaactac

SEQ ID NO: 80981 - protein, 152 aa, Zea mays
  misc_feature: Ceres CLONE 1566372
MALLTPLPIPLLSPYCQRVSSPSLLAAGAVIRPLICLSPHNHRHHDALYPSVPNVWPRHRRRRRGAVASVDQEESSASETAVAPEEDLGPPVSSDAAAEDGVATSAQPAEASPEDLENIREIKRVRCFQPSLSRFASLELVHIDFAFVCFRC

SEQ ID NO: 80982 - DNA, 915 bp, Zea mays
  misc_feature: Ceres CLONE 1566374
  misc_feature: Encodes the peptide sequence at SEQ ID NO. 80983
ccccgcggtggcggccgctctagaactagtggatcccccgggctgcaggaattcgtctcacccctagaaaaaactcctaccgccgagccagaagcacccggagcagcgcacagcaacagagcacacgccgcacaccgacgcctccacagcagcagcaatggcgcgcgccggcgctctctgcctggtgctgctctgcctcgtggccgcgcactcagccgacgtgcgcagaatccacgacagccccggccgccgcgccggccgccgccaccaccccgccggcgaccccgaccaagaagacgcccgcgcccgccgccgcgccgcccaccaccccggccaccctggccccggccgccgcgccgcccacatctccggcaacccccgcgcccgtcgatgaccgcacacaatacggcggccaccctggcacccgccgcagcgcagcccaagtccgacaacatgccgaacactggcaccacgaaacacattgtcgatgccacccatactactgtgaagataactgccgaccactgtcctatcgtatccaacactcgactagtgcaagacttagacgaactagaccgctgaaacatgaccttgcactatcagaaccatgacgtcgtcgaagaatgcatcaagaccagtatctctgaatacggctgctgcgctgcatgatgaagtgattacagaaacaactagctccacagattagcaccgaaatccatcaaaggtactctccaagccctggtgggaactattgggtccgcccattgctccaatgttaaaactgcagctgcagggaaagattggataacgccaaggttatttcgaccaaattccgaaaaaattggggaaagtttgaaccaggagggcaagttttccatttccgctggcgtgtacttgtgaaacacccattacttc

SEQ ID NO: 80983 - protein, 78 aa, Zea mays
  misc_feature: Ceres CLONE 1566374
MARAGALCLVLLCLVAAHSADVRRIHDSPGRRAGRRHHPAGDPDQEDARARRRAAHHPGHPGPGRRAAHISGNPRARR

SEQ ID NO: 80984 - DNA, 932 bp, Zea mays
  misc_feature: Ceres CLONE 1566376
  misc_feature: Encodes the peptide sequence at SEQ ID NO. 80985
  misc_feature (620)..(620): n is a, c, t, g, unknown, or other
  misc_feature (711)..(711): n is a, c, t, g, unknown, or other
  misc_feature (712)..(712): n is a, c, t, g, unknown, or other
ctccccgcggtggcggccgctctagaactagtggatcccccgggctgcaggaattcgtctcacccctagaaaaaggagctgcgtcttccttccgtttcagcaccgcgcgcaatcggccgctcatcccctcttcctatcgcccgccgccgccgccgccgccgcccgtccgcttcagtacgacgtcgagcaaggggaggtaaaagttcgtttggcgtgcgccatgtttaagaagttctcttcagaagatatatctggacagaatcaagttaaggcttctgtacaacgaaagattcggcaaagtatcgctgatgagtcgcccagccttgaacctttgctagatgacttgctcccaaaaaagtcacctatgattgttgttaaatgccaaaatcatcttaatcttgtagtggtgaataatgttcctctatttttcaatatacgtgatggtccttacatgccaaccctgcgtcttcttcatcagtatcctgatatcatgaaaaagttccaagtggatagaggtgctatcaaatttgttctatctggcgcaaacataatgtgtcctgaggtgacttcacctggtggtgccttagacgacgaagtcgaggaagatacacagtggctantatggctgaagggaaaacacacgccccgggcatttggatatacaaagatgtcagcaaaagacattaggaccatcaacaaggggattgggtnnttgacatatgcactatctaaatgatggccctatggagattgaacgggctcgaatgagtagaattctctgaggggtccataactggcggcagaacgttttgatggacttttgaaacaggccggaccccttttggcacagctgggttcgtttttaaaaaaagaagtaccaagaaactttatttacctaagcaacttggagctactcccaacactttgggtgg

SEQ ID NO: 80985 - protein, 171 aa, Zea mays
  misc_feature: Ceres CLONE 1566376
  misc_feature (134)..(134): Xaa is any aa, unknown, or other
  misc_feature (164)..(164): Xaa is any aa, unknown, or other
MFKKFSSEDISGQNQVKASVQRKIRQSIADESPSLEPLLDDLLPKKSPMIVVKCQNHLNLVVVNNVPLFFNIRDGPYMPTLRLLHQYPDIMKKFQVDRGAIKFVLSGANIMCPEVTSPGGALDDEVEEDTQWLXWLKGKHTPRAFGYTKMSAKDIRTINKGIGXLTYALSK

SEQ ID NO: 80986 - DNA, 894 bp, Zea mays
  misc_feature: Ceres CLONE 1566378
  misc_feature: Encodes the peptide sequence at SEQ ID NO. 80987
  misc_feature (481)..(481): n is a, c, t, g, unknown, or other
acccgcggtggcggccgctctagaactagtggatcccccgggctgcaggaattcgtctcacccctagaaaaagtcctctctccttccggcttccgctgctcttctttctttcctggcatcttggagacggcggcgagacgaggagaggactggaccatggctgcctcttcggctctcaggctaatcctgggctcctcgtcggcgtcgcgtcgccagattctgtccgagatgggatacaaattcacgcttcttgttgtttttttttgcgccctatcgtttgagatgtttgctttagtaatttcttctcccgcacctttcagttcattcattttcttttttctccgggggctttagagtgcggatatcgatgagaaagcgatcagaaaggagaacccagaggaactggtggtcgccttggctcatgcgaaagcagacgctattctggagaagatgcagaaacatgggatgatgaaagagattnctgattctcaagatactactctgatgataactgctgaccagtgtcaaatcgtatcaaaactcgacaagtgcaagcttacgaccaataaaacggtggaaaatgattttgactttcagaacttgatgttgtccaaagatgccctcaagccaaagtctctaaaattgcccgttgggttccctgatggagggatttaagaaaacccttccccccgaaaaggcccggaatcccccaagggtccccggaaacccggcccgcaaaattggatcctggcttgttcaaatggaaaacggggcctaaagggaagggggtttaaaccaaatttttttcccaatttcccaacaaattttgggaaattttaccaaaggggggatgtttctttgcccgggggggcccccggggggccccccttttcc

SEQ ID NO: 80987 - protein, 65 aa, Zea mays
  misc_feature: Ceres CLONE 1566378
MAASSALRLILGSSSASRRQILSEMGYKFTLLVVFFCALSFEMFALVISSPAPFSSFIFFFLRGL

SEQ ID NO: 80988 - DNA, 996 bp, Zea mays
  misc_feature: Ceres CLONE 1566381
  misc_feature (400)..(400): n is a, c, t, g, unknown, or other
ctggagctccccgcggtggcggccgctctagaactagtggatcccccgggctgcaggaattcgtctcacccctagaaaaagttggagaagacagacagatgacaagctcgaagctctccagaatctccactcccggagtgagttccccaccaccgtctccaaagtccaaatgtcccgtcaccaccacttcgccgccgccatcgctgtcgtgctcatcctcttcgcgccgcctccttgcgccggcgaccctaacgacgagcgttgcctgacccacctccaccagtccctctccaatccctccggcggtctcaactggaccaaggcggcgatctccgcgccgtgcgatggtttcttctcgcacctccatggcgtgacctgcaacaacgggcgcgtgtacaanctagccctcccggagctctcgctcgggggcaccgtccccgcggaagctctccaactgcaacaaacctccagtcgctggaacctctccgccaacgcggctgtccggcggcattcccgaacggaactttcccgcgctgctgaaacccccgccgggctcaaaccggttcccgcaaaaggcctgttccgggccccatctccccggggaactccccaaggtggcccccatacctcaaagggttataaaatcccccctgggaaaaccagggggttccggggtccccttctcccaaaaaaaagttggggccccctctgtgggggggttttaaaccctttaaaaatttcccaaaaaaacgctctttggggggcccctccccgggggtcttttgtaaaaacaaaaccggggcgcaaaagggaaaaccccggggggacgggaggtgttatagcccccccccctctaaaaaaaaaaagagtctttttttgtgtacccctccccccaaaagaaaaagggggggtcccccgggtccaaaaaaggggtgaattcctcgaggggaggggctcccctttgtgacccttctcgcccgggggtgggggggcggg

SEQ ID NO: 80989 - DNA, 906 bp, Zea mays
  misc_feature: Ceres CLONE 1566383
  misc_feature: Encodes the peptide sequence at SEQ ID NO. 80990
  misc_feature (861)..(861): n is a, c, t, g, unknown, or other
  misc_feature (862)..(862): n is a, c, t, g, unknown, or other
aaagctggagctccccgcggtggcggccgctctagaactagtggatcccccgggctgcaggaattcgtctcacccctagaaaaaaaaccctcgcttacctcccgtcacgtcgcgtccgaacggcgacgctgcgccgtgatggacgccttcttcggcaagggcggcggcggcggcggcttccgcggcgccaagtgcaagacgctgctgaagctgtcgatcccgcggataaagctgctgcggaaccggcgggagctgcagctgcgccagatgcgccgggacatcgccaagcttctcgaggccggccaggaggccaccgcgcggatcagggtggagcacatcatccgggaggagaacatgatggccgcgcaggagaatcctcgagctcttctgcgagctcatcgctgtgcgcctgcccatcatcgagacccaaagggcgtattatctttgagtataaaggagggatcccgaaatcctgctcgtggatacaaatggggctatagttgaaaaaattggattaactggttttggggacaaaaaattctgcaggagaatgcgaaaaaagtccgaccggaattggggttcccctggttgggggggcttcggggggggggccttattgtttttcaaggaagccaaaatccagggttctggtttcccctcccccccaaaaggggcgagattctccccagaaccggaaccaagttccaaaagaggggtttgccacaaaaaattgggggaaaggaattttttcccccctcccccttctccaaaaaataaattccctattttgggggggggccaatctccccaaaaaaaatagaaaaaccttttttttattttgccccccccccccccggcccnnggagaaagttttaaaaacccccctaggaggagaaaaactctccg

SEQ ID NO: 80990 - protein, 121 aa, Zea mays
  misc_feature: Ceres CLONE 1566383
  misc_feature (25)..(112): Pfam Name: DUF292 Pfam Description: Eukaryotic protein of unknown function, DUF292
MDAFFGKGGGGGGFRGAKCKTLLKLSIPRIKLLRNRRELQLRQMRRDIAKLLEAGQEATARIRVEHIIREENMMAAQENPRALLRAHRCAPAHHRDPKGVLSLSIKEGSRNPARGYKWGYS

SEQ ID NO: 80991 - DNA, 1093 bp, Zea mays
  misc_feature: Ceres CLONE 1566390
  misc_feature: Translation starting site: 190
  misc_feature: SWISSPROT Homolog: EC 2.7.9.1 Pyruvate, phosphate dikinase
ctccccgcggtggcggccgctttccaactagtggatcccccgggctgcttgaattcgtctcacccctagaaaaactcggacggatggcggcggcggtttccagtgccttctgcttccaggttccgggctcctaatgcattgtggactgggaagcgacctccttctcccgcggaacggtggcgtcggcttatggccccgcgcgccttagccgtcggcctcatccggtccgtctccggctcgggacggggccagcagtgctcgcctctgatggtcgtcgttgacgccgcgttcttccagaccaggagagtcagctgtatggcggctcagtctcccgcgcgcaagctgcttcggtttggggtcccgccctgctgtcttgcaaccgtctaccatgtgagacacctggcgaaccgtatcagggcggtggctctaatggcggcgcgtctgttgatgagtgatccaaccggtacgttggctcccccttgtgtgccccctttatgtgagaatggaactcacgaaggtgttttcttatagaccggcttcggtcctcttgttcctttgggccgtcttccgattttcaaatgtaaccttggctgttcccttggaagcttcccctggttggtcgtcccttttggaaggcgcccggccttgattttttccttcggcctgtctgggccaggaacaagctttcccctttgtcttcggcgtgctttcccaattcttatatcggcgtccctaaaccttccttgggagggcttgagtggagaaatggttggtgggcgtttcgtggggttttcccttgttgtacccgttttcctatcgtggctctcttgggctgggttgctcccgttgggagcataagaagtttgctggaagctacgtgtttttggcccaggttcgccgtccggaacacgcggtttgtggatcgccattgctttccttggagctcgtcttctgttgttcgtttgtggggtaaccagattccaacggtgctgtggctcggaggcggccgccccgtccagccgtgttgggctctcgctccgcttgggttatcacccttgtttgtggtgggggccgcccgcgaggggtgttgtgg

SEQ ID NO: 80992 - DNA, 821 bp, Zea mays
  misc_feature: Ceres CLONE 1566391
  misc_feature: Encodes the peptide sequence at SEQ ID NO. 80993
  misc_feature (758)..(758): n is a, c, t, g, unknown, or other
  misc_feature (759)..(759): n is a, c, t, g, unknown, or other
  misc_feature (762)..(762): n is a, c, t, g, unknown, or other
ggagctccccgcggtggcggccgctctagaactagtggatcccccgggctgcaggaattcgtctcacccctagaaaaaactggcctgaatctgacccgcgccgccatccccaccgccgcgcctcttccgggcagccatggacgaggccttcgcgcgcgcggtggaggacggcctcaagctcaccaagcgcctcgtcctgcccagcgggggcgggatgccgccgccgccgcgcccgcacctggcgatggaccgcgacgaccccgccgcggcgctgcagcagctcatgccggcggcgcccatggcgtacgcagtcgtcgtcgacccggccgccgtcgacagccccgacgtgcccagctaccagccccacgtctacggccgcctcgacccgcccgcgctcatcccgctccagatgcgggaggtcgagctccgcgtcgactgcgccgccggctgcgccaccgccgaggtcgccctgcgcgcgcgctggtggctgcactgcatcacgcgcagccgcgcctgccactgccgcatcgtcgtgcccatggctcaccagggttcaattctaggcgctgaggttacctgtggggaaaagaccataccataatccatggtaattgaaaccgaagggaaaaactggttccagggaaaaattggcaattgcccccccaaaaaagggggggggggttctttttaaaaaaaaaaggaattttttttttttttttctttgggagaaaaaaaacccccccggttttttttttttnnggntgggggggaggaaaaaaaaaaaaaaaaaattaattattttttctctcccccccccccca

SEQ ID NO: 80993 - protein, 154 aa, Zea mays
  misc_feature: Ceres CLONE 1566391
MDEAFARAVEDGLKLTKRLVLPSGGGMPPPPRPHLAMDRDDPAAALQQLMPAAPMAYAVVVDPAAVDSPDVPSYQPHVYGRLDPPALIPLQMREVELRVDCAAGCATAEVALRARWWLHCITRSRACHCRIVVPMAHQGSILGAEVTCGEKTIP

SEQ ID NO: 80994 - DNA, 862 bp, Zea mays
  misc_feature: Ceres CLONE 1566392
ctccccgcggtggcggccgctctagaactagtggatcccccgggctgcaggaattcgtctcacccctagaaaaaacgcatccttcgaccaaaacggcagctcctttctcccgcggcgttgccgtcgcactcgcacgcacgcactcaccgccggcctgagcctaatcctaatcctaatccacataccgggacaatccagacgaacgagcgaaccaacgcacggacggccaccagccgctgcgtgcgttcgctttcccccgaaacgtgacccgagacgagctgcagagagaaaggagaagccgccatgaagtagcagcagctgcctcctagtcgtccccgttaaatccctgctcgccaagccacgactacgagcaccagccgtccagcccccgcttttctcctcccgcccccgttccccgtcccgactcccgacccaacccatatcagagattccttccgttggtggcgctggcgtccgcgctggcgttcccgtgagtcggcccgcgcgcgaaggcggccgtgaccgaccgtccggagcttcatgcgccaagggcggcggctccaccccgtcgtttgatgggcaacgcatgcggcggcccccttagatccaagcaccagcacagcttcaagcacgcccgcgtcgtcgaaacggccaccagggccttcttcggagtaaagcgcccaggccccccgggccgaacaaactcgccccagggaaaacggccaccggccggctcgggcaaaaaaggggaaacccccaaagggcccggcgccgccggccggtcccgaataaatggaccaaaaaaaagccccgcctgtggagggagcccgggcccctccccccccggagaacatgtgggggt

SEQ ID NO: 80995 - DNA, 896 bp, Zea mays
  misc_feature: Ceres CLONE 1566393
  misc_feature: Encodes the peptide sequence at SEQ ID NO. 80996
atagctggagctccccgcggtggcggccgctctagaactagtggatcccccgggctgcaggaattcgtctcacccctagaaaaaactccaaccgccgagccagaagcacccggagcagcgcacagcaacagagcacacgccgcacaccgccgcctccgcagcatcagcaatggcgcgcgccggcgctctctgcctggtgctgctctgcctcgtggccgctcactcagccgcggcgcagaagtccacgacagccccggccgccgcgccggccgccgccaccaccccgccggcgaccccgaccaagaagacgcccgcgcccgccgccgcgccgcccaccaccccggccaccctggccccggccgccgcgccacccaccacgccggccacccccgcgcccgtcgctgcggcgcccactaccccggccaccctggcacccgccgcggcgccgcccaagtccgcccccaaggcgtcccctcccgccccgtcgcccaaggccaaggccaccccgccggtggccgagctgccgcccgcctcctcgcctcccgcccccgcccccgcctccccgcccacgaagaccgccgaggtccccgcgcccgcgccgtccaagaagaaaaagaagccctcctcgtcgtccaagaacaagaagaagaagtccaaggccccggctccagcccacgtctggaaggcaaccaccagctgccagcgctccaaggttaaagaacctttcggcagccaagccgacataaccggtccaggtcggctatggcgtggccgccgacaccgccggttgctggaaggaacgtggccaggcgtaaatttgggcggccgccctggggactaaagggccctttcccgcctatgtgaggggcgcaccaacaaaaaacgggtgcgcgcta

SEQ ID NO: 80996 - protein, 223 aa, Zea mays
  misc_feature: Ceres CLONE 1566393
MARAGALCLVLLCLVAAHSAAAQKSTTAPAAAPAAATTPPATPTKKTPAPAAAPPTTPATLAPAAAPPTTPATPAPVAAAPTTPATLAPAAAPPKSAPKASPPAPSPKAKATPPVAELPPASSPPAPAPASPPTKTAEVPAPAPSKKKKKPSSSSKNKKKKSKAPAPAHVWKATTSCQRSKVKEPFGSQADITGPGRLWRGRRHRRLLEGTWPGVNLGGRPGD

SEQ ID NO: 80997 - DNA, 775 bp, Zea mays
  misc_feature: Ceres CLONE 1566396
  misc_feature: Encodes the peptide sequence at SEQ ID NO. 80998
ggagctcaccgcggtggcggccgctctagaactagtggatcccccgggctgcaggaattcgtctcacccctagaaaaactcggaaggatggcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcggtgacggggccagcagtgctcgccgctgagggccgtcgttgacgccgcgtcgatacagacgaccaaaaagagcaaatggggcgcctcaagtctcccgcgcgcaagctactacggttcagggtccgggtgctgcggcgggctgatcccgtcttacggtgggagacacccttggtaacagtgaggaagggcggccgccccaaaaggcaggcccctcggcctgatgaatcctcccacccgggaagcagccgcccccctgtttgaccccaaaattgggaaagggagccccaagaaagggggtttccaaaaaaaaggggggaaaccctttggccccaaaggggggggcccccaaaaaaaaaaaaaaaaaccccgggggtttccccggggaaaaatccccccggtgtaaccccccctttttttaaaaaccccccgggggggttttttttttccccccccccccttttgtggggggggaaaaaaaaaacatttttcccctctcccaaaaaccccatatattttttctccccccccgcga

SEQ ID NO: 80998 - protein, 65 aa, Zea mays
  misc_feature: Ceres CLONE 1566396
  misc_feature: SWISSPROT Homolog: EC 2.7.9.1 Pyruvate, phosphate dikinase
MAAAVSRAICVQKPGSKCSRDREATSFARRTVAAPRPPRAKAAGVIRSDSGAVTGPAVLAAEGRR

SEQ ID NO: 80999 - DNA, 938 bp, Zea mays
  misc_feature: Ceres CLONE 1566398
  misc_feature: Encodes the peptide sequence at SEQ ID NO. 81000
  misc_feature (533)..(533): n is a, c, t, g, unknown, or other
  misc_feature (569)..(569): n is a, c, t, g, unknown, or other
ctggagctccccgcggtggcggccgctctagaactagtggatcccccgggctgcaggaattcgtctcacccctagaaaaatgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacngcggtggcagcggctacggtggccgcggcggctacnggtggtggtggccgcggctacgggcgttggcaaccgtggcggcggctacggctactccgacgggaactggaggaactgaacggtggggcccgcccgggcaagttatctgtgtcgctaccgggatgtttaccctagtccaaagggtttacctcctttccgggccgggtttttggtccccctctttgtttttgaattcaggggcccccctgggcaatttgtaaggccgggttccccccgggtttcggaaacccggtttaaaaaattgggaggggattttatggaggggttccccccccgggggttttttcagagttacctaaggaaaaaaaggggcgcttttggccgccacaaaaaaaaaaaaaaaaaaaa

SEQ ID NO: 81000 - protein, 203 aa, Zea mays
  misc_feature: Ceres CLONE 1566398
  misc_feature (10)..(81): Pfam Name: RRM_1 Pfam Description: RNA recognition motif. (a.k.a. RRM, RBD, or RNP domain)
  misc_feature (48)..(128): Pfam Name: GRP Pfam Description: Glycine rich protein family
  misc_feature: SWISSPROT Homolog: EC 5.2.1.8 Peptidylprolyl isomerase
  misc_feature (119)..(119): Xaa is any aa, unknown, or other
  misc_feature (131)..(131): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYXGGSGYGGRGGYXWWWPRLRALATVAAATATPTGTGGTERWGPPGQVICVATGMFTLVQRVYLLSGPGFWSPSLFLNSGAPLGNL

SEQ ID NO: 81001 - DNA, 923 bp, Zea mays
  misc_feature: Ceres CLONE 1566401
  misc_feature: Encodes the peptide sequence at SEQ ID NO. 81002
  misc_feature (789)..(789): n is a, c, t, g, unknown, or other
  misc_feature (808)..(808): n is a, c, t, g, unknown, or other
  misc_feature (809)..(809): n is a, c, t, g, unknown, or other
  misc_feature (862)..(862): n is a, c, t, g, unknown, or other
ggagctccccgcggtggcggccgctctagaactagtggatcccccgggctgaaggaattcgtctcacccctagaaaaaataattcgctgccagagccagctccaagggagcttcccaggaatgaggacccgagtttggtgagaaggaataagaggatgctggggcagcttcttgtcggtacattagagaaatttcaacaagaggataaaaagctatccaactctgaggcttttctgcgcagatcagagactcagcgaaaggctgagcaaaaggttcgtgaagaaagtgaaaggctgcgacagcaggaacgtgagcaaattgcagagaagcgtaagcgtgatatgacgctccgcgctcgtgtagctgctaaggcagaagaaaagaggttggagctgttgtacattcagtggactgagcatcataaaaggctgtccaatttcttaaggttatttttatttctggtccaaaagtgtccatattgacaattaaattgagggaagatacattctaattgtatgcagacctgatgtttgataactattagtgtatctgtttacattgtatactaatgaacaatatttgttccatgtttgacacttatctcattacccccttacgtttggcaggacaaaagctgagccacctatttattacatgccaacttcaacaattattgatgatccagccattgttgagcagaacaaggaaaaggtattcgaagaatggaaatctatgcgcagggctgagctgactcagtttcaaaagcaagttgaggagcaatatctctcnaatgtggagaggcattggnnagagatccagaatgcccggtacgctcggaaggcgaacgggccctggtacatgncagaaatgggacaggagctggacacccacagggcggagcatggtccaaagccctcggctat

SEQ ID NO: 81002 - protein, 108 aa, Zea mays
  misc_feature: Ceres CLONE 1566401
MLGQLLVGTLEKFQQEDKKLSNSEAFLRRSETQRKAEQKVREESERLRQQEREQIAEKRKRDMTLRARVAAKAEEKRLELLYIQWTEHHKRLSNFLRLFLFLVQKCPY

SEQ ID NO: 81003 - DNA, 843 bp, Zea mays
  misc_feature: Ceres CLONE 1566402
  misc_feature: Encodes the peptide sequence at SEQ ID NO. 81004
ctccccgcggtggcggccgctctagaactagtggatcccccgggctgcaggaattcgtctcacccctagaaaaaaaaaaccccgcgctccacttacgtgactcgcgcgcgacacgcgagcaggaggttgagacgaagacccgccgccaccggggatggcccaagcgccgccgcgacctagggagcgaggatgaggagctcgaggaggtgcgccgcatgcagaggattcctgcaaggaggagaacatggaggtggtgcccgtagtagtaggggaaccgatcaagagcactggcgaggggaagaaatagaagaagcactatgcttccttggagtaccacgtcaacagcttggagctgcttgcattgaccacagaggcacaccggagcatccggcgaggacctgcacgcttgaaaccgacgacgaggccatgccatctttgcatgccccgcctttttacacggtgacacagtgttacatgggcaagtggggaattgcatattgtgtcaagggtggtccagaaaaagagctaaaagcaatgcagtacttggagagaagagagtgtgagtatgaccagaagatatccattgatttctacaaggaaggagatcccttgaaaccagctgtgatgggcgtcttagtgttcgtttccactccagatccaattggcaacaagtactatcttggccctgctcctttgcagaatatggcaaggccacgaagatgattcgatcatagagcttgcaaacaaggtgaggaaggtgctcaacagaacaaaggagaccaaaatcactgcgatgcagggcgcgtgaactcttctactacctcaagggtaagcaggtggact

SEQ ID NO: 81004 - protein, 177 aa, Zea mays
  misc_feature: Ceres CLONE 1566402
  misc_feature (34)..(178): Pfam Name: ChaC Pfam Description: ChaC-like protein
MRSSRRCAACRGFLQGGEHGGGARSSRGTDQEHWRGEEIEEALCFLGVPRQQLGAACIDHRGTPEHPARTCTLETDDEAMPSLHAPPFYTVTQCYMGKWGIAYCVKGGPEKELKAMQYLERRECEYDQKISIDFYKEGDPLKPAVMGVLVFVSTPDPIGNKYYLGPAPLQNMARPRR

SEQ ID NO: 81005 - DNA, 926 bp, Zea mays
  misc_feature: Ceres CLONE 1566403
aagctggagctccccgcggtggcggccgctctagaactagtggatcccccgggctgcaggaattcgtctcacccctagaaaaaatcatccacaccaacagcgctggtacagcggagcttgggagcctgaaagcacagagccttgtgagatcctttgccaggatgctggggaagctgctcatctgcgctggctggccctatggctctatatatctccggctcctccgcccacgtcgtcctcggctcactggaccctcggcccagggcctacgcggcgtccgcggcgtaagggaccatgtgccacaccaggaacggcacgacctcgggcagaagccaatgatgtcaggcacgccccccgcgccgatggctaggtctccagagtaccagaccccggaactgtccaacaccccccccactgatgggcataagtcgtcgacccattccatatgggtatcgctattctcggccgcaaactcgccaggttgctgattagatccagctaccataaatttgatccgcctgctcacgtgttgtattcgcactccgtgcgtacctgtgtgagacgaattgtagtgaccggtgttcgtgccgcgaacgacgctttgatccacacgcgcgtgcgcccggcctctatgacgctcagcaccttctttgtacatcgccaacgagaccttttttgatcaccgcgctcgtcttttatgccaaataagattatgtttccctagaatgtttttcgtttcgaacaaccttagataactcggtttcttgaaccccgtcgcaggagcagtattgtctcagaatgtgcagacttaattgggagacgttccagaattgcccagttacctcccttcaagcggaaaagggctcgtctatacctttcgatattgtaaaacaggtcgtggacctatcacaggtgccgtatctatg

SEQ ID NO: 81006 - DNA, 840 bp, Zea mays
  misc_feature: Ceres CLONE 1566405
  misc_feature: Encodes the peptide sequence at SEQ ID NO. 81007
ctggagctccccgcggtggcggccgctctagaactagtggatcccccgggctgcaggaattcgtctcacccctagaaaaattccatccccaaccaaacaagtttggatatcaaaatataccatcccccgcgctatggagagtctggatcctcctgaacctccaagacgcaagcaatgaaaggagggacgcaagcaattagcctgatggtgcaccttgctgtgccatgggtctgccttgcttcttgggcagctctgctaccgacgatagcatctggaaatgtgggagcatcagctcccatactgacagcaaattacataaaattgaacttcagcaccgcttccgcgacccccgacaagtacaagagcttcatcgcttctgttcgggctggcatggtgagcacagcgaggggcaacagcagcgggatccccgtgctggtcgacgaacacaacccgctcgcgctcgaatcgttgctaaacatcactctggtgaacaaggcagggcgctccgtaagattgaagatggatgtctccagagcctccttcgtggcttacataacacgtcagcgctcgtgcctcctcaagagatcacgccgcacgttctcgtccgcgatctgttactacggtggctcgtggggaacctgttcgagctctgtcacgagacctgctactgctggcggcgacagccaggaatctggggtcacggcatgcccagcgagatatctcaacgaaggcatctcgacactgttccatgatcaccactggcaacgctatcgaagagcaactgaaacggaggcgtcagcctcctgcaacatgattgtggccaaccgcaggggacattta

SEQ ID NO: 81007 - protein, 222 aa, Zea mays
  misc_feature: Ceres CLONE 1566405
  misc_feature: SWISSPROT Homolog: EC 3.2.2.22 rRNA N-glycosylase
MKGGTQAISLMVHLAVPWVCLASWAALLPTIASGNVGASAPILTANYIKLNFSTASATPDKYKSFIASVRAGMVSTARGNSSGIPVLVDEHNPLALESLLNITLVNKAGRSVRLKMDVSRASFVAYITRQRSCLLKRSRRTFSSAICYYGGSWGTCSSSVTRPATAGGDSQESGVTACPARYLNEGISTLFHDHHWQRYRRATETEASASCNMIVANRRGHL

SEQ ID NO: 81008 - DNA, 853 bp, Zea mays
  misc_feature: Ceres CLONE 1566406
  misc_feature: Translation starting site: 194
  misc_feature: SWISSPROT Homolog: EC 2.4.1.67 Galactinol--raffinose galactosyltransferase
ctccccgcggtggcggccgctctagaactagtggatcccccgggctgcaggaattcgtctcacccctagaaaaagccggccggaccacccgagccagaagcgcgtcgccagctgataactaacccaacccaacccaaataagctcgatcctgctctctgccgacgcggccggattctaattcgaggacgatcgatgacggtgggcgccggcatcgccgtccaggacggcagcctcctggcgctgggcgccaaggtcctgcgggaggtgcgcggcaacgtgctcgtgacgccggccgccggcgggggcctaaccaacggcgcgttcctcggcgtccggtccgcgcccgccaccagccgcagcatcttccccgtcgggaagctccgggaccagcggttcgtgtgcacgttccggttcaagatgtggtggatgacgcataggatgggctccgcaggccgcgacatcccctccgagacgcagttcctgctcgtggaagtgtccggcggcggcgagcagcccgccgtcgtgtacaccgtcttcctccccgtgctggagggctcattccgtgccgttcttcaggtgaacgccgacgaccagctggagatctgcctggagagcggcgacccggacgtggaatctttccaaggctcccatctggtcttcgttggcgccggatcggacccgttcgaggtcatcacaagttcagatcatgctgtcgagaggtacttgcagacgttctctcacagggagaagaaaagatgcaagacattctgaactggtttgcctggtgcacctgggacccgttctacaccaatgtcaccgcccagggaagtaaagcagggattcagaagctgc

SEQ ID NO: 81009 - DNA, 939 bp, Zea mays
  misc_feature: Ceres CLONE 1566407
  misc_feature: Encodes the peptide sequence at SEQ ID NO. 81010
  misc_feature (687)..(687): n is a, c, t, g, unknown, or other
  misc_feature (837)..(837): n is a, c, t, g, unknown, or other
  misc_feature (838)..(838): n is a, c, t, g, unknown, or other
  misc_feature (928)..(928): n is a, c, t, g, unknown, or other
tggagctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtncgcggcgccgagtactaccggatcaccaacggactggacctagaggacagctgcaccccggtgggcccttcgaccccctgggcctggcagcgaccccgaccaggcggcatcctcaaggtgaaggagatcagaaacgccggctgggcatgnntctcatgttcgctttctcatccaggctacgtcaccggcgtaagccccgtggagaactcgcaagcacctcacgaccccttcggacactgcntacgtcatctc

SEQ ID NO: 81010 - protein, 269 aa, Zea mays
  misc_feature: Ceres CLONE 1566407
  misc_feature (83)..(232): Pfam Name: Chloroa_b-bind Pfam Description: Chlorophyll A-B binding protein
  misc_feature (235)..(235): Xaa is any aa, unknown, or other
  misc_feature (236)..(236): Xaa is any aa, unknown, or other
  misc_feature (266)..(266): Xaa is any aa, unknown, or other
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVAVIAEVILVRGAEYYRITNGLDLEDSCTPVGPSTPWAWQRPRPGGILKVKEIRNAGWAXXSCSLSHPGYVTGVSPVENSQAPHDPFGHCXRHL

SEQ ID NO: 81011 - DNA, 859 bp, Zea mays
  misc_feature: Ceres CLONE 1566412
  misc_feature: Encodes the peptide sequence at SEQ ID NO. 81012
ctccccgcggtggcggccgctctagaactagtggatcccccgggctgcaggaattcgtctcacccctagaaaaaacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggccccttcgccggcgacgagccgcaccaggcgtacatgtgtacacccagcccaggcccttaactgcgcccgcccctgcgactggttttcctgctggtttctgtggatttggctgccggaggattcccccaggctttaggatcacggtagattcgctgtgaaatccgaagggtgctcaggtcatgttgggggaccagcgcatgatactgggcttagactcggcaacctcatcaagcactgcccctgatttgacccgcgctgaagaggatccttctgtgagcaggagctgcgtgatcgaccgcctgcaggtggggtgggcgcagaagggaggacaagtggagggtctgggtgattgttatagcaagaagaagaacaagaccggcagtggtttcaggaatcttgccgcccgaagcttggtcctcccaagatggaggggttcttatgaaggggggagaaatttaacccggggcaacctttcttttgccggggatctggcagggaaggttggcccaattttcaggcctgggttcccgtcttttcccggggtctttactaaattaataaaattggggccaaggggttttataacccgaattccttt

SEQ ID NO: 81012 - protein, 139 aa, Zea mays
  misc_feature: Ceres CLONE 1566412
MLGDQRMILGLDSATSSSTAPDLTRAEEDPSVSRSCVIDRLQVGWAQKGGQVEGLGDCYSKKKNKTGSGFRNLAARSLVLPRWRGSYEGGRNLTRGNLSFAGDLAGKVGPIFRPGFPSFPGVFTKLIKLGPRGFITRIP

SEQ ID NO: 81013 - DNA, 1321 bp, Zea mays
  misc_feature: Ceres CLONE 1566413
  misc_feature: Encodes the peptide sequence at SEQ ID NO. 81014
  misc_feature (57)..(57): n is a, c, t, g, unknown, or other
  misc_feature (63)..(63): n is a, c, t, g, unknown, or other
  misc_feature (788)..(788): n is a, c, t, g, unknown, or other
  misc_feature (824)..(824): n is a, c, t, g, unknown, or other
  misc_feature (956)..(956): n is a, c, t, g, unknown, or other
  misc_feature (1079)..(1079): n is a, c, t, g, unknown, or other
  misc_feature (1117)..(1117): n is a, c, t, g, unknown, or other
  misc_feature (1296)..(1296): n is a, c, t, g, unknown, or other
acgggatagtctatattctcacctcttaaatccaccctacgtggttctctacttttntttttnttttttttttaaaaacctggactccacgcggtggcggccgctctagaactagtggatcccccgggctgcttgaattcgtctcacccctagaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcatccagcagcccctggtacggccccgaccgcttcaagtacctcggtcccttctccggcgagcccccgagctacctcaccggcgagttccccggcgactaccgctgggacaccgccgggctgtccgccgaccccgagacattgttcaacaaccgcgatgtggacccgatccacttcccgctgggccatgtctcggtgtcgttcgggactgcgttcttcccccgtagatggcttctcccgctaacgggggtccaagtttccgtccaaagccccttcttgggttacaggggcccggggtccccaataatccttccttccgaaggggccagggcctgggaaattatacccttccggctataaacccccatacccctggttatttccacagtccgctcatgtaatccatattccctttctttccacaccttgtataggagtgtctcctcgtgccccaccggnggcctccggtgagtgtcctataccatatgtgtgggnctgtggccctcgcatatctcctctacaattagagggtcgctcctttcctccctcgtcgataaatttatatgcctctcatatgtatctagggggtgtctctcgctattacttggtaggcccgtaagatgagtntccctccccctcgtaacacacttgtggtattgtgtgaccgcccgtgtagggtggagtctatatattcatttacgagatcccctcactcttgggggcttatgttggtacactcatataacaccnacccctagagatgccgctgtcttcactgagtatatctntaaaagatgagcaaaagagagcccctcattagaatagatgaagcgcactctattcgcccttgtttttcgttccaagatgattccgggccacactttccatttagatagagattaaatcacgacaccagtgagatatagggtgctcgcccctataaacatctacttatattgcctaaccntgtcacacatacttgtcgaaaaaat

SEQ ID NO: 81014 - protein, 159 aa, Zea mays
  misc_feature: Ceres CLONE 1566413
MAASTMAISSTAMAGTPIKVGSFGEGRITMRKTVGKPKVAASSSPWYGPDRFKYLGPFSGEPPSYLTGEFPGDYRWDTAGLSADPETLFNNRDVDPIHFPLGHVSVSFGTAFFPRRWLLPLTGVQVSVQSPFLGYRGPGSPIILPSEGARAWEIIPFRL

SEQ ID NO: 81015 - DNA, 810 bp, Zea mays
  misc_feature: Ceres CLONE 1566414
  misc_feature: Encodes the peptide sequence at SEQ ID NO. 81016
  misc_feature (388)..(388): n is a, c, t, g, unknown, or other
ccccgcggtggcggccgctctagaactagtggatcccccgggctgcaggaattcgtctcacccctagaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccncccctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtggttgagagtggtgctgtgcccatctttgtcaagctactcaactccctcagcgaggatgtccgtgaacaggctgtatgggctttaggtaatgttgctggtgactcccaaaagtgtcctgatctc

SEQ ID NO: 81016 - protein, 197 aa, Zea mays
  misc_feature: Ceres CLONE 1566414
  misc_feature (106)..(147): Pfam Name: Arm Pfam Description: Armadillo/beta-catenin-like repeat
  misc_feature (149)..(189): Pfam Name: Arm Pfam Description: Armadillo/beta-catenin-like repeat
  misc_feature (4)..(97): Pfam Name: IBB Pfam Description: Importin beta binding domain
  misc_feature (57)..(57): Xaa is any aa, unknown, or other
MSLRPSEREQMRKGNYKQTVDAEESRRRREGQMVDIRKAKREESLQKKRRDGFPASXPGVPPMGHSTALQQKLDGLPAMVQAVHSNDPSVQLEATTQFRKLLSIERSPPIEEVISTGVVPRFIEFLTREDHPQLQFEAAWALTNIASGTSENTKVVVESGAVPIFVKLLNSLSEDVREQAVWALGNVAGDSQKCPDL

SEQ ID NO: 81017 - DNA, 842 bp, Zea mays
  misc_feature: Ceres CLONE 1566415
  misc_feature: Encodes the peptide sequence at SEQ ID NO. 81018
  misc_feature (285)..(285): n is a, c, t, g, unknown, or other
  misc_feature (315)..(315): n is a, c, t, g, unknown, or other
tccccgcggtggcggccgctctagaactagtggatcccccgggctgcaggaattcgtctcacccctagaaaaaagcagtacccactcacgagaccgtccaggcgtccaccgcgacgcgctctcctgcccgtgcccacctccacgactccacctccgcagcgcccgcggtaacctccccacgccacgccacatcgcgtgcgagccccaaccgtcgccggcctcccaattaagccgcccccgcggcgcgatccggtgtccaccgctgctccgccggaggaggggganaggggaagaaaagggagggggggagcacanggggatgctagaggcgaagccgccgtcgccgggctccggcgcggccggggcggcggcgcacatccacggtcaccggcggtgggcggcgccgctgctggcctcggttctgctctcgtcgctcctcatcaccgcgtcgctcttcttttcctcctcccgcgcgctgctactctccttctcggcgctcccctccgcggcctccgccgagcctctcttcgtcgagggcaagctccgccagcagatgcggggccgaggaggcgcccacgcggggcggcgtgcccaggaatcgctacctcaacctcggctccgcgggggaaggagccccgccttcgccggaaccctaaggggcctctaaccacccggaaaacacaaacgtcgtggcaccctgaacttcaaggcccccggccgccgagaggcgccgaaaatcgcccttggccatgcaccggggaaccccgtttaaacctaagggtcccccaacgttcagaggggtgtccccccggggccaacactggggccacctaacggggggg

SEQ ID NO: 81018 - protein, 115 aa, Zea mays
  misc_feature: Ceres CLONE 1566415
MLEAKPPSPGSGAAGAAAHIHGHRRWAAPLLASVLLSSLLITASLFFSSSRALLLSFSALPSAASAEPLFVEGKLRQQMRGRGGAHAGRRAQESLPQPRLRGGRSPAFAGTLRGL

SEQ ID NO: 81019 - DNA, 810 bp, Zea mays
  misc_feature: Ceres CLONE 1566419
  misc_feature (626)..(626): n is a, c, t, g, unknown, or other
  misc_feature (721)..(721): n is a, c, t, g, unknown, or other
  misc_feature (722)..(722): n is a, c, t, g, unknown, or other
  misc_feature (760)..(760): n is a, c, t, g, unknown, or other
ctccccgcggtggcggccgctctagaactagtggatcccccgggctgcaggaattcgtctcacccctagaaaaatatagaattttacgatgtcagagcagctgaaggtgcagttcgtgctttaaacaggagtgatcttgctggcaagaaaataaatttggggactgttggtctgagtggtgttagacgattaacacagcacatgtccaaagagtcggggcaagaagaatttggtgtatgcaaactgggcagtctaagcacaaatagccctccattgccttcattgggttcatcttatatggtagccatgacatcttctggccgtgaaaatgggagtattcatggtttgcattctggactgctcacatcaatgagcccgttcagagaggcttcttttccgggcctatcatctaccataccacagagcctgtcctctcccattggaattgcatctgctacaactcatagtaatcaggctccccttggtgagctcagccactcacttagtcggatgaatgggcatatgaattatggttttcaaggcttgggtgctcttcatccccattctcttcctgaagttcacgatggagcaaataatggcaccccgtacaatctaaacaccatggntaccaattggtgtgaatagcaaactcagaacagccgaagcagttgactgcagacatcttcataaaagtgggttctagcaacctcaatggacattnncattgatcgtgtcggtgaagaagctatgggattttcangaaagtggaagtggtcctggtcatggtcacccagctaatggggaaatatc

SEQ ID NO: 81020 - DNA, 881 bp, Zea mays
  misc_feature: Ceres CLONE 1566420
  misc_feature: Encodes the peptide sequence at SEQ ID NO. 81021
ctccccgcggtggcggccgctctagaactagtggatcccccgggctgcaggaattcgtctcacccctagaaaaagagcccacgtcccacccctcctgcatttcaaaataatatctccctgcgcttttcctagccctttgtcatccaaggaaacaataaacaaccggcgcttttacacccccgccaagaacaggagcaacaacaacaaggctcctcgcaacaatccattctcatccatggcgaagctcatgaacaagctggtcgattcgttcgagcacgacgagataccggacgtcggctgcgtgcgcgccgtgctggccgagctcgtcctcaccttcctcttcgtcttcaccggcgtctccgccgccatggccgccggaaaagacaggtccttcccccccttcatgaaacgtacgtggctctgcacgcgcgcaggatccgacgggaagcccggcgacgctatgccgatggcgacgctggcggcggtggctatcgcgcacgcgctggccgctggcgtcctggtgacagccgggttccacgtctcccgcggccacctgaaccccgcggtgacggtggggctcatggtgcgcggccacatcaccaaagctccgggcggaggcagaacattccccccccagcgtgcttggccttcctccccccgcctggggggctccctccgatttccccaaacggggggggaagtggggacccccccgggcacccccccccggggggaaagggggactaaaaatcccccaaaaaaaagggggcccccggtgtaaaaaggggaggggaataaaaacaccacaccctttctcgccgccgggcgaaatttaataagggagcaaataacacggcaggagaaaatatgtgggagaggag

SEQ ID NO: 81021 - protein, 181 aa, Zea mays
  misc_feature: Ceres CLONE 1566420
MAKLMNKLVDSFEHDEIPDVGCVRAVLAELVLTFLFVFTGVSAAMAAGKDRSFPPFMKRTWLCTRAGSDGKPGDAMPMATLAAVAIAHALAAGVLVTAGFHVSRGHLNPAVTVGLMVRGHITKAPGGGRTFPPQRAWPSSPRLGGSLRFPQTGGEVGTPPGTPPRGERGTKNPPKKRGPPV

SEQ ID NO: 81022 - DNA, 843 bp, Zea mays
  misc_feature: Ceres CLONE 1566423
  misc_feature: Encodes the peptide sequence at SEQ ID NO. 81023
ctccccgcggtggcggccgctctagaactagtggatcccccgggctgcaggaattcgtctcacccctagaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaaatgagcagctgcctctgccttcccaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggttcgccatcgagtacgccgtgtgcgcgctcaaggtgcaggtcatcgtggtcattggccacagctgctggcgg

SEQ ID NO: 81023 - protein, 107 aa, Zea mays
  misc_feature: Ceres CLONE 1566423
  misc_feature (31)..(107): Pfam Name: Pro_CA Pfam Description: Carbonic anhydrase
  misc_feature: SWISSPROT Homolog: EC 4.2.1.1 Carbonate dehydratase
MDPTVERLKSGFQKFKTEVYDKKPELFEPLKSGQSPRYMVFACSDSRVCPSVTLGLQPGEAFTVRNIASMVPPYDKIKYAGTGFAIEYAVCALKVQVIVVIGHSCWR

SEQ ID NO: 81024 - DNA, 945 bp, Zea mays
  misc_feature: Ceres CLONE 1566424
  misc_feature: Encodes the peptide sequence at SEQ ID NO. 81025
  misc_feature (809)..(809): n is a, c, t, g, unknown, or other
  misc_feature (830)..(830): n is a, c, t, g, unknown, or other
ctccccgcggtggcggccgctctagaactagtggatcccccgggctgcaggaattcgtctcacccctagaaaaaacgccgctgctccaagaaaccaccgccgagcccaaccgcacaagcgcgcgaggcaggagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagatgaaatgcagggactcccatgttcctatccttgccccactgncaattgggttcgcgggttccntgggtcacttgcaccatccccattactggcactgggcatcacccagctaggagccttggcgctgcatcatctacaaagggatcacgcctggaaacgacattggatcctctggggt

SEQ ID NO: 81025 - protein, 239 aa, Zea mays
  misc_feature: Ceres CLONE 1566424
  misc_feature (47)..(238): Pfam Name: MIP Pfam Description: Major intrinsic protein
  misc_feature (217)..(217): Xaa is any aa, unknown, or other
  misc_feature (224)..(224): Xaa is any aa, unknown, or other
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKMKCRDSHVPILAPLXIGFAGSXGHLHHPHYWHWASPS

SEQ ID NO: 81026 - DNA, 851 bp, Zea mays
  misc_feature: Ceres CLONE 1566426
  misc_feature: Encodes the peptide sequence at SEQ ID NO. 81027
ctccccgcggtggcggccgctctagaactagtggatcccccgggctgcaggaattcgtctcacccctagaaaaaaaaaccccatctcagcaacgatgcctcgtcctcttgcagctctcctctctaccgcttgcatcctctccttcttcatcgctctgtttccaagagctgcatcatcccgagacatcctaccactgggttcctctctcgtagtcgagtcctacgaatccagcaccttacaatcatcagacgggacattctcctctggcttctacgaagtctacacccatgccttcacattctcagtatggtactcaaagacggaggcggcggcggccaacaacaagaccatcgtgtggagcgcaaaccctgaccgccctgtccatgccaggaggtcggctctaaccctgcaaaaggacggcaacatggtgctcaccgactacgacggcgcagccgtgtggcgagctgatggcaacaacttcaccggcgtccagcgtgctcggctcctggacaccgggaacctcgtcatcgaggactcaggaggtaacactgtatggcagagtttcgattcccaacggacactttcctgccgacgcagctcatcactgctgcgaccagattagtccccacaacccaatcgcgtagtcctggtaacaacatcttccgcttcagcgacctctcagtgctgccgcttaaataccacgtgcctccagtccccaacataactgggccagacccttgacagaacccctaccaggaagggccggaaccagtataaccattccaaggtttggaaagcttaccggaaagggggggggctggcctcaagggaatttccctgaagtgcccgga

SEQ ID NO: 81027 - protein, 175 aa, Zea mays
  misc_feature: Ceres CLONE 1566426
  misc_feature (83)..(174): Pfam Name: B_lectin Pfam Description: D-mannose binding lectin
MPRPLAALLSTACILSFFIALFPRAASSRDILPLGSSLVVESYESSTLQSSDGTFSSGFYEVYTHAFTFSVWYSKTEAAAANNKTIVWSANPDRPVHARRSALTLQKDGNMVLTDYDGAAVWRADGNNFTGVQRARLLDTGNLVIEDSGGNTVWQSFDSQRTLSCRRSSSLLRPD

SEQ ID NO: 81028 - DNA, 934 bp, Zea mays
  misc_feature: Ceres CLONE 1566429
  misc_feature: Encodes the peptide sequence at SEQ ID NO. 81029
tggagctccccgcggtggcggccgctctagaactagtggatcccccgggctgcaggaattcgtctcacccctagaaaaagaagacggttcgagtccgttctagaatctagacacggcaatgaagcccaggcctctcggttgcggttgcggttgcgtcccggcggcggtagggtgcgtcggctgggcatggaggccgactcctaggccgcgcgggggagggagggcagcaggggtgtcgcccaagtgctcgcactcggcggcggcggcgggagcggtacagtcggaggaccgccgccgcgaggtgctgtaccgcccggtggagctgcccgggacggggtacgggtctgagctggatgcgcggatcgagaaggtcatctacgcctgccgcttcatggccttcttcggcatttgtggcttgctcctcggctctgtcccatgcttcctcaaagtgctcgctcgcttcattgactgattcgcggatcatttcggctcccccccactccccactaatttgtgaactggagccttggatcctgcagggatgctttttcttgatggatgccctcctcaagtactaccggcacggcgcagggaaggtcatccccccggctgttggaaaccattggtaaccaatccgctcacctgacgcttgttcattcctcaaaatatcactgtcatggcgcttgctaacgcctgttatctttaaatctttgccacattggaacattgaacggcgatttcctctctggatgcccaaacttgtcttaaaatgggcaatgccccggaaggcttcctgctgtgcatgggccgtttccccccccagaaagtttctcatggcaacggacactttgtcttggaggaagggtttttcaaacccctcctcataaacgggaacccttttagggtcaaacccttttggcggtttaacactccg

SEQ ID NO: 81029 - protein, 117 aa, Zea mays
  misc_feature: Ceres CLONE 1566429
MKPRPLGCGCGCVPAAVGCVGWAWRPTPRPRGGGRAAGVSPKCSHSAAAAGAVQSEDRRREVLYRPVELPGTGYGSELDARIEKVIYACRFMAFFGICGLLLGSVPCFLKVLARFID

SEQ ID NO: 81030 - DNA, 841 bp, Zea mays
  misc_feature: Ceres CLONE 1566431
  misc_feature: Encodes the peptide sequence at SEQ ID NO. 81031
  misc_feature (741)..(741): n is a, c, t, g, unknown, or other
acccgcggtggcggccgctctagaactagtggatcccccgggctgcaggaattcgtctcacccctagaaaaagcagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacggcagacgaggagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagcttccgcgcctgcgtgccgctcgccacgcacgccgacatcgagccctacattgcgcgtatcgccgacggcgacacgtcccccgtgctcaccgccaagcccatcacctccatctccctcagctccggcacgacgcaggggaagcgcaagtacctgcccttcaaccaggagctcgtcaagtccacgatgcagatataccggacttcctacgccttcaggaacagggcgttccccgtggaggacggcaaggcgctgcagttcatctacggcagccggcagttcaccaccaagggcgggctgacngcgacgacggcccacaccaacgtgtaccgcagcgaggagttcatgcccacgatgcgcgccatccagtcgcaggtgtgcagccccggaggcggttgatctt

SEQ ID NO: 81031 - protein, 192 aa, Zea mays
  misc_feature: Ceres CLONE 1566431
  misc_feature (15)..(193): Pfam Name: GH3 Pfam Description: GH3 auxin-responsive promoter
MPEKEAQAAAFCGEAVIAEFESLTRDAAAVQRDTLRRILADNACAEYLRCRGLAGRTDAASFRACVPLATHADIEPYIARIADGDTSPVLTAKPITSISLSSGTTQGKRKYLPFNQELVKSTMQIYRTSYAFRNRAFPVEDGKALQFIYGSRQFTTKGGLTATTAHTNVYRSEEFMPTMRAIQSQVCSPGGG

SEQ ID NO: 81032 - DNA, 977 bp, Zea mays
  misc_feature: Ceres CLONE 1566432
  misc_feature: Encodes the peptide sequence at SEQ ID NO. 81033
  misc_feature (486)..(486): n is a, c, t, g, unknown, or other
ctccccgcggtggcggccgctctagaactagtggatcccccgggctgcaggaattcgtctcacccctagaaaaaattgcaggccccgccgtctccgtggggcgacctggaggaggtgctggcgcgcgcggcgaccaaggaccgcacggtgatcatgacgcagatcaacgcggcgtggacgcgcccgggctcgctgctggacctcttcttcgagagcttccgcacgggggaaggcggcgtggcgcgcctcctggaccacctggtcatcgtcaccatggacccggccgcctacgagggctgcagggccgtgcacagccactgctacttcctccgcacgggcaacgccgtcgactaccgatcagagaaggtgttcatgagcaaggactacctggagatgatgtggggacgcaaccgcttccagcagacggtgctggaactgggatacaacttcctattcacggacgttgacgtgatgtggtttcgcgancccgtcccgcacctctccatggcggggggaatcggcatctccagcgacgtgtacttgggcaaccccttaaccctgggcaaactccccaaaagggggtttcctcttcctggcgggcgtcggaaaaaaagggcccctttctcccgggggtgggaaccaggggcggtggggctttccgtggggaaccccaaaacagaacgggttccaccccccctaaacaccaaagaggggcccccgggtgggaacccccccctctcaagtttccctcaaacaacccaaattaaaggggttttttgccccctttcaaaagggggccctccaagggattgtcgcgcccccccccccccaaaattgtgttggttgggccttggggccaaaaatctacaaaaacctccggggggggcccccccatcgcggggagaaaaaaaaccccggcgggacaccaagaagaggaacgcccggggaaaaaattctctggagagaacacccccgcc

SEQ ID NO: 81033 - protein, 274 aa, Zea mays
  misc_feature: Ceres CLONE 1566432
  misc_feature (111)..(111): Xaa is any aa, unknown, or other
MTQINAAWTRPGSLLDLFFESFRTGEGGVARLLDHLVIVTMDPAAYEGCRAVHSHCYFLRTGNAVDYRSEKVFMSKDYLEMMWGRNRFQQTVLELGYNFLFTDVDVMWFRXPVPHLSMAGGIGISSDVYLGNPLTLGKLPKRGFPLPGGRRKKRAPFSRGWEPGAVGLSVGNPKTERVPPPLNTKEGPPGGNPPLSSFPQTTQIKGVFCPLSKGGPPRDCRAPPPPKLCWLGLGAKNLQKPPGGAPPSRGEKKPRRDTKKRNARGKNSLERTPP

SEQ ID NO: 81034 - DNA, 838 bp, Zea mays
  misc_feature: Ceres CLONE 1566436
  misc_feature (838)..(838): n is a, c, t, g, unknown, or other
ctccccgcggtggcggccgctctagaactagtggatcccccgggctgcaggaattcgtctcacccctagaaaaaatccttcgaccaaaacggcagctcctttctcccgcggcgttgccgtcgcactcgcacgcacgcactcaccgccggcctgagcctaatcctaatcctaatccacataccgggacaatccagacgaacgagcgaaccaacgcacggacggccaccagccgctgcgtgcgttcgctttcccccgaaacgtgacccgagccaagcttcagagagagaaaggagaagccgccatgaagcagcagcagctgcagctgcctcctagtcgtcccagttaaatccgtgctcgccaagccacgactacgagcacctgccccggtttttctcctcccgcccccgttccccgtcccgactcccgaccgacccaacccatatcagagattccttccttggtggcgctggcgttcccgtgaggcggcccgcgcgcgaaggcggccgtgaccgaccgtccggagcttcatgcgccaggggcggcggctccaccccgtcgtttgatgggcaacgcatgcggcggcgcccttagatcaaagtaccagcacagcttcaggcacgccggcgtcgtcgcaacggcacgccctcctccgaagtacagcgccagcgcccgtggcccgaagaactcgccccaggaagcccgccacagggggccccgccaaccacggaaaggccccaaggggccggtcggcccgggcaaacgggcaaccggccaacgcggcctccatataaaggcccccgcccggggggccccggggcccccccccccccgggaaacn

SEQ ID NO: 81035 - DNA, 809 bp, Zea mays
  misc_feature: Ceres CLONE 1566441
  misc_feature: Translation starting site: 191
ctccccgcggtggcggccgctctagaactagtggatcccccgggctgcaggaattcgtctcacccctagaaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaaagagttatcaaatcaggtgtagttccaagatttgtgcagttgctcacaagagaggatttgccccagctgcagttcgaagcagcatgggctctcacaaatattgcttctggcacttcagaaaatacaaagttggtattgatcatggggctgttcctatatttgtgaagcttcttgggtctgggagtgatgatgttcgtgagcaggctgtgtgggctttgggcatgttgctggcgattctccaaaggtcggggacttggttctggccaagggggcatggatgcctctggcaacccatttgaaa

SEQ ID NO: 81036 - DNA, 864 bp, Zea mays
  misc_feature: Ceres CLONE 1566444
  misc_feature: Encodes the peptide sequence at SEQ ID NO. 81037
  misc_feature (475)..(475): n is a, c, t, g, unknown, or other
  misc_feature (502)..(502): n is a, c, t, g, unknown, or other
  misc_feature (551)..(551): n is a, c, t, g, unknown, or other
acccgcggtggcggccgctctagaactagtggatcccccgggctgcaggaattcgtctcacccctagaaaaaactctgctctccttttcccctttctccgttcacctttctctcttcctttttctttcccctccctctccctttctttcctcctggcgacgactgggcgagtgccgccgaacttcgccaggtcttcaccggcgacgagcacctacaaggtgacactattccttttcttcacttggtgtataatctctctttgctccgatcaagcttttcaaacataataagcaaatagtctctgcacgtgattgccaaaattagtcaagacgggtgctctttgctgcgtggccgctaggccacatgggacaaagtctgaccctgctagcagagatcgttctatggatcctactgagcctcgttggcgcataaattcgagcttttctccctccacgtcaaggaggtgggattgccngctatcatcagatggattgccccacangagtcatgatgctcctcatgatcaccccgcatttgtttcatcactatcntcccatagcaaagagagccaaattctttttgccagggatcagtccctcaatcatcatcattctggatccgaaggagcccttctttcctttggggatcccgtttgaaccccttggggccccatctggaacccctcttttcaagaattgatcccgggaaatttctaccccccggggggggaataaaacccaaaacctttgaatttccctccccaaagggaagggcccttgctgcgccaagggggtttggtttctccccccccctttttggaaaaaacgccaaaaattttttttttaaaaaaaaagggccccctct

SEQ ID NO: 81037 - protein, 84 aa, Zea mays
  misc_feature: Ceres CLONE 1566444
  misc_feature (25)..(25): Xaa is any aa, unknown, or other
  misc_feature (34)..(34): Xaa is any aa, unknown, or other
MDPTEPRWRINSSFSPSTSRRWDCXLSSDGLPHXSHDAPHDHPAFVSSLSSHSKESQILFARDQSLNHHHSGSEGALLSFGDPV

SEQ ID NO: 81038 - DNA, 829 bp, Zea mays
  misc_feature: Ceres CLONE 1566446
  misc_feature: Encodes the peptide sequence at SEQ ID NO. 81039
ctggagctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatggggcgcgtcgaaggctaccgtatttgcggcgggccgctcggcgaggtcgtcgacccgctgtaccctggcggcagcttcgaccccctcggcctggccgacgaccccgaggcctttcgccgagctcaagggaaaggacctcaagaacggccgccttcgccaaggttttcatgttcgggctttcttcgtccaggcct

SEQ ID NO: 81039 - protein, 229 aa, Zea mays
  misc_feature: Ceres CLONE 1566446
  misc_feature (61)..(210): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGRVEGYRICGGPLGEVVDPLYPGGSFDPLGLADDPEAFRRAQGKGPQERPPSPRFSCSGFLRPG

SEQ ID NO: 81040 - DNA, 1025 bp, Zea mays
  misc_feature: Ceres CLONE 1566450
  misc_feature: SWISSPROT Homolog: EC 1.1.1.22 UDP-glucose 6-dehydrogenase
  misc_feature (41)..(41): n is a, c, t, g, unknown, or other
  misc_feature (51)..(51): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
tgggggccccgagagccacaggccctcttctcctcaccgtnctttttgcgncctcgtgttnnnnnnnnnnnnnnnnnnnccaaactggaactccccgcggtggcggccgctctagaactagtggatcccccgggctgcaggaattcgtctcacccctagaaaaaacaacacaccagacccgccccaattcgcaagacgcgagcgtctctcctcagtactctccacacgcaccgcggcaaggaaggacatacagagatcgccgctcctcttctctccggccgtggcgcggttgacctggcctcctcgagcgagatctcgctgcagaccctcgagatctggtcccatatcctatccccaccagatggtgaacatctgctgcatccgtgctgggtatgtccagggcccccccatgcaagccctaggacataagtgacctcacctccaagctgtccgggcagacatctgcgaccccggcgttgaggcatggaacacccacacactaccgatctacaaacccggcctctattatgctgtgaacaagtgcaggggcacgaacctcttctctaccactgatgttaataaccacgtcactgaggctgacatcctcctcgtcatcggtgaacacccccacccaggacgcgagcgctatggagctggcaaggctaactaacctcacataattggggagaccccctcctcaaaataagtcgccaaattgtatcccaatgtctggacaagaatcggtactccaattaaaacccacccggaccctgttttaagaccggcctgaaggctaatggacaaaaaactttttacccttcgaaaaggcaaggggctattccatttaccagaatgcctttatccaaacccgcgaattttccctggcccccaggggcgactgaattaatttgagggacccgtgttacaaggcccagaacagaagggttttctatcggggtggccccagggaacaaacccccctgaggggaacgtgaaaaagcccttcccagaggtttctccaagga

SEQ ID NO: 81041 - DNA, 1029 bp, Zea mays
  misc_feature: Ceres CLONE 1566451
  misc_feature: Encodes the peptide sequence at SEQ ID NO. 81042
ctggagctccccgcggtggcggccgctctagaactagtggatcccccgggctgcaggaattcgtctcacccctagaaaaactccacttctcaccactgccgtctccttcccaaacccggctgccgtctcctttgattccacggcttgccacgcagcagcagcaaaactcctagtcaacccttcaactcgcctactactcctactagcccgccccttcttttcttcgatctccgcaatctacagctttgcttctcccggctcgagcggctagggtttcaggagtgcgcggtgagacggcatgacaacgcggggagctaagcgcgcggccacctccgaccccgccgcacccgatttaccaagtaagagagtaatggacggaccctcttttgatgttcacagggcggagtcttcccatcagcatgtgatggcaggacccgctagtttagatcctcgggcgggcggaaggctgctagcaaacatgttgagggcacttaataacccagtttgcaaggctgggttccaattgccagctggcaaaaacatcccagctgaaactttgggaaggacgggccttaaggaattacatatcaccatgccttccgaaaatcccgggaaaaaattccgggggtggtgggccaccggggcttaggggaaaaattcaaggcggggtccaaaaaagtgggttttcaccccccaaagccccacgggaaaggagagaaaaaaggccaaattcgccccagcggggaaaaaaataggcaaacccctttttaaacccgcccaattttcaaaataaaaaaagagagggcccccaaattggggggctccaagagtttctaccccttttgaaaaaaaaaagaggttaccaaaaactttttttctccccgcccctcccccaaaaacaaccccatttctgggggggtgttttgtgcgcaaaaaaaaaaaacaccccgggggaaaagagaaaacaccctcccccctgggggggaaaaaaaaatatatttggggggaaagaaagagacccctttccca

SEQ ID NO: 81042 - protein, 92 aa, Zea mays
  misc_feature: Ceres CLONE 1566451
MDGPSFDVHRAESSHQHVMAGPASLDPRAGGRLLANMLRALNNPVCKAGFQLPAGKNIPAETLGRTGLKELHITMPSENPGKKFRGWWATGA

SEQ ID NO: 81043 - DNA, 803 bp, Zea mays
  misc_feature: Ceres CLONE 1566452
  misc_feature: Encodes the peptide sequence at SEQ ID NO. 81044
ggagctccccgcggtggcggccgctctagaactagtggatcccccgggctgcaggaattcgtctcacccctagaaaaagctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaagtagctcgctcgttggatggcagcgtacgtggccatcagcagcatgcagtcgtcgtcgtagcagagatgtcctagctacgtgtgtgtcatgcatcagactggccataataaaagagtagatcatgcacccactagtgatcacttcgtctagtgcccctcccgtccctggtgtcgtcgtcctcctccgggtggacctccgaacgtgaatgcccgaacca

SEQ ID NO: 81044 - protein, 126 aa, Zea mays
  misc_feature: Ceres CLONE 1566452
  misc_feature (36)..(122): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSGVRSLNSRASSAADRQATCNCLKSMTGRLGGGVSMANAANIPGKCGVSVGVPISPTVDCTKIN

SEQ ID NO: 81045 - DNA, 985 bp, Zea mays
  misc_feature: Ceres CLONE 1566453
  misc_feature: Encodes the peptide sequence at SEQ ID NO. 81046
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (359)..(359): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (936)..(936): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctggagctccccgcggtggcggccgctctagaactagtggatcccccgggctgcaggaattcgtctcacccctagaaaaatccgcgcactccacccaactcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgccctcacaggccnaccngnncccgacaggcctgtcgtctccgctacaaggccagcagggatatgttgtctaccgtgtccctgtgaaaccctggttggcaggaaaaggcttttgccccaaagggatttggcttattggcaaagccaaaaccccccgggggattcccccccagtccaaatttccaaaaggaaaaaaaaagggcctttttcccttaaaggaaaaaaaaacttggaacaaaaaacctttttgggggaaaacaaaggggggtttttaaaacacccccccaggggggggaaaaaaaaaagaaaaaaataaccccccccacaaaggaactttttttggaagaaaacctcccctttgttgggagggaatttttctccccccacaaaaagcccccctttaaaaaaaacaccccccccccccggggggaagaaaaaaacgcgggggggtatataataaacccccccctttgtgtggaaaaaaaaaaaaaacccccgggaggagagaccccccggggggggccccccccccccccccccgcggggggggggaaaaaaaaaaaaaaccccccgggggttttttcttctttgntgttgatagagggcgcccccccccccccccccctccccccaaagagaaa

SEQ ID NO: 81046 - protein, 65 aa, Zea mays
  misc_feature: Ceres CLONE 1566453
  misc_feature (44)..(44): Xaa is any aa, unknown, or other
  misc_feature (45)..(45): Xaa is any aa, unknown, or other
MGAYKYVSELWRRKQSDVMRFVQRVRCWEYRQQPSIVRPHRPTXXRQACRLRYKASRDMLSTVSL

SEQ ID NO: 81047 - DNA, 1176 bp, Zea mays
  misc_feature: Ceres CLONE 1566457
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (343)..(343): n is a, c, t, g, unknown, or other
  misc_feature (1176)..(1176): n is a, c, t, g, unknown, or other
accagcaggtactagggtaccagacgcagcggcggggacatcccttattattttnnnnggggnnnnccatactggactccccgcggtggcggccgctcttcaatagtggatcccccgggctgcttgtattcgtctcacccctagaaaaagaaatcgtctccccctcgcctcgcctagtataggaaggaagaacagagataagcgacaacgcgtccctcctcgccttcctcccgcctcgagctcttcccggagcaaccggagccacagacgtcaggacagcctagcgcgttccacgccggtatgcagaaccagatcatgggagatgattaacagacccatatgntctacacgagtggagcgtccagcaactgctgccggggttgggaggccatcaacaccgtggccgccgcaagatcgtgaaacggctccgccccccccgagaggggggggggaagtttgatgaaataaaaaccccccccggggccgggagggggaacgagagggggatgaggggaagagtgcggggacgggggggccacaaaaggcgcatggggcgtgtaggggcggggggaggggggaagggcggggggtggaggcatgaaggggaggccactagcggcagagggcgggccgagatgggaggattaagggggcgggtacacgaggagggaaaacagtgggggggcagcaaaggtataatgacacgcaagagggagcgttaaagccggaagggcggggtgatcacggaaggggcgggacaagtacagacgcgccctgtggggcgaaagcagtacaaggaccctaagtcaaggtccgcgggacaataagaagagatcgcgggcgacttcgtcaaggggcaagctgagatagcacgccgcggtaaggggggcacgcgagggagagagaaactcggacgatacgctcctgggacgacagatgtcaaagggaaacagcgccagcttagcaacaccacgcgaagctcatgttgcagcagacaactgagaccgcgaggtcagacttaaggggggtgggcgccacgcaccagtccggcggcggcgatgccggagccacgccgaagaataagaaggggcggaaacgctggatcagtggaagacaaggagaataggcagagagcgctgacgaaaccgacagagacagaccctctgtaaacacaan

SEQ ID NO: 81048 - DNA, 761 bp, Zea mays
  misc_feature: Ceres CLONE 1566459
  misc_feature (510)..(510): n is a, c, t, g, unknown, or other
ggagctccccgcggtggcggccgctctagaactagtggatcccccgggctgcaggaattcgtctcacccctagaaaaagttcccctccatcactccctcgcctcccccgctgtgccggcctgcacacacagacacacacaccacagcctacagcgcttctgctgctccagctcctcgtactaccgcgcccgcgcgctgctcgttccccggcctctgcttgcttggctcgtcgagcccagaggttggtggagaggcggggcttattgccccagataggagatcggggacgcgggagggcgcgtcgcgctcgggccggtctcggttcagcgggatcacttggccgtggccgtggtcgggcctccggcgcccatgtggtgagccaagccaggcttttgttgcccggggggcagagatcttgcacttgcagcagtgaagccggcggtgcggtccggtccggtcccggagccgagcggcgccccacgccatgggcggcagcgacgaagtcaaccngcacgagtgcaaagggggcggtgccgatccacacatggggtctcatctccaacttccaagctgggcgtacaacatgctccgggggggcgaaaggcaacttccgaccgcaaacctggccaaatttcctgaaccggggggggggggcccgaaaccccgggccccagaaagggggttccctcctttcaaccccgggaattaaaactttaaacccggctggaaaggcccaattttacgggggccccggcccaaaa

SEQ ID NO: 81049 - DNA, 980 bp, Zea mays
  misc_feature: Ceres CLONE 1566466
  misc_feature: Translation starting site: 271
  misc_feature: SWISSPROT Homolog: EC 5.2.1.8 Peptidylprolyl isomerase
  misc_feature (21)..(21): n is a, c, t, g, unknown, or other
  misc_feature (33)..(33): n is a, c, t, g, unknown, or other
  misc_feature (39)..(39): n is a, c, t, g, unknown, or other
  misc_feature (49)..(49): n is a, c, t, g, unknown, or other
  misc_feature (50)..(50): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (83)..(83): n is a, c, t, g, unknown, or other
  misc_feature (105)..(105): n is a, c, t, g, unknown, or other
  misc_feature (130)..(130): n is a, c, t, g, unknown, or other
  misc_feature (161)..(161): n is a, c, t, g, unknown, or other
  misc_feature (168)..(168): n is a, c, t, g, unknown, or other
  misc_feature (171)..(171): n is a, c, t, g, unknown, or other
  misc_feature (174)..(174): n is a, c, t, g, unknown, or other
  misc_feature (176)..(176): n is a, c, t, g, unknown, or other
  misc_feature (178)..(178): n is a, c, t, g, unknown, or other
  misc_feature (180)..(180): n is a, c, t, g, unknown, or other
aaaccccgggaacagcacganaccaagacaaanaggacncttaccccannttnnnnntttnntggnnnnnnnnccaaagcggnactccccgcggtggcggccgcnctttacaacaagaagcccccgggcngcattttcacaacgggcgcctagaaaaaaanccccccncgngcncncncncgaaccttctcccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaagtattgctagggccccccacactcccgaggtcggcgacgaggttgaagtgcattacacgggcaccctccatgatgggacaaaaggcgacgcaagccgggatcgtggagaacccttcaagttcaagcttggacaagggcaagtgataaagggttgggatcaaggaaacaagaccatgaagaaaggagaaaatgccaaatgtaccattcctccagagcgggcttaaggagcaactggggtcacctccaaccaccccaccccaaagcaaccctgcaagattgaaggtagaagctgctttccagggaccagcgggaaaagaacttttgccaaaagagggggggcaagttccaagaaagaacccttaaagaagggaagaaaaaagggggagaaacccaaagggaacctgaaggaaagtgcccggcggaaaaaaaaaaagcccccgccccggcaaaaagggtaaccggatgagaaaccaaaacccagagaggggggtcgcagaaaaaccaggggacaaaaaagggcaaacatgggggcgccggcgcccggagacaaaggagagc

SEQ ID NO: 81050 - DNA, 901 bp, Zea mays
  misc_feature: Ceres CLONE 1566473
  misc_feature: Encodes the peptide sequence at SEQ ID NO. 81051
ctccccgcggtggcggccgctctagaactagtggatcccccgggctgcaggaattcgtctcacccctagaaaaatccccgtctgccgtccaccacgcatcgccaagcgccatatctgcaggaagcaccgggccagacacgtcgcttcaccaccccaccccaccccaccccaccttccccttacaccaccaccgcaagccaagaggcacgtccacgcatgggtttcccggcgggctactcggagctggtgctcccgaagcagctgctccacctgctgctgctgctggggtacgtccgccgcttcctcctctgggcgttcgacgccgtgggcctcggcgacctgctggatctcggggacgaccaccaggcgccgccgccgccgcagcagccgcagccgcagcagcaccggcgggcggagttccgggcggccatgccggcgatggtcatcgaggaggccctccccgtggcgcggttcgacgagctggaggcgcgcgtcgtcggcggggactgcgcggtgtgcctcggcggcatcggcggcggcgacgaggtgcggcggctcggcaactgccgccacgccttccaccgcgcctgcctcgaccgctggatggagcacgaccagcgcacctgcccgctctgccgcgcgccgctcgtccccggcgcgctctggcccgccgacgcctccgacctggacttctcctacctcggcgcgcccgtgccctccccgacgctgctgcggccgcacgagctgctgctgctcgcgggcctgggcggatactgagctcaccgccccgactggcggggaagccactccccccgtgcgcatgcgctgccgggaaacgctgaatccgtccgccatcgacgctcggctcgctcccgttccgtccgtgggagggagcagaagc

SEQ ID NO: 81051 - protein, 186 aa, Zea mays
  misc_feature: Ceres CLONE 1566473
  misc_feature (98)..(140): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MGFPAGYSELVLPKQLLHLLLLLGYVRRFLLWAFDAVGLGDLLDLGDDHQAPPPPQQPQPQQHRRAEFRAAMPAMVIEEALPVARFDELEARVVGGDCAVCLGGIGGGDEVRRLGNCRHAFHRACLDRWMEHDQRTCPLCRAPLVPGALWPADASDLDFSYLGAPVPSPTLLRPHELLLLAGLGGY

SEQ ID NO: 81052 - DNA, 846 bp, Zea mays
  misc_feature: Ceres CLONE 1566475
  misc_feature: Encodes the peptide sequence at SEQ ID NO. 81053
  misc_feature (184)..(184): n is a, c, t, g, unknown, or other
  misc_feature (539)..(539): n is a, c, t, g, unknown, or other
ctcaccgcggtggcggccgctctagaactagtggatcccccgggctgcaggaattcgtctcacccctagaaaaaacggagagtcctggtggccgtgcgggcactgtgcgcccgtggaggtgtcgtgtctcggtgcccacacgacaacgacgctcctctgcacccccgtctctacaagtaccacnctggctgaactccagtttcccgacgccattccacgtatctcttgtttaggccgggctcgagagagttgggctccgaatcctgggtgggtttggagttggagaatcgccttcgtcgctcgacccagaaagattcgatggagagccacaacccatcgcactctcagatcgccgaagtgacgatggacatcgcagcgtcagcttctggagcggcagggagcaagttctgcaagggcgcagcctgcgactttctcgacggcaagcactcctcgaaagacgccaggggagaagtgcgggcttcaatgaagaaagctggatagtccccgggggtccctctgcgttcggaattcattgcccnttgaaagtttggttgggggggcattaaaggggaaaaaagcccttggccattcctgaaccgaaagcgggggaaccccttcctgttttgaaaaatgggggggggtttttcccccaatcccgcctgtttttccccccccttggggcccccccgggggggggggggggaaaaaccccccccgggaaaactctaaaaggggggtttcttcccgggggggggagaaaatacctctgggggggccccccctttttttctatataacaaagagtcttaattagtggggggtgtctccccccgggcggataaacga

SEQ ID NO: 81053 - protein, 60 aa, Zea mays
  misc_feature: Ceres CLONE 1566475
MESHNPSHSQIAEVTMDIAASASGAAGSKFCKGAACDFLDGKHSSKDARGEVRASMKKAG

SEQ ID NO: 81054 - DNA, 999 bp, Zea mays
  misc_feature: Ceres CLONE 1566476
  misc_feature: Encodes the peptide sequence at SEQ ID NO. 81055
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
tctccctcatttctttttccctgaatctccttcttccctctattttggngnnnnnnnnnntattttttttgaaaactggagctccccgcggtggcggccgctctagaatagtggatcccccgggctgcaggaattcgtctcacccctagaaaaagagaacttgactgtctgccctgtttgcaggcactcgtcttcttcctggagagaaaaagcagaatacaatacatagatgtccaagatggcggaggagaaggcggcggcagtgggcggactcggaggagccggggcggcggacgcggcgcagcagaatcagctggcatcaggggaggccgcggcggctcgggtgcggcccgtggaaacgctgcttctcgcggcaacgctggggctctgcttggccaccatgaccgtcatgctacgtaacctgcacagcaacgagtatggcgccgtcgcctactccgacctgggaggcttcaactaactcgtctacgccaactgtctctgcgccgcctactcgctggtatccgcgttctacaatgccgtgccgtagcctgccaccgagtcgagctcctggctcgtcttcctcctcgaccaggtgttcacgtacctgatcctggcggcaggcgcatcggcggcagagctgctgtacctcctctacagctgtgacaaaggagtgcacctgcagtgaagcttgccgcgtttttcagctggctcttgcccgtcagcgtcgcaccttgcgttggcatttgattccggcaccggtcccctgtttccatcctcctggtccctcatctgcttcgtacccgcattttaaacgcctaagaagacgcccccccccggtcggggcctctgaaaccaagggggttcgagaaagcccgaccttcaccacgctgaaagctccctgaaggggaggccctcgtttgcaaattcccccgttttgtccaatgtccaaccatgtaaaatagtgggttaatccaaaataatcctctccctggaaagaga

SEQ ID NO: 81055 - protein, 82 aa, Zea mays
  misc_feature: Ceres CLONE 1566476
MSKMAEEKAAAVGGLGGAGAADAAQQNQLASGEAAAARVRPVETLLLAATLGLCLATMTVMLRNLHSNEYGAVAYSDLGGFN

SEQ ID NO: 81056 - DNA, 820 bp, Zea mays
  misc_feature: Ceres CLONE 1566478
  misc_feature: Encodes the peptide sequence at SEQ ID NO. 81057
acccgcggtggcggccgctctagaactagtggatcccccgggctgcaggaattcgtctcacccctagaaaaatactgttccctgggattggctttgggcttttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtcctcgagtgcaaaggcagaagggagcttgactgcaagactcacccgtcgagcagagacgaaagtcggccttagtgatccgacggtgccgagtggaagggccgtcgctcaacggataaaagttactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctggtgtaccagttatcgtgcctacggtaaacgctgggtagccaagtgtggagaggataactgctgaaagcatataagtagtaagcccaccccaagatgagtgctctctcgtgccacacatccatccccgttcgcctct

SEQ ID NO: 81057 - protein, 38 aa, Zea mays
  misc_feature: Ceres CLONE 1566478
TRGGGRSRTSGSPGLQEFVSPLEKYCSLGLALGFSCAA

SEQ ID NO: 81058 - DNA, 867 bp, Zea mays
  misc_feature: Ceres CLONE 1566479
  misc_feature: Encodes the peptide sequence at SEQ ID NO. 81059
  misc_feature (256)..(256): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (270)..(270): n is a, c, t, g, unknown, or other
cccgcggtggcggccgctctagaactagtggatcccccgggctgcaggaattcgtctcaccccctagaaaaaattgtgtggcctggcttccgttccgcccgccgaggccagtgtggcaggcagctcccgcgcgagcgccagcgcgatccagaggctggcgcacctgcgtcactcgctccgcgctgccgcgatctcctctgacgtcgaagtcgcccgggggatgacacagggggaaggggtggtgtggggaggggtnaacnnnnnnctccncgactgctgggcgggctgccggatggaggagcgcgcgttcggctcccgagccaggaggagttcttccggaggcgcatgggggcacagcgtaggcccggtgttccgcaccaacatcccggccaccttctccttcttcggggggcgtggaccctcgcgttgtccccatcatggacgcagcccgcttcccggcgctcttcgaccgggaccttgtggacaagcgcgacatccctcatggggcctattacccgggtgccgggtttcaccggcggggaacgggctttggcgtgttccttcgactcttaggaagaagaaacacttcgcttctatcagaacctttgcccatggacctttcttccgacggtttcggcgcgggacttggttcgtctcacttcccgcgggggacgggtggcccccatcttggaaccccccgggacaccgtatctcccccagggtggaggggcgggccacaaaaaatccttcacccagctaactgggatccccgtggggggcgtagcatcttttcgcggtttccttttgaaagggaattcggtgggggggggaaacccgggcccccaaaaggggtggggggacaaaccg

SEQ ID NO: 81059 - protein, 143 aa, Zea mays
  misc_feature: Ceres CLONE 1566479
MDAARFPALFDRDLVDKRDIPHGAYYPGAGFHRRGTGFGVFLRLLGRRNTSLLSEPLPMDLSSDGFGAGLGSSHFPRGTGGPHLGTPRDTVSPPGWRGGPQKILHPANWDPRGGRSIFSRFPFEREFGGGGKPGPPKGVGGQT

SEQ ID NO: 81060 - DNA, 886 bp, Zea mays
  misc_feature: Ceres CLONE 1566480
  misc_feature: Encodes the peptide sequence at SEQ ID NO. 81061
  misc_feature (731)..(731): n is a, c, t, g, unknown, or other
  misc_feature (791)..(791): n is a, c, t, g, unknown, or other
  misc_feature (855)..(855): n is a, c, t, g, unknown, or other
ctggagctccccgcggtggcggccgctctagaactagtggatcccccgggctgcaggaattcgtctcacccctagaaaaatagaaaaaaaaaaatacactacgaccaccaccaagcgaacgaaccaacgatcgacgctccccgaccagcgtggtgaacaggacagcagtcagcagccaatggaggcagcactgacgcagcaggcggcagcgacggcgacggcgacaccgacgaggtggcggtgcgtgggggacgcgtcgctggctagccatggccagggccagcagcgagcaggcgccgtccggctcggagcggcgcggcgtgcggtcagcggggctgtccgggctagcagcagcaggcatctgggccccgtgcgggcgctcgtctccgaggccgccggcggcgagcgggcggcggagggcgagggaatggacaccgcggtgaggctgttcgtgggcctccccgcggacgcggtggtctccgacggccgcggcgtgggccgccccagggccgtctcggcggcgctgcgcgcgctcaagctgctcggcgtcgacggcgtggagctgccggtgtcctgggccgtcgcgcagcccgggcccgggggctggttcgagtgggccgggtaccgcgccgtcgccgccatggtccgcgacgcggggctcgacctccgcgtctcgctccgcaccgacggcgaccgctccccgggaatgggttggccgacgcggcggccgncttaccccgacgtcctcttcatcgaccgctcctgccaccgccgcatgtgctgcctctccntttgcgtcgacgagctccccgtgctcgtcggcaagtcgccgctccaggcctacgaagccttctncgcagctttgctgaagagtcgatgaactgtt

SEQ ID NO: 81061 - protein, 233 aa, Zea mays
  misc_feature: Ceres CLONE 1566480
  misc_feature: SWISSPROT Homolog: EC 3.2.1.2 Beta-amylase
  misc_feature (185)..(185): Xaa is any aa, unknown, or other
  misc_feature (205)..(205): Xaa is any aa, unknown, or other
  misc_feature (226)..(226): Xaa is any aa, unknown, or other
MEAALTQQAAATATATPTRWRCVGDASLASHGQGQQRAGAVRLGAARRAVSGAVRASSSRHLGPVRALVSEAAGGERAAEGEGMDTAVRLFVGLPADAVVSDGRGVGRPRAVSAALRALKLLGVDGVELPVSWAVAQPGPGGWFEWAGYRAVAAMVRDAGLDLRVSLRTDGDRSPGMGWPTRRPXYPDVLFIDRSCHRRMCCLSXCVDELPVLVGKSPLQAYEAFXAALLKSR

SEQ ID NO: 81062 - DNA, 878 bp, Zea mays
  misc_feature: Ceres CLONE 1566481
  misc_feature: Encodes the peptide sequence at SEQ ID NO. 81063
  misc_feature (711)..(711): n is a, c, t, g, unknown, or other
gcggtggcggccgctctagaactagtggatcccccgggctgcaggaattcgtctcacccctagaaaaagtcatccactccgccgcacaggcgctcagctccgcaacgccgtcggaaatggtcgccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctctgggaggagggtcccaacagcttccagccctccgaccccgttctcaccatggccgtggacagcggactgaaggatgacttggtttttggggacccaaacgcgccgcgtttcgtgctgtgggaggggaagctgaggcccgtgccatccaagcccgccgacctcccgttcttcgatctcatgagcatcccagggaagctcagggccggtctaggcgcgcttggcatccgcccgccctcttcaggccgcgaagagtcagtggaggagttcgtgcgccgcaacctcngtgctggagtctttgagcgcctcattgaggcctttctgctcaggggtctatgctgggggacccttctaagctcaccatgaaggctgcatttgggaaagtttggccggtggaaaaaaccgggaggaataattattgtggggaaacttcccagacaatttcggagagga

SEQ ID NO: 81063 - protein, 224 aa, Zea mays
  misc_feature: Ceres CLONE 1566481
  misc_feature: SWISSPROT Homolog: EC 1.3.3.4 Protoporphyrinogen oxidase
  misc_feature (199)..(199): Xaa is any aa, unknown, or other
MVAATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNSFQPSDPVLTMAVDSGLKDDLVFGDPNAPRFVLWEGKLRPVPSKPADLPFFDLMSIPGKLRAGLGALGIRPPSSGREESVEEFVRRNLXAGVFERLIEAFLLRGLCWGTLLSSP

SEQ ID NO: 81064 - DNA, 849 bp, Zea mays
  misc_feature: Ceres CLONE 1566482
  misc_feature: Encodes the peptide sequence at SEQ ID NO. 81065
ctggagctccccgcggtggcggccgctctagaactagtggatcccccgggctgcaggaattcgtctcacccctagaaaaaaagcctgtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcggttgcccacgtcggcaatggtcgtccccctacggcgcccttctttcgtccctgcccggctccgggaacccccgggcggcgggacctaccccaaaggaaaaaactggggcaaaaaactcccgggggaggggggggttaaaaaggcaggggtcccaaaaaacccaccctccccaagggggcccaaggggtgcccccccccccccgggggggggggaaaaggaaaaaaaccctgggccccccctgggggaaaaacccgcgggggggaacccccctcccggggtggcgtttgggcccgggaaaaaaccccccttaaaaaaaaaatttttttttcccccccccggcggggggttctcccctgtataaaaaaacacacgggtgaaagaggggttgctcctgtagaaaaaaacacccccccctttttattggggggccccctgtttttttcccccccccccaattttaataaaa

SEQ ID NO: 81065 - protein, 119 aa, Zea mays
  misc_feature: Ceres CLONE 1566482
  misc_feature (54)..(93): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSAALSTAANPTQLYRSRASLGKPVKGLGLSMGRERAQRSIVCQAASSISADRVPDMEKRKLMNLLLLGAISVAHVGNGRPPTAPFFRPCPAPGTPGRRDLPQRKKLGQKTPGGGGG

SEQ ID NO: 81066 - DNA, 842 bp, Zea mays
  misc_feature: Ceres CLONE 1566483
  misc_feature: Encodes the peptide sequence at SEQ ID NO. 81067
  misc_feature (520)..(520): n is a, c, t, g, unknown, or other
  misc_feature (633)..(633): n is a, c, t, g, unknown, or other
  misc_feature (645)..(645): n is a, c, t, g, unknown, or other
ggagctccccgcggtggcggccgctctagaactagtggatcccccgggctgcaggaattcgtctcacccctagaaaaacgttcagaccgcccgattcccgttcccgcatcaccttcctccaccaccgcctcccacattcttcgcatccccttatacttttttgtccttctatcgtcgtcgatccgggctcctgttttgcccgcacgcaggctggttgccaagaaagacagggcgagtgcgcggcgcccagctccgaccgtgcttcatagctcatctggccggggacggggatattcgcgttgctcgcttgcccggcgggtagctgtagcctgtaggcgagaatcgggaacgggggtgtttacaggccatgaagtataacacgaggaaagacgcgagcggtggcggtggcggcgcgccgtttgccgtcccatgcgtcgacatcaagtcgttcgtgggctcgctcgccttcctcacgctgttcgtcgtgttctggcagctccagccctacggctccgtgctncacgcggctcgcacctccgcctcgcccccttgcaccctcctccccacaccgctgtcatcgacctcgcctctcctgataccaacagcagcactgccgcaaagacggaccaaccngcgggcggcgcngcggcggctgtttcaactactgccgcaagccgcaatgctgcccccggtgtggtgggcaaaagcaacgaagcccggcccggccgggagaatctaaacaagcgcgtggttccggccctaacggtaagcccggcgggcgctgtttcttgcaaaaaggggggcctaccggggggggggccccggaaaatttccccatcgga

SEQ ID NO: 81067 - protein, 123 aa, Zea mays
  misc_feature: Ceres CLONE 1566483
  misc_feature (89)..(89): Xaa is any aa, unknown, or other
  misc_feature (93)..(93): Xaa is any aa, unknown, or other
MKYNTRKDASGGGGGAPFAVPCVDIKSFVGSLAFLTLFVVFWQLQPYGSVLHAARTSASPPCTLLPTPLSSTSPLLIPTAALPQRRTNXRAAXRRLFQLLPQAAMLPPVWWAKATKPGPAGRI

SEQ ID NO: 81068 - DNA, 918 bp, Zea mays
  misc_feature: Ceres CLONE 1566485
  misc_feature: Encodes the peptide sequence at SEQ ID NO. 81069
  misc_feature (851)..(851): n is a, c, t, g, unknown, or other
  misc_feature (890)..(890): n is a, c, t, g, unknown, or other
ggagctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaggcgtttgcggcctatggcaagctccgccttgagcggatgaacaagaagcacctcggtgcccgccagaagaatgcagctgatgcagagatgtagacatgagtgaagcagcaaactttgtagcctgtttttgtctgtcagtcatagcgagatgctactccatcagtgnctgttccaggtttttttgggtgctggaaatgagacagtncaaaatttttggttcctactggttgaaa

SEQ ID NO: 81069 - protein, 204 aa, Zea mays
  misc_feature: Ceres CLONE 1566485
  misc_feature (6)..(185): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTYKAKLVIFPRRARKVKAGDSTLEELTTATQVQGDYMPITRGEKRSVEVVKVTDEMKAFAAYGKLRLERMNKKHLGARQKNAADAEM

SEQ ID NO: 81070 - DNA, 1041 bp, Zea mays
  misc_feature: Ceres CLONE 1566487
  misc_feature: Encodes the peptide sequence at SEQ ID NO. 81071
  misc_feature (65)..(65): n is a, c, t, g, unknown, or other
  misc_feature (66)..(66): n is a, c, t, g, unknown, or other
  misc_feature (120)..(120): n is a, c, t, g, unknown, or other
  misc_feature (122)..(122): n is a, c, t, g, unknown, or other
  misc_feature (127)..(127): n is a, c, t, g, unknown, or other
  misc_feature (148)..(148): n is a, c, t, g, unknown, or other
  misc_feature (149)..(149): n is a, c, t, g, unknown, or other
  misc_feature (161)..(161): n is a, c, t, g, unknown, or other
  misc_feature (162)..(162): n is a, c, t, g, unknown, or other
  misc_feature (164)..(164): n is a, c, t, g, unknown, or other
  misc_feature (167)..(167): n is a, c, t, g, unknown, or other
  misc_feature (169)..(169): n is a, c, t, g, unknown, or other
  misc_feature (172)..(172): n is a, c, t, g, unknown, or other
  misc_feature (208)..(208): n is a, c, t, g, unknown, or other
  misc_feature (289)..(289): n is a, c, t, g, unknown, or other
  misc_feature (302)..(302): n is a, c, t, g, unknown, or other
ggagggggaggggaggggaacaaaaaaaaaaagggaaagagaggaaagggcgaaacaaaaaaaannaaaaggaaagaggaagacagggggggggtggccactttcaaaggagggggagcncngggcnaataacggaggaagaagggcnnagaaaaaaaccnncnccncnccngcccgggatttttcccccgagaggggggggcagccngacgaaaagcgcggcgacaggaagggcagccgccgaaaggcggggcccacgccgaccgcggcgccggcgaagaggacccancaagagaaggagnagagcgacgacccaaaacccacgcagacggcgaccgccgcgaaaccggagaacgcgctgaagagagccgaagaattaatccatgatgggcaaaagcaggcagccctgcaggctgaacaggatctcaacaccacgaaaagggacagggcagggcagaagcctctcgaaaagatcaagaagaagtatggagaactcggtgaggacctgaggaaaggcagaaatgcaaaagatggccgaagacaggataggatggtcagccagcaagaaaacgggtcagaccagggaggaaggcataaagcactcacatgcaagctccccaaaaggagaaagctggaacaaggcgagagagtccaggaccgaaagcactgggaaaaaggcaacggggaagttcgaaagaaaccggggaagcaaggacaaaggcggtgccccaaagaggacccgccagggcgccagggaattggaccaaggggggggaggaaaagggaaaagaggacccgaaagcagaaaaaaagaaggggtgggaaaacccccaatgggggcgaaagggtccccaccgggggaagaaccaaaccggggagaccgggcccaagaagataagccaagggaaacaaaatcaaaaggccaggaaagcgcgcagaaggccaaaggaacggcccaaaaaggggggaagcacaaggccggaagaaaacggaaacagaaagaaccaacccgaaactccccgaagagggagaggtaaagaa

SEQ ID NO: 81071 - protein, 298 aa, Zea mays
  misc_feature: Ceres CLONE 1566487
  misc_feature (22)..(22): Xaa is any aa, unknown, or other
  misc_feature (40)..(40): Xaa is any aa, unknown, or other
  misc_feature (41)..(41): Xaa is any aa, unknown, or other
  misc_feature (50)..(50): Xaa is any aa, unknown, or other
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (96)..(96): Xaa is any aa, unknown, or other
  misc_feature (101)..(101): Xaa is any aa, unknown, or other
EGEGRGTKKKREREERAKQKKXKGKRKTGGGWPLSKEGEXXANNGGRRAXKKTXXXPARDFSPERGGQPDEKRGDRKGSRRKAGPTPTAAPAKRTXQEKEXSDDPKPTQTATAAKPENALKRAEELIHDGQKQAALQAEQDLNTTKRDRAGQKPLEKIKKKYGELGEDLRKGRNAKDGRRQDRMVSQQENGSDQGGRHKALTCKLPKRRKLEQGERVQDRKHWEKGNGEVRKKPGKQGQRRCPKEDPPGRQGIGPRGGRKREKRTRKQKKRRGGKTPNGGERVPTGGRTKPGRPGPRR

SEQ ID NO: 81072 - DNA, 906 bp, Zea mays
  misc_feature: Ceres CLONE 1566488
  misc_feature: Encodes the peptide sequence at SEQ ID NO. 81073
ggagctccccgcggtggcggccgctctagaactagtggatcccccgggctgcaggaattcgtctcacccctagaaaaactccgccgcctacgcgcccaacacgtccccgtccagattcatccacccttccccttcgtctcaactccctccatccaatccaccccctctcccccttctcgtcgtcgccgccgccgccgcccacccggggcttggactgtcctttccccgttctgctggtagtgggtggatgcgtctttgactgcccggcgcccgcccgcaccccgcagcagcaatggacgacggggacctggatttctccaacccggacacgtacctgtgtccggccctcggcaccgacccgcccagcagctgctccatggacagctacttcgacgagatcctcaaggacacggagcacctcgcctgcacgcacacccacacctgcaacccgccggtgcacgacctctcgcacacccacacctgcgtccacgtccataccaagatcgtcgcggcctcgccgggcgacgccgagtcgccgtccgagaacaacagcaacggcaacgccgcctctaagaagcgcccgtcgggtaaccgcgcccccgtcaggaagtaccgggagaagaagaagcccacaccgcatcgctcgaggaggaggtggtgcacctccgggcgcctcaccagcagctcatgaaaaagctccagagccacgccgcggctcgaagcggaggcggccaggctccgctgcctgctcgtcgaactcaggggcaggatccgagggggagatccgttgcgttcccgtatcagaggccgccggccgtcaagaacgttgaacctcctggcctagtgttgaacaaggaaagcctccttggaagcgcctgtctgcccaagttggccaactcttggtga

SEQ ID NO: 81073 - protein, 132 aa, Zea mays
  misc_feature: Ceres CLONE 1566488
  misc_feature: The sequence is a functional homolog of SEQ ID NO 208 in the 10/225,068 US patent application
  misc_feature: The sequence is a functional homolog of SEQ ID NO 2360 in the 10/374,780 US patent application
  misc_feature: The sequence is a functional homolog of SEQ ID NO 372 in the 10/412,699 US patent application
  misc_feature: The sequence is a functional homolog of SEQ ID NO 863 in the 11/479,226 US patent application
  misc_feature: The sequence is a functional homolog of SEQ ID NO 1707 in the 11/479,226 US patent application
MDDGDLDFSNPDTYLCPALGTDPPSSCSMDSYFDEILKDTEHLACTHTHTCNPPVHDLSHTHTCVHVHTKIVAASPGDAESPSENNSNGNAASKKRPSGNRAPVRKYREKKKPTPHRSRRRWCTSGRLTSSS

SEQ ID NO: 81074 - DNA, 852 bp, Zea mays
  misc_feature: Ceres CLONE 1566492
  misc_feature: Encodes the peptide sequence at SEQ ID NO. 81075
ccccgcggtggcggccgctctagaactagtggatcccccgggctgcaggaattcgtctcacccctagaaaaaaccactcaccacagtctccagtctccactgcatctaaaaaaaaacgtaaaacccccaccacgccgtagcggagagaagagaagagaggagcgcgcgatcgatgtcgggctccggcgatcgtcgcggcggcggtcctccgggttcccatagtggctgggaaaccatggggaagaagtcgaagaaacccgggcaagccggggggagacagtgggcaccatggagttccacaaatgtgacacctaacacagcaaggccagcatggggtggcagtggttcctcgcacccttctggaaccagctgggctcaagctccagatcatggtgctgctaccagaggcaatcctagaccgccatcacaaacatcgcgccctgttctggctccacctctggcaaatggttggcagtggcaatccaggcctcgcccatctggatctgaagtcaagaaggatgatgctcctccatctggttctgtccctgaggtggagaatgttgatggcaacaatacatcagatgatgatgatgatgatgacgatgatttgagtgatgatatcagtgatgactatgattctgacgcaagtgagaaaagttttgagactctgaaaacgagcaagtggttcaaagagttctttggagtattggatacattgaggttgggaacaaataaatgaacaaactcggcaatggcattgcccggcatgcaaaaatggacctgggggcgattgactgggtacaaaggcctgcagccttttatgggatcatgcctagaaccaagggttcttcc

SEQ ID NO: 81075 - protein, 188 aa, Zea mays
  misc_feature: Ceres CLONE 1566492
MSGSGDRRGGGPPGSHSGWETMGKKSKKPGQAGGRQWAPWSSTNVTPNTARPAWGGSGSSHPSGTSWAQAPDHGAATRGNPRPPSQTSRPVLAPPLANGWQWQSRPRPSGSEVKKDDAPPSGSVPEVENVDGNNTSDDDDDDDDDLSDDISDDYDSDASEKSFETLKTSKWFKEFFGVLDTLRLGTNK

SEQ ID NO: 81076 - DNA, 898 bp, Zea mays
  misc_feature: Ceres CLONE 1566493
  misc_feature: Encodes the peptide sequence at SEQ ID NO. 81077
  misc_feature (789)..(789): n is a, c, t, g, unknown, or other
  misc_feature (847)..(847): n is a, c, t, g, unknown, or other
ctggagctccccgcggtggcggccgctctagaactagtggatcccccgggctgcaggaattcgtctcacccctagaaaaaatcggtcgaccagaccaaccgagcagttggggtgaacgaaccgtggatcgacgtcgtactcgtacgtacgtacgtactgtacgtgacgatggatagctcatcggacgctcacgggcgtcacaggtgcgcggcgtgcttccggcagttcaacaagatggagcacctggtggagcacatgcgggcggcgcggcactcggggcacgagccccgctgcgacatctgccgcaagcactgccgctccttcgaggcgctcagggaccacctcggcgtcggcggctccacgctgcccaaggccgccagctgcgccgacgccttcgccgcgcggggctgcgccatctgcctccgcgtcctcgccggcgccggcgccgcgtcgctcggagcccaccgcgcggcgtgccggctctcgcgcaccccgccgccgagggcgcagcagctgcatcaccggacgcagccgcaaggaggcgcgctcgcgctgggctgcaagatggtcggcgccggcagcgacggatccctggacgtgtgcgcgcgggtgtgcgtcatcgacgagcaggagaacgtcctgttcgaggccttcgtgaggccgctccttcccgtgacgcactaccggtacgagacgacggggatccggcctgagcacctccgcgaccgcgcgagcgtgactgtgaagagcgcgcatcgcccggtggaggagctgctgctcgacgcaggnaaacccctgggagggcgcgcatcatcctggtgcaagtcccgccctgctgggtcgtccncggttctcgaacaactacctccacgccgctgacattggacttaccggtccc

SEQ ID NO: 81077 - protein, 236 aa, Zea mays
  misc_feature: Ceres CLONE 1566493
  misc_feature (227)..(227): Xaa is any aa, unknown, or other
MDSSSDAHGRHRCAACFRQFNKMEHLVEHMRAARHSGHEPRCDICRKHCRSFEALRDHLGVGGSTLPKAASCADAFAARGCAICLRVLAGAGAASLGAHRAACRLSRTPPPRAQQLHHRTQPQGGALALGCKMVGAGSDGSLDVCARVCVIDEQENVLFEAFVRPLLPVTHYRYETTGIRPEHLRDRASVTVKSAHRPVEELLLDAGKPLGGRASSWCKSRPAGSSXVLEQLPPRR

SEQ ID NO: 81078 - DNA, 1149 bp, Zea mays
  misc_feature: Ceres CLONE 1566494
  misc_feature (55)..(55): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (795)..(795): n is a, c, t, g, unknown, or other
  misc_feature (1149)..(1149): n is a, c, t, g, unknown, or other
tttggtttttttatttaccccacaccaccggcacagttaaaacataatctccccnggcgccccnnncccnnnnnnnnngcaagctggagctccccgcggtggcggccgctctagaactagtggatcccccgggctgcaggaattcgtctcacccctagaaaaaaggtcggtcctacacggtcccgttctgcctggtgcctgcaacctgccttttcttcttgcgtcgccacccagcgtgctctctctccctctttctctctctctcgtggcggcccctgggcagccgttgctgccgcctgcgctaggtgccagggcttcttcgggccctgccccgcgcgacgagagcccccgggttgtacatgggtacaccccggtgctgtactgggtcggattctgctagtgctccgtaccaagggcatctccatacacctgctctgtatacactcctcctgttcaggcgggtcaacatacccccccctcaccaccgggcgccccccccgggggagtcctccgttcaatctagtaagcccgaggtgcaacgccccgtggcggtggatgagtgccgcctctgctctcccctcccccagtcgtagctccgtccaaacttccgctcggccacagagtgccctgggtgtcgtcggacacaatatcacgggacaaacatggcatgcgtgtaacagcccctttgtctttgctcgtaaggaaagattgtgctgggagccccgaaggcaaacgattcgtgttattagaactgtctgacctgccattacctcgagggcagcgatagtaagggcncatgaagcggatgattttttgcgtggttattttgttcggtgccgcggacgtctacgcgctcgccgcttctccactctgtttgtggtagacgccagaaggagcacgccgtgttttgagcctcctgctggtcgcatgatgcgtgaggacttgcgcggttgtctgtaattgtcccgccgtcagagctggtcgggtcatacacatgcgtcgtttgtcccactgttcggtatctgtgtgccccgtagtctcggtattgtacttctggtcgtggttgtaaccaaaaccgtcagacctcgccggcatctccaccaccccacgtatagcatctctagagatggttgcaactccctcctatcn

SEQ ID NO: 81079 - DNA, 835 bp, Zea mays
  misc_feature: Ceres CLONE 1566497
  misc_feature: Encodes the peptide sequence at SEQ ID NO. 81080
ctccccgcggtggcggccgctctagaactagtggatcccccgggctgcaggaattcgtctcacccctagaaaaatccagcggcatccgccacttcgtcgtcgtcgtcgcacggattggcattggctgccccccggccctgttcctcgtcctcctcatcaattcccgtctctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcggcagatttgtcaagacgctgtatttcttcaacgggcctccagaactttctcagattgtagaatctatcatcagcagtttcactggaccctgcttctagtggaattgccaaagaaaatgggaaccttcggaagggggggctgggtaccgggaaaccacccgttggtttttgggcaaacgggggggtgaaattcctctgcaaaaaaaagggaatacccgttttcaaatatttggctttaaaattttaaacaaaggcaaggggccactatttggggggcccgaaattaccccctcaataccttggggaaaaatttttcccaagaagaaaaaaaacccctttgattccctcaagcttttttacaagggggggagaaaaaaaaaa

SEQ ID NO: 81080 - protein, 106 aa, Zea mays
  misc_feature: Ceres CLONE 1566497
MNCSSCCAAATPSSPALLARPRGGLAASCSTTTANQKVLFLGSKQFPRITYSRASSRLSRREVIAFAGQQPWDIGRFVKTLYFFNGPPELSQIVESIISSFTGPCF

SEQ ID NO: 81081 - DNA, 878 bp, Zea mays
  misc_feature: Ceres CLONE 1566498
  misc_feature: Encodes the peptide sequence at SEQ ID NO. 81082
gagctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccctgaagttctacacccccgagggcaactggggacctgctgggcaacaacttccccgtcttcttcatccgcgacggcatcaagttccccgacgtgatccacgcgttcaagccccacccgccggtcgcccttgcaggagtactggggggggggttcgaatttcctggcgcccctcccccaaaagacctggccacctttctttttttcctcttttaacaaacctgggggggggcccgttccgacatacccgcccacattggaaaaggggtttccggcgtgtgaaaaccatacacacctttctctttaaacccccggcgcggggagaagagcccgcaagaccccgctcaagagtttccccctggg

SEQ ID NO: 81082 - protein, 243 aa, Zea mays
  misc_feature: Ceres CLONE 1566498
  misc_feature (18)..(234): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFALKFYTPEGNWGPAGQQLPRLLHPRRHQVPRRDPRVQAPPAGRPCRSTGGGVRISWRPSPKRPGHLSFFPLLTNLGGGPFRHTRPHWKRGFRRVKTIHTFLFKPPARGEEPARPRSRVSPW

SEQ ID NO: 81083 - DNA, 1032 bp, Zea mays
  misc_feature: Ceres CLONE 1566499
  misc_feature: Translation starting site: 153
  misc_feature (481)..(481): n is a, c, t, g, unknown, or other
ctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgaccggagacattcgcgcgcaaccggtagctggatgtgatccactccccgtgggcgatgctgggcgcgctgggctgcgtgttcccnggagatcctggcaaagaacggcgtcaagttcggcgaagccggtgtggttcaaggcccggcccgcagatcttccccgaagggcggcctggactaacttggggaaaccccaacctgggggacgcccacaaaaatcctgggccattttggcggtggcccagggggggccacaggggctttccccaaaggggtcacccgggtcgggggggggccccccccggggaaagggcccccaaaaggggggccccccggggggcccctttttacccggggtggggcctcccaaaaaaacccgaaaaccccgccccagatccggggggaaggggccccaaaaagggcccccccccgcggtgctcccaagtggggggtcttcttggggggcgcccctcccccgggggggggcccaaataaaaatattttaaaaagggccgcaacccccgacaaaaaggggggggatcaccaaaaattttcccccccgaaaatatggattaacacacccccgggggttaacacaaaaaaacacccttttttccccccccccaaaaaaaaaggtg

SEQ ID NO: 81084 - DNA, 953 bp, Zea mays
  misc_feature: Ceres CLONE 1566502
  misc_feature: Encodes the peptide sequence at SEQ ID NO. 81085
  misc_feature (250)..(250): n is a, c, t, g, unknown, or other
  misc_feature (252)..(252): n is a, c, t, g, unknown, or other
  misc_feature (304)..(304): n is a, c, t, g, unknown, or other
  misc_feature (416)..(416): n is a, c, t, g, unknown, or other
ggagctccccgcggtggcggccgctctagaactagtggatcccccgggctgcaggaattcgtctcacccctagaaaaagttccagcacgtactcaccgcaccccccgacggcccgacacgtccgtgctggcttgtacttgcacgccacaccaccacccagcccccaacgatgacggcggcggcggcaccggcaccggcggtcgctagcagggtgtgggagtgggagagggaaggtggcgtcggcggtggncnaggcgacggcggacgaggcgtgggcgctgctgtcggacttcctggcgttccnccggtggctcccgcgcgtggccgcgtgccgcctcgcgtccggctccccgcgcgcgcccggctgggtgcgctgctggacgggctcctgcctcttcccccacccagcacagcgnccccactggacgcacaagacgctggtgatagactaccagtgagcgaatgcttcgaccgccacgagagtgaaggacaagggacatgcttgcgcaacaacttacatcgacacctgtcaacgtcgtcccggttcaaccgccggccgggcgaatactacctcgcagggggggggtgcgaacttcaaggggcaaccccaagcaaggtgcagggaacacgaataatgaagggccacctgtagggaccggggtcgagcggcaaaaggggggttgggttgaagggaaaacgaaaatttggacgactgggccccgtcccggggaagggggtggccaaggggggccaccggggaagggggcccattaccccgcctggggcattgaacaaaaaacccgaaacacggacccccggactctgatggagaacggaaccccaaaatagatcccgcctatgacaagagaaaaccaagatcaggatgttgggtgggaatcctattttacaccactacaagggcgccccgagaaaaacatgtggaaaaataccct

SEQ ID NO: 81085 - protein, 160 aa, Zea mays
  misc_feature: Ceres CLONE 1566502
  misc_feature (28)..(28): Xaa is any aa, unknown, or other
  misc_feature (83)..(83): Xaa is any aa, unknown, or other
MTAAAAPAPAVASRVWEWEREGGVGGGXGDGGRGVGAAVGLPGVPPVAPARGRVPPRVRLPARARLGALLDGLLPLPPPSTAXPLDAQDAGDRLPVSECFDRHESEGQGTCLRNNLHRHLSTSSRFNRRPGEYYLAGGGCELQGATPSKVQGTRIMKGHL

SEQ ID NO: 81086 - DNA, 1148 bp, Zea mays
  misc_feature: Ceres CLONE 1566503
  misc_feature: Encodes the peptide sequence at SEQ ID NO. 81087
  misc_feature (1)..(1): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
nttttttctgattgcctattatttgaaggtcgtcagccacgccggtcgcacccaacgannnaagnnnnnncaaaactggagctccccgcggtggcggccgctctagaacagtggatcccccgggctgcaggaattcgtctcacccctagaaaactgacgtctcgcgaagcatcatcttccaaaccctcgccgcagccgcagccacccttgcttccgcacgatagtgcccgggaccagccatctatggcggcgtcgctgctcctccgcgctgtgcgccgaagggagctcgcgtcccctctcggatccctgggtgccaacttacagtcaacatgtgctgccaacatatgctcaaaatggggaaattttgcaagaccttttagtgcaaaagctgctggaaatgaggttattgggattgatttggggacaactaactcttgtgttgctgttatggaaggaaagaacccaaaagttatttcacaatgctgaagggtgcgagaacaacaccatcctgttgtccgcattttcctcaaaaggggtgaaaaaactttgtgggtacctccggcccaagcgcccaggggaataaacccaaaccccccgaaaaacactttttctttggggaaaccaaagaggaattgaattgggcgcccaacaccctttttgaatggatccccccccggcacccccgggaaaaggaagattttgaaaaaattggggggggcccaatacacaaaaaaaatcaggtggaaaagggctctctccaaaaagaggggggtggaaaatgccctcttgtggggtttttcggataaaaccaaccccggaagtgggggcgaagaggcatggtgaactcctctccccgcggaagatatcagagggggcggcgggccgcacattttttgttgcctcgggcccccccaaacatgaagaagggggaaaaacacgctttgaaaaacttttcttccctgtggggcgaaaatacttgttcctcccaaagagggggggggggaatcccgcgtgcccccgccgcttatttttttaaaagaagattccctaagcgtgcgcaggggcccacaaaaagagaaacccgggccccatttttggtgcggccctcttttatgttttaaagagggtcctcagtcagaccaccctcc

SEQ ID NO: 81087 - protein, 80 aa, Zea mays
  misc_feature: Ceres CLONE 1566503
MAASLLLRAVRRRELASPLGSLGANLQSTCAANICSKWGNFARPFSAKAAGNEVIGIDLGTTNSCVAVMEGKNPKVISQC

SEQ ID NO: 81088 - DNA, 918 bp, Zea mays
  misc_feature: Ceres CLONE 1566505
  misc_feature: Encodes the peptide sequence at SEQ ID NO. 81089
ctccccgcggtggcggccgctctagaactagtggatcccccgggctgcaggaattcgtctcacccctagaaaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaagcggtgggcggcgggcagtgcccggccctggggtgcgcggcggacctcaacgccgggtgcccgccctcgcatcgcgtgctgggcagggaggccgccgctttgtttgtcttccaagggccccccagggctacttccaaggagcggtgcccccttgactcgcaccactcccaccgacgtgggaccccgtgccgcaacaggtgcttgggcccccggcgagcttcaaggtcgtcctctgccagtaccgccatgatgtaacaccgccgccccccgccataaacgaaagcatccgccaccgttcttccgggacaactagagttactaggcggtctacctgcccttggttaaacccgggcgggggtcaccggcccaatttaaaggaaggaaattccgc

SEQ ID NO: 81089 - protein, 220 aa, Zea mays
  misc_feature: Ceres CLONE 1566505
  misc_feature (34)..(206): Pfam Name: Thaumatin Pfam Description: Thaumatin family
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSHRVLGREAAALFVFQGPPRATSKERCPLDSHHSHRRGTPCRNRCLGPRRASRSSSASTAMM

SEQ ID NO: 81090 - DNA, 913 bp, Zea mays
  misc_feature: Ceres CLONE 1566506
  misc_feature: Encodes the peptide sequence at SEQ ID NO. 81091
  misc_feature (381)..(381): n is a, c, t, g, unknown, or other
ggagctccccgcggtggcggccgctctagaactagtggatcccccgggctgcaggaattcgtctcacccctagaaaaaacggacggggcatgggattgacccacacacccgccctccgccccgcaagccaaatacgccgtggcacgcgtcgccatgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacggngggggaggggggcgctgggccccccccggcggctcgtcctgggaggacctacccctgggaccattccttccgtccggcaaggtgcctgggcgaaccccccaaatcggacacttatccccgcggggaagggtcctggccacgccctggtttacctcccggggggggtcctcccctctttgcccaaaaggggggaaaaaaccccccaaagcctgggtttgccactggggtcctgaatattcccgtggggcccgaatccctacatgcaaaattcggggaataaacaaaaagaagattttgaaaaaaaacccctgaaatttccccctccaaaattttttctcttcccagaggaggaaactctccccccacaaggggggggagagttttttgccccttaatccaacaagagggctatgggggagagaaaactcaatttttgtggggtttatgggggcggggaaaacaactcggggggggaagggaaaaaaactatatttcttttctgtgggaaaagggtttttcaaacacccctcgg

SEQ ID NO: 81091 - protein, 40 aa, Zea mays
  misc_feature: Ceres CLONE 1566506
MGERKLNFCGVYGGGENNSGGEGKKTIFLFCGKRVFQTPL

SEQ ID NO: 81092 - DNA, 753 bp, Zea mays
  misc_feature: Ceres CLONE 1566509
  misc_feature (148)..(148): n is a, c, t, g, unknown, or other
  misc_feature (161)..(161): n is a, c, t, g, unknown, or other
  misc_feature (162)..(162): n is a, c, t, g, unknown, or other
  misc_feature (191)..(191): n is a, c, t, g, unknown, or other
  misc_feature (192)..(192): n is a, c, t, g, unknown, or other
  misc_feature (230)..(230): n is a, c, t, g, unknown, or other
  misc_feature (231)..(231): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
ctccccgcggtggcggccgctctagaactagtggatcccccgggctgcaggaattcgtctcacccctagaaaaaattgcaagccttcccggttacttgttcactaacaaggtcgaggacggcatgagcccttaggagctgcgtaccantcactacctgcanngctcgccggcgacccatggcacccgccanncacacgcactggctcccctcggcgtactttatcttccnntcgtcattccgcccttagtatcccgccaagggcgaaacccgggcaacaaaccctccggcccaaaaaaaacgttttaaggggggaaaaaaggggggttttcgcgttccccccctttccccccccggggaaaaagcttgccccaatttattgggggccccccccccccccccctttttttggggggggccccaaaaaaaaccccccaaattttttttttatttcccccgggggaaaaccccctttggaaaccccccccccacaaaaaaaccgcggggggggggccacaaaaaaagaaagcccctcccgggggtggggtctcccccccccccccccccccccctaaaatatagggggggccccccccttttgttctccccccccccccccaccgcccgggtttttttttgggggggggggggggnnnnccgccccccccccacaaaaaaaaagagccccccccccccccccaaaaaaaaaaaaacaaccccctctctcttttttttttttgttggggaacaaaac

SEQ ID NO: 81093 - DNA, 892 bp, Zea mays
  misc_feature: Ceres CLONE 1566511
  misc_feature: Encodes the peptide sequence at SEQ ID NO. 81094
  misc_feature (803)..(803): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaatcggttaatctccacacgaatcacggacacggagacttgccttccttttggtgcggaaaaagaaagagaagagaagccaaggaggttctcagttggagcggctccctctccccgcgcgcgccaccgcctccgatccgagcagccgcctacaattaacccattcaacctcaaatgttccttgtgaggtatcatgacagaacagcaggaacgtgttagcaagagctcttcctcaagtattagcagcagcactcaggaaagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccagttccgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaggtctgggggaatgggggagatcatgtgaccttacaggcagctgcagacaggagctttggctaaagtttctgggtgtgagtacactacattncattgtatgcagttgaagatctccntacacggaaactagaaagagcattggctggtctagctccgcaggcttgggtgatttcttggtat

SEQ ID NO: 81094 - protein, 184 aa, Zea mays
  misc_feature: Ceres CLONE 1566511
  misc_feature (94)..(174): Pfam Name: OTU Pfam Description: OTU-like cysteine protease
  misc_feature (180)..(180): Xaa is any aa, unknown, or other
MTEQQERVSKSSSSSISSSTQESEEELTIGTLITEATNTTNSAKSLGKRLSHLDSIPHTPRVNGKIPDFNNATIDHESLLERLGTYGLAEYQIEGDGNCQFRALADQIFRNPDYHKHVRKAVVKQLKEFRKHYEGYVPMEYKVYLKKMKGLGEWGRSCDLTGSCRQELWLKFLGVSTLHXIVCS

SEQ ID NO: 81095 - DNA, 985 bp, Zea mays
  misc_feature: Ceres CLONE 1566515
  misc_feature: Encodes the peptide sequence at SEQ ID NO. 81096
ctggagctccccgcggtggcggccgctctagaactagtggatcccccgggctgcaggaattcgtctcacccctagaaaaactccagtccaacgaactgacccaactacctaagctaaaagctaacctccgtacccccggccatggcgctcgcgcccacctccgctgccgtgctctagaccccgttcctcggggccaggcgcgcgctcgccatgcccgctcctcgccgcgcgctcgtcatcgccgccgcgggcgcctccaagaagtcgtggatcccggccatcaagagcgacgccgagatcgtcttcccgccctggctcgacggctctctccccggcgacttcgagttcgacccgctggggctgggcaaggacccggcgttcctcaagtggtacccccaagccgagctgatccactggcggtgggcgatggcggccgtgctgggcatcttcgtggtgcaagcgtggagcatcttcccgttggttccaagccagcacggtaccctagcgccattcactccctttctcctttcgggttcgctgctggggcaacgcagactgcctactggatggggtggggtgggagtccaaatcggttggggcggactttcttccaaccccgtacttcccatggcccgggtgaatggggccaccccccttgtgtccccccaacccgcttgaaaaacttcggccaaaccttctcccaggggaatactgggctatccccggggcggaggaattttcttgcgaaccaaatcgggaactctctccggggaacctttcaaaggaacggtggtccaacctttccccgaaatgtctgaaaaaactccgagagcgggggtctaacttgggcccgaagatataaagacaacgccccccaattcccccttgtttggtgccatgaaccaccactctcctactttccaagacccgtgacaaggtcaattaatcccgcctctgaggcgcaccctaggccctcttgattgtt

SEQ ID NO: 81096 - protein, 155 aa, Zea mays
  misc_feature: Ceres CLONE 1566515
  misc_feature (31)..(135): Pfam Name: Chloroa_b-bind Pfam Description: Chlorophyll A-B binding protein
MPAPRRALVIAAAGASKKSWIPAIKSDAEIVFPPWLDGSLPGDFEFDPLGLGKDPAFLKWYPQAELIHWRWAMAAVLGIFVVQAWSIFPLVPSQHGTLAPFTPFLLSGSLLGQRRLPTGWGGVGVQIGWGGLSSNPVLPMARVNGATPLVSPQPA

SEQ ID NO: 81097 - DNA, 982 bp, Zea mays
  misc_feature: Ceres CLONE 1566518
  misc_feature: Encodes the peptide sequence at SEQ ID NO. 81098
ctccccgcggtggcggccgctctagaactagtggatcccccgggctgcaggaattcgtctcacccctagaaaaaactggaccattcctccgtgctggggagcggcggagagctatccacctcgtctcaggcaccctctggcgtccccctccccccgccgcgtgccggcgagccgcggagatccggggttctgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgtcaacattggtgctgcaaatgccccatcccaggtccttgcaacgctaagtggccactatggtcctgtgtggcgtgttgcttgggcccatccaaagtatggtgcaatccttgcatcgtgcagttatgatggccgtgtcattatttggaaagaggatgcacgagggcattggtctcaagtccacgtcttcagtgacaacaagtcatctgtcaactcctttgcttggggctcgtatggaggttggcctctggctttgctgtgcattcttctggtgggaagatatccatccttgaccattcaacctgacgggggttgggatactgcaacctttgacggagcccttcctgcggggcgaacggcatttccggggcccctggaaaagggtcctaatgggggagagggaacttttttacaacctggccccaggggggtttaaccctttttttaaaggcgggggttccacaagggggttttggaaactgggaagagctctttcttcgaaatggccccaatttggggggggattgccccgggcgcccatttttggggtttcccaacaccacatgcggggggtgtaaaaagagggaagggtctcctgcaccaggagaaaaggggaacagtg

SEQ ID NO: 81098 - protein, 181 aa, Zea mays
  misc_feature: Ceres CLONE 1566518
  misc_feature (47)..(87): Pfam Name: WD40 Pfam Description: WD domain, G-beta repeat
  misc_feature: SWISSPROT Homolog: EC 2.3.1.48 Histone acetyltransferase
MSSKKIELDHKDMVHDSAIDYYGKRLATASSDFTVKIVNIGAANAPSQVLATLSGHYGPVWRVAWAHPKYGAILASCSYDGRVIIWKEDARGHWSQVHVFSDNKSSVNSFAWGSYGGWPLALLCILLVGRYPSLTIQPDGGWDTATFDGALPAGRTAFPGPLEKGPNGGEGTFLQPGPRGV

SEQ ID NO: 81099 - DNA, 824 bp, Zea mays
  misc_feature: Ceres CLONE 1566522
  misc_feature: Encodes the peptide sequence at SEQ ID NO. 81100
agctccccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtgatggtggtgtccactcccgccttgaccaactgcagttacttctgaaaggtgtcagtgagagaggagcaaaaaaaattcgtgtgcacatccttaccgatgggcgtgacgttttggatggcagcagtgttggtttcgtggagaccctagagaatgatcttttggagcttcgaggcaagggtattgatgcacagattgcttctggtggtgggaaagatgtatgttaccatggaccgttatgagaatgactgggatgtggttaaacgtggctggga

SEQ ID NO: 81100 - protein, 211 aa, Zea mays
  misc_feature: Ceres CLONE 1566522
  misc_feature (15)..(210): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGKDVCYHGPL

SEQ ID NO: 81101 - DNA, 830 bp, Zea mays
  misc_feature: Ceres CLONE 1566523
  misc_feature: Encodes the peptide sequence at SEQ ID NO. 81102
ccccgcggtggcggccgctctagaactagtggatcccccgggctgcaggaattcgtctcacccctagaaaaaaacggttgaggcgttgctggtgctcctgccgcttaccctgccctgttcactgttctgttccgcgtatcccacaggaagggaaggggaggaagcagcagcagcacacagctttgctctcgctctcggctccccgtccaccaaaggaggaaacgcgcagcccgcagcgctagccgtcgtctatctcgtctcctagtccaaggaaggaaagaggcgcttggcatgaagcgacctaccaagaatgagacgctgggctacccctggcacaagtagagcaagagccccagcaaccgagccacagtgaggaggactcgagggaagagatgggcaactgcggcacgcgggaggagaatgccgtcgtcgctgcgcacgcacaagttcaacagctccacttgttacaaaatcctgccaagaatgccattggagataggaagcacaaccgcacctcatcagatataagtgatccttccacacctaggaaagctgaagatgccaagaacatttccatatacaacgatgtgattgtcttcacattgtttgagctagagacaatcacaaagagcttccgtgccgattatgttctcggcgaaggaggatttgggaccgtttacaagggctacataaaatgaaatgtcagggtgggggctgaagtcactggcctgttgcagtcaaagttgctccaacaaagaatggacacccaagggccccgaaaaaatggctttaccgaaatttaaactgccctggggggcatttaaaggcaa

SEQ ID NO: 81102 - protein, 101 aa, Zea mays
  misc_feature: Ceres CLONE 1566523
  misc_feature: SWISSPROT Homolog: EC 2.7.11.1 Non-specific serine/threonine protein kinase
MGNCGTREENAVVAAHAQVQQLHLLQNPAKNAIGDRKHNRTSSDISDPSTPRKAEDAKNISIYNDVIVFTLFELETITKSFRADYVLGEGGFGTVYKGYIK

SEQ ID NO: 81103 - DNA, 975 bp, Zea mays
  misc_feature: Ceres CLONE 1566524
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (241)..(241): n is a, c, t, g, unknown, or other
  misc_feature (242)..(242): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (294)..(294): n is a, c, t, g, unknown, or other
  misc_feature (296)..(296): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (319)..(319): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (333)..(333): n is a, c, t, g, unknown, or other
  misc_feature (334)..(334): n is a, c, t, g, unknown, or other
  misc_feature (338)..(338): n is a, c, t, g, unknown, or other
  misc_feature (339)..(339): n is a, c, t, g, unknown, or other
  misc_feature (341)..(341): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (363)..(363): n is a, c, t, g, unknown, or other
  misc_feature (375)..(375): n is a, c, t, g, unknown, or other
  misc_feature (378)..(378): n is a, c, t, g, unknown, or other
  misc_feature (380)..(380): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (436)..(436): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (528)..(528): n is a, c, t, g, unknown, or other
  misc_feature (535)..(535): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (876)..(876): n is a, c, t, g, unknown, or other
ctccccgcggtggcggccgctctagaactagtggatcccccgggctgcaggaattcgtctcacccctagaaaaagttccagcacgtactcaccgcaccccccgacggcccgacacgtccgtgctggcttgtacttgcacgccacaccaccacccagcccccaacgatgacggcggcggcggcaccggcaccggcggtcgctagcagggtgtgggagtgggaggggaaggtggcgtcnnngnngnnnnannnnannnnnnnnnnnnnnnnnnnnnannnnnnanntnnnannntncntaattnnnatnnnnnttnnnntntttnnnnttaaaannaatnntncncnnnnnannnnnnngttcantgattttttttnttntntttcgccccccccccaaaaannnnntaaaannnnnnnnnnntntnnnatnntntcnccccccnccnnttctttctctccccctctctcctgtcctcttctcttactctttttctcttctaatctatcttaanncnnnnnatgnnnggngtgtggngcgctggcgggnnngggcgcggggggggggtgttgggttgtgtcctcctgtttggcggcccccccgtaggttgttgacctctgtactggacttgttgcgcccgacttccccatgaagtatggtcctctctatagggggtaaagcgttataatagtatgggtgggcaactaccagtcttggggatgctctgtctgacgctgtgtattaggatttaccggtatctgttgatattgtattcaatttaccggaaccatcaccgaacgtatcgtttcttcggccgtctaggagacggaccttcttgtatttagcaccgtacaacactggggcgctaacgctgtgtnttagattgttcacaatcggtaggttgtttggtcgcgaaccaagagtgtcgctgtagtatgcgtcttgtatgatgaatactatgatacttctggcagggg

SEQ ID NO: 81104 - DNA, 773 bp, Zea mays
  misc_feature: Ceres CLONE 1566526
  misc_feature: Encodes the peptide sequence at SEQ ID NO. 81105
agctccccgcggtggcggccgctctagaactagtggatcccccgggctgcaggaattcgtctcacccctagaaaaaagtcgccgtcgccacctcggctgctagcctcctccgtctgctcaggacgagggaggagcagagaccgaactctgccgtctcttcctcctccctctgcacccccacgagctccatggccgccaccgccatgattgggattaccaacctacattgccgccacgacccgctctcctcccttccccgggctacgtcgtcggccgcccagacctgtactctgcttcctcctccatgccgccaccgttcttcttgctgctccccttcctcctccgatctctacgtgccgggcccgggtccgaccgacaacgactctgaagcacatacctgccgccgacaccggcttcatgagaccggccaacaatgaggccaccacgcttaaacgatcatcctcgtgcgaccttcgccgccgccttagcgtccgcagatccgccgctggcaccggacacaccgccagtgcttcactacatgagtgctgcccgacattatcgaggtggcgcatctgctcgtgtcgctggggattctgctcgccctggacaagtacctcagcaagcattcatcgccgcctcgatcatgttcccgagtgcccttgacggcatgggcagcgtcttctcggcgctcgaaatcatcaacacatgtcggcctccacgcgcgaacgcgttcattggcttgtttgagaccaccatgatgttcatggaagaga

SEQ ID NO: 81105 - protein, 82 aa, Zea mays
  misc_feature: Ceres CLONE 1566526
MAATAMIGITNLHCRHDPLSSLPRATSSAAQTCTLLPPPCRHRSSCCSPSSSDLYVPGPGPTDNDSEAHTCRRHRLHETGQQ

SEQ ID NO: 81106 - DNA, 973 bp, Zea mays
  misc_feature: Ceres CLONE 1566527
  misc_feature: Encodes the peptide sequence at SEQ ID NO. 81107
  misc_feature (1)..(1): n is a, c, t, g, unknown, or other
  misc_feature (74)..(74): n is a, c, t, g, unknown, or other
  misc_feature (75)..(75): n is a, c, t, g, unknown, or other
  misc_feature (95)..(95): n is a, c, t, g, unknown, or other
  misc_feature (206)..(206): n is a, c, t, g, unknown, or other
  misc_feature (207)..(207): n is a, c, t, g, unknown, or other
  misc_feature (337)..(337): n is a, c, t, g, unknown, or other
  misc_feature (661)..(661): n is a, c, t, g, unknown, or other
  misc_feature (729)..(729): n is a, c, t, g, unknown, or other
  misc_feature (731)..(731): n is a, c, t, g, unknown, or other
  misc_feature (897)..(897): n is a, c, t, g, unknown, or other
  misc_feature (900)..(900): n is a, c, t, g, unknown, or other
  misc_feature (901)..(901): n is a, c, t, g, unknown, or other
ngaggggggggggggtgcccgcgcaccgtggtgggtgcctgggtggagaaggccgcagagagggtggggacggnngggggggggggtttccccgngcaaactggactccccgcggtggcggccgctcttcactagtggatcccccgggctgcagtattcgtctcacccctagaaaaactcaggcgacgcgatggcgatggcggcgnnctgcgacgcgaggggaggcgcctcctcctcgcccccaccgtccccaacccgtcttcggcggccgcttccgctgcggtgacgcgatcctccgccatgtcgcaaccggagatggctccacttggtgcacggnctatttcaactcaggttgtgaggaaccggatgaagaagtatcaaaacttcccgaagatcccaaaggcctttgaaaatgggttccagcatcaaaagccttcggggctgtttcaaaccaaggaccgtaaaaattccccccccccttttgggggcaaacccgttttccccccccccccttttttggggggggaaccccccccccccaaggggttgttaaacccccccccaaaaaaaaaaaaaaaaggggggtattgtggggggggccccccctatttaatgctgtggggcgtgcttgtggctgtaaaaagaggggggggggggaaanccccgccccccccccgggggggggggggggggttgtgttaaaaactttgttgacccccaccccccccngngggggaaaaagaaataatttgtggaggggggggggggccccccctcttccacaaaaaaattcaccacccccttgggggggggcggtcgcgaaaaaaaaaaaaagaaggcgcgaggggttccgccctctctttttggtggggggggagaaaaacacccccccacttnccnngggggttttttttttgcgcggcggcctcgaggaaataaaaaccccccttgtataggagcccccccctcgggg

SEQ ID NO: 81107 - protein, 133 aa, Zea mays
  misc_feature: Ceres CLONE 1566527
  misc_feature (13)..(13): Xaa is any aa, unknown, or other
  misc_feature (121)..(121): Xaa is any aa, unknown, or other
MSQPEMAPLGARXISTQVVRNRMKKYQNFPKIPKAFENGFQHQKPSGLFQTKDRKNSPPPFGGKPVFPPPPFLGGEPPPPKGLLNPPPKKKKKGGYCGGGPPYLMLWGVLVAVKRGGGGKXPPPPRGGGGGLC

SEQ ID NO: 81108 - DNA, 962 bp, Zea mays
  misc_feature: Ceres CLONE 1566529
  misc_feature (248)..(248): n is a, c, t, g, unknown, or other
  misc_feature (343)..(343): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
ctggagctcaccgcggtggcggccgctctagaatagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttctgcgaggcccgcgtgacgatgcgncagactgcggggaatgccaatgcggcgcggcgtccggtagcccgtggtacggccccgaacgcgtgctgtacctgggcccactgtccggcaagcgncgagctacctgacggggcaatttcggggccaactacgctggtaaacccctggctgtcgggcgaaccggaaaactttccgcaaaaccgggaacttggaggtaacccacccccctgggcccttttgggggccccccggtttcttttccccaaagttttcccccccaaagggggttatttttcgaaaaacccctggggtttaaagggcggcccccaattttttttcgggggggggggaagggaaccccccgggaaaaaagaaatcctttcccacgggggaaaaaaaccccccccccctttggggcccccccaaaatgtttctcttttttggggcccccccaaaaagttacctattaatttttggggggggggcccctgggtggggatattcgtgaaaaccctctttttttttgggggggggggaaaaataataaaaaggggggggccgaaaaaaaaaaaaaaatgggggggtttttaaaaggcggggaggaaaaaaaaaaaaaaaaacacaccccccccccccgcnnntggggggggggtacctttcccccccccccccccccggggggggggggggggttaatttatttttttttttttttctccccccccccacaaaaat

SEQ ID NO: 81109 - DNA, 891 bp, Zea mays
  misc_feature: Ceres CLONE 1566532
  misc_feature: Encodes the peptide sequence at SEQ ID NO. 81110
  misc_feature (891)..(891): n is a, c, t, g, unknown, or other
ggagctccccgcggtggcggccgctctagaactagtggatcccccgggctgcaggaattcgtctcacccctagaaaaaaccgcctctccaaaaaaaagcctaaaccctcctcgacgtcaccagcgtccgcccctatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaacgagcgctactccgctggacaaggtcgtctaccgctccagcctcggggggggcctcctcgaaagtgcgccaccgacatggaagggcgctggccccgcttacccgggggttcctaacggggcgggaccccctttccaacttcccggcgtcgggacgcacccgcccttggcccctaccgggtccgggcggtcctggggcccaagaaaggggggtcgatgggcttccccccagatacgaactaccgaacaccatctgtgtttcccgtcttttgaggggggaaactcccacaccctcttctagggggcgcggagacaccctccggaccccacaagaaacacttgggggcggggagaagaaaacaaacctcggggggataaaagccactgtgggggaacatcccccgcccaccgggggn

SEQ ID NO: 81110 - protein, 131 aa, Zea mays
  misc_feature: Ceres CLONE 1566532
  misc_feature: SWISSPROT Homolog: EC 4.2.3.1 Threonine synthase
MATFTAASSLSLLFSHPHSHSRQPSAQGPTASSHLHLHPRASRARCASSDTTATKHRRPAEENIREEAARLRGPAQGFSAWYEPFPPAPGGDPNERYSAGQGRLPLQPRGGPPRKCATDMEGRWPRLPGGS

SEQ ID NO: 81111 - DNA, 777 bp, Zea mays
  misc_feature: Ceres CLONE 1566533
  misc_feature: Encodes the peptide sequence at SEQ ID NO. 81112
ctccccgcggtggcggccgctctagaactagtggatcccccgggctgcaggaattcgtctcacccctagaaaaaactgctacgtctccgctctacgtctctctcacaagtcacacagcctttgctttcccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaaacagcgaaagcactagttgaagaactacggaagttgtctaaggaggtcgaagatagtgagcttgcagatgttgctgctgttag

SEQ ID NO: 81112 - protein, 183 aa, Zea mays
  misc_feature: Ceres CLONE 1566533
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAV

SEQ ID NO: 81113 - DNA, 965 bp, Zea mays
  misc_feature: Ceres CLONE 1566534
  misc_feature: Encodes the peptide sequence at SEQ ID NO. 81114
aaagctggagctccccgcggtggcggccgctctagaactagtggatcccccgggctgcaggaattcgtctcacccctagaaaaagctcccgttcccatgctgatttttttaggcggctgctggcctgcctgtctccactggaagctccggattacgtagaaaaggggcgggcggcatgaggatccagtgcgacgcgtgcgaggccgcggcggccgcggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaatgacgcgctgccgcattgaggtgccgtcctcgccgttcctgccaccgtccggttgggccgtcgaggacctcctcgagctgtcggactacgaatccagcgacaagaaagactcgtctcttgggctcaaagagctggagtggttcgaggacatcgacctgttccacgcccattcgccagctaaactggccatggcggagttctcgcctcgccgcagccagtgagtaacgccgggttctacagggcgaacgggcgcgcctgttcagagtcccggatggagtgcctgacgacacaacaggactactcatcgtcctgatctggcctgaatgaagactctgctgatc

SEQ ID NO: 81114 - protein, 155 aa, Zea mays
  misc_feature: Ceres CLONE 1566534
  misc_feature (55)..(102): Pfam Name: zf-B_box Pfam Description: B-box zinc finger
  misc_feature (1)..(47): Pfam Name: zf-B_box Pfam Description: B-box zinc finger
MRIQCDACEAAAAAVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVNDALPH

SEQ ID NO: 81115 - DNA, 893 bp, Zea mays
  misc_feature: Ceres CLONE 1566535
  misc_feature: Encodes the peptide sequence at SEQ ID NO. 81116
ctccccgcggtggcggccgctctagaactagtggatcccccgggctgcaggaattcgtctcacccctagaaaaaaccgggcacacaccatcacagtacacacacacacacgcacacgctcatcaagcttctctctcgcctactcggctgcaatggcgcgcttccagctcgcggccctggccatggcaatgctcttcgccgccgcggcggcgcaggccccggccgccaccccgacgccggctcccaaggcgtctcctcccccgccggcgacgccgcctccgacgcccgcgaccccgccgcccgccccggcgccggtgtcgccgcccgcccagcctccggccacgcctcccccggccccggcgcccgctcccaaggcccccgcccccgcgccccacgcccttgccccggcgcccaaggccgaggccccgacccccgagatgagctccccgccgatgcccacggagggccccgccccgactccctccgccgaggtgccacctggccccagcgccgccgccggcgtctcccccgccgctcccaagaggttcgccgccgctagcgccgtgggcgcccgccgccgcctcctttctactgagagaagggaaacctgcaccgcccccggcttggaaaataattagttatccctattcaagccgtcaaatcccgccctgtgttttttcaattccccacatttggttccccccagccggaaaataccgtattttcttttcgggcattccccataacaaagagacctgggcgggaatcaatttgcggtccccgaatcctgaacattaatgggcaaccgggggcatcacggaacaaaattgctcctggggctgggccccacccaaggttatttggcgcccggcgacaattatcattttatataac

SEQ ID NO: 81116 - protein, 161 aa, Zea mays
  misc_feature: Ceres CLONE 1566535
MARFQLAALAMAMLFAAAAAQAPAATPTPAPKASPPPPATPPPTPATPPPAPAPVSPPAQPPATPPPAPAPAPKAPAPAPHALAPAPKAEAPTPEMSSPPMPTEGPAPTPSAEVPPGPSAAAGVSPAAPKRFAAASAVGARRRLLSTERRETCTAPGLENN

SEQ ID NO: 81117 - DNA, 816 bp, Zea mays
  misc_feature: Ceres CLONE 1566536
  misc_feature: Encodes the peptide sequence at SEQ ID NO. 81118
gcggtggcggccgctctagaactagtggatcccccgggctgcaggaattcgtctcacccctagagaaaaagagcaagggacaatggcccgcaccgcggcgccggccgcgggctacggagaggacggagtgtaccgctccccgcgcccggccgtgcgcatcgagtccgacacaggcctctccctcaacgacctcctcttccgccgcgccgacgtgtgcccctccgctctcgcgctggtcgactccgccaccggccaatccctcaccttcgccgcctttcgctccgccgtcctcaccacggccgtcgccctctcctcgcgcgcgggcgtccggcgcggcgacgtcgtcctcttcttcgcccccaactgcttcctctaccccgtctgcttcttcgccgtcaccgccctcggcgccgtcgctaccacggccaaccccctctacacccctcgggaggtcgctaaacaggccaccgactcgcgggccaagctcgcaatcacggtctctgaactccttcccaaaatcgtggacctcggcttccccaccatcctgctcgacggcggcggcgacggcgacgcggccagtgccgccgcctccaagcctcaggtagccagcgtgacgctttactcagacctcgtttctggggcgcgtgagacggagtaccgccgcccgccgacgaagcagagcgacacgaccgcgctgatgtactcgtccggcacgacgggtgcgagcaagggcgtaatcctgacacaccgcaacttcatctcgggcgcggccatgatgacagcggaccaggacgcgctcggagagggcccccaccc

SEQ ID NO: 81118 - protein, 244 aa, Zea mays
  misc_feature: Ceres CLONE 1566536
  misc_feature: SWISSPROT Homolog: EC 6.2.1.12 4-coumarate--CoA ligase
MARTAAPAAGYGEDGVYRSPRPAVRIESDTGLSLNDLLFRRADVCPSALALVDSATGQSLTFAAFRSAVLTTAVALSSRAGVRRGDVVLFFAPNCFLYPVCFFAVTALGAVATTANPLYTPREVAKQATDSRAKLAITVSELLPKIVDLGFPTILLDGGGDGDAASAAASKPQVASVTLYSDLVSGARETEYRRPPTKQSDTTALMYSSGTTGASKGVILTHRNFISGAAMMTADQDALGEGPH

SEQ ID NO: 81119 - DNA, 897 bp, Zea mays
  misc_feature: Ceres CLONE 1566540
  misc_feature: Encodes the peptide sequence at SEQ ID NO. 81120
  misc_feature (858)..(858): n is a, c, t, g, unknown, or other
ctggagctccccgcggtggcggccgctctagaactagtggatcccccgggctgcaggaattcgtctcacccctagaaaaagacaggggaaaaccaagcctgtgtttcagagacaactcaggcgacgcgatggcgatggcggcgctgcgacgcgaggggaggcgcctcctcctcgcccccaccgtccccaacccgtcttcggcggccgcttccgctgcggtgacgcgatcctccgccatgtcgcaaccggagatggctccacttggtgcacgttctatttcaactcaagttgtgaggaaccggatgaagagtatcaaaaacatccagaagatcacaaaggctatgaagatggttgcagcatcaaagcttcgggctgttcagacgaggactgaaaattcacgcggcttgtggcagccgttcaccgcccttcttggggacgctcctagtgttgacgtcaagaagaatgtgattgtggccattacctctgataagggactctgtggtggtatcaattcaacctcggtgaaagttagcagggcccttcacaaactgacatctggtccagaaaaagaaagcaagtatgttatattaggagaaaaaggcaaagttcagctgttgcgtgactcgaagaacagcattgaaatgaccgcaagtgaactacagaagaaccctatcaactatacacagattgctgtgctcgcggatgacatattgaaaaatgtggaatatgatgctctaaggggtattttcaaacagttccattctgtcatatcgttttagccccacatggtaacgatactggtccccctgaggtgcagaaaagaagcgaagctgggtgggagatgggtgacttagatcntatgagaattgaagcggggaacaaaacagaaatatgcaa

SEQ ID NO: 81120 - protein, 216 aa, Zea mays
  misc_feature: Ceres CLONE 1566540
  misc_feature (50)..(217): Pfam Name: ATP-synt Pfam Description: ATP synthase
  misc_feature: SWISSPROT Homolog: EC 3.6.3.14 H(+)-transporting two-sector ATPase
MAMAALRREGRRLLLAPTVPNPSSAAASAAVTRSSAMSQPEMAPLGARSISTQVVRNRMKSIKNIQKITKAMKMVAASKLRAVQTRTENSRGLWQPFTALLGDAPSVDVKKNVIVAITSDKGLCGGINSTSVKVSRALHKLTSGPEKESKYVILGEKGKVQLLRDSKNSIEMTASELQKNPINYTQIAVLADDILKNVEYDALRGIFKQFHSVISF

SEQ ID NO: 81121 - DNA, 905 bp, Zea mays
  misc_feature: Ceres CLONE 1566542
  misc_feature: Encodes the peptide sequence at SEQ ID NO. 81122
  misc_feature (905)..(905): n is a, c, t, g, unknown, or other
tggagctcaccgcggtggcggccgctctagaatagtggatcccccgggctgtatgaattcgtctcacccctagaaaaacagaagaggaaaggcttgcggtggatatttaggcacctatagacgatgaagggcgtagcaagcgacgaaatgcttgggggagttgaaaataagcatagatccggatattcccagataggtcaaccttctgaagtgcctgctgaatccatgagcaggcaagagacaacctggggaagtgaaacatcttactagccagaggaaaagaaagtaaaagcgattcccgtagtagcggcgagcgaaatgggagcaggctacaccgtgaacacggggttgtgggagagcaatacaagtgttgtgctgctaggcgaagcggttgacccccccggcctagatggctaaagtccagtagccgaaagcatcactagcttacgctctgacccgagtagcatggggcacgtggaaacccgtgtgaatcagcaaggaacaccgttgcaaggctaaaatacacctggggggaccgaatagcgaagtattacccttgaagggaaaggttaaaaacaacccccagtggggtagttgaaatagaacgtgcaaaccggtgcttgaacttcccaaacaagtgggaagcggggaaaagggaatctcttgaacccccttgccctggtatcaaaaaatggagcccgggggaactctctagggacaggagacttttggtttaagggggaaattgaaaccccccccgggagacccgttaaccttaaagggcggttcgttccaatagggggcgaatagagccaccgttgttatagggaacaccaaaaaaccgtgggggggatatttttccccggagactccggaacaaaaaagtgtggggaataaaaaacttn

SEQ ID NO: 81122 - protein, 48 aa, Zea mays
  misc_feature: Ceres CLONE 1566542
MKGVASDEMLGGVENKHRSGYSQIGQPSEVPAESMSRQETTWGSETSY

SEQ ID NO: 81123 - DNA, 874 bp, Zea mays
  misc_feature: Ceres CLONE 1566544
  misc_feature: Translation starting site: 158
  misc_feature: SWISSPROT Homolog: EC 1.4.1.2 Glutamate dehydrogenase
tccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtcttttgatgccaaggcgtctcatcgggcagggaggttccagtgatgcgttctgtccagaagtgatatccaagtttgtgggccccttcaagggccattttctgggggcctgggggagaaaggccaaatgaattggttgtcccaggcacccaggggtggagggaaaaaacccattttttcgcaccttgaaaaaaagaacccccccccctagggggttcccttataccaaaaaaaatgcccctgggaaaaaatttgctcttaaaaacccttttccccctgggggtgaggcccgccaaattcaaaaaaaaaggttttgtggggggccccaagggacccccttggggccgctcctttggtgaagggggcccgccccccgggagggggggggggggccccacacaaaaaaggaggaaaccttctggggggggggataaatttttgtcgggggggcctctttaaaaaggggtggcctgcccccgtttttattttttttctgttgccgggggaggg

SEQ ID NO: 81124 - DNA, 895 bp, Zea mays
  misc_feature: Ceres CLONE 1566545
  misc_feature: Encodes the peptide sequence at SEQ ID NO. 81125
  misc_feature (809)..(809): n is a, c, t, g, unknown, or other
ctccccgcggtggcggccgctctagaactagtggatcccccgggctgcaggaattcgtctcacccctagaaaaagagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctccccctccccctcctcctcttcgctgcggtatttagccaatgccgacagcgacgtgctccaaggaagcggcagcccggagcgcactgcgggatctgcggggagccgacgactccttgaactgcgcggacaagaggcggcggaggaggaagaggagcggtggtccttcttggcgctgctctttgagctactgcggaagtcgttgctcgggtgcaggaccgtgggcggcggcgaaggcgaacacggcggctgcgggatggagattgggttgcccacggacgtgcagcacgtggcgcacgtcacgttcgataggttccacggattcctaggcctgcccgttgaattcgagcccgaagtgccccgccgtgctcccagtgcagtgcaagtgtcttcgggtgtttcaacgaaattcatgcagtggttcctatgattgtcggaggaaacaatgtcccaaacatcccttttgaagatgcagagacggcttttatgaacacggtgggcttncaagcagaaagtattcttctgtattaatggcggaaaaaaccccggaagaagtttgtgaaaaaacccaccaaaatagggggaattga

SEQ ID NO: 81125 - protein, 166 aa, Zea mays
  misc_feature: Ceres CLONE 1566545
  misc_feature (111)..(166): Pfam Name: PBD Pfam Description: P21-Rho-binding domain
MTEVALLRGPTNLASTASRAPASPSPSPSSSSLRYLANADSDVLQGSGSPERTAGSAGSRRLLELRGQEAAEEEEERWSFLALLFELLRKSLLGCRTVGGGEGEHGGCGMEIGLPTDVQHVAHVTFDRFHGFLGLPVEFEPEVPRRAPSAVQVSSGVSTKFMQWFL

SEQ ID NO: 81126 - DNA, 946 bp, Zea mays
  misc_feature: Ceres CLONE 1566546
  misc_feature: Encodes the peptide sequence at SEQ ID NO. 81127
ctggagctcaccgcggtggcggccgctctagaactagtggatcccccgggctgcaggaattcgtctcacccctagaaaaaactccatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagctaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactaccacaagaatgagaacaagggagttgctgtgaatgactttctaccagggagcgccgctttaggaaacttacagcactctatggacctgaaggctactacatcgttgagggccttgaggaggtaggattctgatgggctagaaagggcggggaggtagtttaccaaaaactggggagaccattttccggaatggagacaattccgtttattaactatattcggggcccgggttaacgcgcagaaa

SEQ ID NO: 81127 - protein, 61 aa, Zea mays
  misc_feature: Ceres CLONE 1566546
  misc_feature: SWISSPROT Homolog: EC 3.6.1.1 Inorganic diphosphatase
MAPAVEAVKETGTFQKVPALNERILSSMSRRSVAAHPWHDLEIGPGAPTIFNCVIEIPRGS

SEQ ID NO: 81128 - DNA, 1165 bp, Zea mays
  misc_feature: Ceres CLONE 1566549
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (82)..(82): n is a, c, t, g, unknown, or other
ttttgttttatttttttgtcacagatcgtacaaacgcgcaatccgctaaataaataaaatattactccttctnnnnnnnntnaaaactggagctccccgcggtggcggccgctctagaactagtggatcccccgggctgcaggaattcgtctcacccctagaaaaagcggtgtgactgcctgccccaccccattgcgcctgtgcctcgcttcatccggtgcgctgcccacctcacctcactcccgtcgtcctcttcctcatcctcgctctcgtcgcggagcggtgtggaggcgcgcgctcctggaaggcacggggcaagagcggaggaagatcatctgggtgttggagtcatccagaggcacaagctgaggaatggggcaaaaggactccaagccttcacatggatatggctactcttcttatgattacgggagtgcttcatcaagatacacctcgagaaaacgtgggcaattcgtcctccacttatagcgatcaggtactgcgcctttcttcgcgataaccagtgtacaagcccggaaaacaccagtccacggtttgtctggaggaaaagtcattcccaaggaatcgtatgcaagaacttacccggtttcttttcgaggctcactgcgtaactgaaaatcttttttgggccaacaatgtaagggctccattcgaaaaattcccttccaataatgcgtttaattcggattagagggccactccgggaagtgtttcgtaatccaagaggcaagggctaaaatggcgaataaattgagtaatccgaggcgtgataacagagaatgtttccacgcttatttccaaaatttacgagctcacacacttgataccccttgttctagtgggaaattatatcttgaggggaaatatattcttcccctttaaactccctccttttcattgtgacccgagagagccatcgataatgcccggacatttatactttgggaagaacgggatacacgctctggttgcttacgcaatattagtgaacggcgcaaccaattacgatttggcgaggttgtccccgtgagcctcttcgtggaaattttctgatagaattatcaataccaaagattgttagtggaaatcgaaggcaccggatacttcgctaaacctttttataacctccaccaatcattccctc

SEQ ID NO: 81129 - DNA, 981 bp, Zea mays
  misc_feature: Ceres CLONE 1566551
  misc_feature: Encodes the peptide sequence at SEQ ID NO. 81130
  misc_feature (763)..(763): n is a, c, t, g, unknown, or other
  misc_feature (830)..(830): n is a, c, t, g, unknown, or other
  misc_feature (853)..(853): n is a, c, t, g, unknown, or other
  misc_feature (910)..(910): n is a, c, t, g, unknown, or other
  misc_feature (922)..(922): n is a, c, t, g, unknown, or other
  misc_feature (923)..(923): n is a, c, t, g, unknown, or other
ggagctccccgcggtggcggccgctctagaactagtggatcccccgggctgcaggaattcgtctcacccctagaaaaaaccagcgcagaatcagcaaacgcgccattgacgcgcactcgtagtcttgactcttgcgtgcttccctcgtcttctcggacgttccgttccatcgccatggcggaccagcttagcgaggagcagattgccgagttcaaggaagctttcagcctcttcgacaaggacggcgacggttgcatcacaaccaaggagctcggaaccgtgatgcggtctctcgggcagaaccccaccgaggcggagctgcaggacatgatcgccgaggtggacagcaacggcagcggcaccatcgacgagcaggagttcctgggcctgatggcgcgcaagatgagggacgcggagtcggaggaggagctcagggaggcgttccgcgtgttcgacaaggaccagaacggggtgatctccgcggccgagctccggcacttgatgaccaacctcggggagaagctgagcgagcaggaggtggccgagatggtccgtgaggccgacgtggaccgcgacggccacatcaactacgacgagttcgtcaaggtcatgacggccaagcgaaggagcaagaggacggaggagaaggcgacgcgcggcaagaagaaaccggtcggcggcgccgtccgactccggcaagcgtggccagatatgcgtgatcctgtgagccggagcttcggttgtccagtacatgctggtgcantggttgctgcgtgcgtgtcacccgctcgtactctgcttccggcacacagctgcgggaagctcacttngtcctgcaggtgaatgtagctgntgtaaatttatcagaacgtgtttgggacatgaattgaagggaaaaatcacctggagnaagggattttanncatctagaatctcctctaatcccctggctccccaacagctttaataagaaaaaccgag

SEQ ID NO: 81130 - protein, 222 aa, Zea mays
  misc_feature: Ceres CLONE 1566551
  misc_feature (12)..(40): Pfam Name: efhand Pfam Description: EF hand
  misc_feature (85)..(113): Pfam Name: efhand Pfam Description: EF hand
  misc_feature (121)..(149): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (197)..(197): Xaa is any aa, unknown, or other
  misc_feature (219)..(219): Xaa is any aa, unknown, or other
MADQLSEEQIAEFKEAFSLFDKDGDGCITTKELGTVMRSLGQNPTEAELQDMIAEVDSNGSGTIDEQEFLGLMARKMRDAESEEELREAFRVFDKDQNGVISAAELRHLMTNLGEKLSEQEVAEMVREADVDRDGHINYDEFVKVMTAKRRSKRTEEKATRGKKKPVGGAVRLRQAWPDMRDPVSRSFGCPVHAGAXVAACVSPARTLLPAHSCGKLTXSCR

SEQ ID NO: 81131 - DNA, 833 bp, Zea mays
  misc_feature: Ceres CLONE 1566552
ctccccgcggtggcggccgctctagaactagtggatcccccgggctgcaggaattcgtctcacccctagaaaaaaccggccagcgtcgttcgctctgtagcagtccagctctgcgcccggcgccgcagccccgcatcgcgcacaggcacaacttctacggtcctgccgctgatcgccgcacgtggccgcgccgccgcctccctcacccgagctcgaccgcgcttctccagctcgccgcctcgacggtcgctgcctcgacacctcccccgcgtgggcaccagccgggagcagagagccctggtccctggaggcgcgtcgcgttacggcgggggcgcggcttccccagccccccttggtgatcggtcctcccccggcagactcgcctcctcggtcttgcgctcctgcgcggctgcgcgcccagcgccgtgcccggtggcggcggcgaccggcgacggtcagcccccgacagtcaggacttccgactccggacctccccctcagccccctctgtccgtcccagtcccagctcgagcgtgaaggttgaaacaacaagcaagatattttgaaatagcccccgccacgaaattcttcagccatcgtggaggggttcagttcagggggagactcgactcaggaaacaggagcacgagcggagcagaaggcagtcatggcggatgaagtggagctcgctgcggaccagcacgtccgctacatcgttacggtgggagaagagaaaggaactctttgagtcccttgggaatggaacacattccgcttcaacggggcccaactgggggccttcaccagcgctcgaccttcttccacaaggctct

SEQ ID NO: 81132 - DNA, 889 bp, Zea mays
  misc_feature: Ceres CLONE 1566558
  misc_feature: Encodes the peptide sequence at SEQ ID NO. 81133
  misc_feature (70)..(70): n is a, c, t, g, unknown, or other
  misc_feature (72)..(72): n is a, c, t, g, unknown, or other
  misc_feature (536)..(536): n is a, c, t, g, unknown, or other
  misc_feature (544)..(544): n is a, c, t, g, unknown, or other
ctcacccgcggtggcggccgctctagaactagtggatccccctgggctgcaggaattctgtctcaccccntngaaaaaaaaaaaaaaaaaaaaaaaaaacttccaccgccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctgcagctcgcggtgtccaccatcaccgccaacccctcctcgccctccgcttcggcctccacctcctcgcgtgacccggccccttccgctccgttggcggtagatgcggagtacgtcgcgcccccgccgccgctgccgctgccgctgccgccccagcagcagccggggatcgcgtggaagctggtgacgctccccttccacgtggtctcgggtggggtcggcctcgtcgccggcacgttccgccttggccgcttgggagccggggggcgtgntttcccgnttccttttcctttcttgggctcccgggggaagcccggcagcggtgaccccctgctaaaatttgcccccttcaactggccaagggggccgaattcctccctagaattcaacccaaattttggcgctggccccggccccgctttttgggccaaagggttcccttaaagccctaaaaccaaccccccgcggaaattacaacctttgggttgggggacccccccccccccgggaacccggcagaaaccccggctttttggggggggggtgccttgggcaaaaacccctgcgggcgcctttttaaaaagaaaaaatttctttcccgggggggggataaaacaaaaaaaaa

SEQ ID NO: 81133 - protein, 181 aa, Zea mays
  misc_feature: Ceres CLONE 1566558
  misc_feature (125)..(125): Xaa is any aa, unknown, or other
  misc_feature (128)..(128): Xaa is any aa, unknown, or other
MAETVDDKVSYFQAVTGISNTDLCTEILAAHNWDLQLAVSTITANPSSPSASASTSSRDPAPSAPLAVDAEYVAPPPPLPLPLPPQQQPGIAWKLVTLPFHVVSGGVGLVAGTFRLGRLGAGGRXFPXPFPFLGSRGKPGSGDPLLKFAPFNWPRGPNSSLEFNPNFGAGPGPAFWAKGFP

SEQ ID NO: 81134 - DNA, 857 bp, Zea mays
  misc_feature: Ceres CLONE 1566559
  misc_feature: Encodes the peptide sequence at SEQ ID NO. 81135
ccccgcggtggcggccgctctagaactagtggatcccccgggctgcaggaattcgtctcacccctagaaaaaatcgcctttgcccgcacacacggctcccattccatttccgctgcctgcctctgacgcgcacccacaccacctcgcctccctcagccctccgcagctcggcctctttgcgttgcgttgcgtgtgtatgtagtggccgcaacacaaaaatcaagagacgtgtatgtatatgcgacccccaacagccaacgaccggcctccaagcggtgggggtggaggagcagcagctggtgcaggtgcagcagcaggggacgacgacttcgccttctactgctcctacctccaggacgccgacgctgccgccgcctcagcgacgtcgacgctcgccctcgccgtcgacgaccccaaccccaaccccagcgccccagggatgacaaacggcccggcgcccggaagccaccgcgggggcaaaagaagccggaagcccccccggggaaggggatagaaggagggccaaagaaaggacggccaagaaaaggggtcccttaacccaaggcttgccccccccctcgcctggggcgggctcctgggaaggcgggaggggaatacttgccggaaccggggtggggggggcccccgcggaaaccctttccaaggcgggggaaactggggccctttttttccaagatctaaaaggccgaaacacccgggttctcgggggccccccccgtggggttttattcccccccaaaacaggggggagagaaagtttatgaacccccccccgaccaaaagtataaggggggcgccccccccggggtgcgagggggttcctggtggtgcgggcg

SEQ ID NO: 81135 - protein, 93 aa, Zea mays
  misc_feature: Ceres CLONE 1566559
MYMRPPTANDRPPSGGGGGAAAGAGAAAGDDDFAFYCSYLQDADAAAASATSTLALAVDDPNPNPSAPGMTNGPAPGSHRGGKRSRKPPRGRG

SEQ ID NO: 81136 - DNA, 796 bp, Zea mays
  misc_feature: Ceres CLONE 1566562
  misc_feature: Encodes the peptide sequence at SEQ ID NO. 81137
ccccgcggtggcggccgctctagaactagtggatcccccgggctgcaggaattcgtctcacccctagaaaaagagcttttcttgtgcgcagccgcagccgctgcttttcgttcgtcttcatcctacgcgagggcgaaacccagaaaccctctccctcctgtactccggccgacacatccaggggcgatgacgctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacatgcgttaatcacgagacaggaatggttgatccaaggaaagttggtttgctagcgaactggcagcgggactacacgatggagaacatcctcactcagctcaaagaaagagatggctgccttcgcagaatcgaaagttagtgcagccctcaagaggggacaatccttctaaacaaagggttcaacttggccccgttcatgggatcccacagtaaattgaaaagttttttgggggcctaaaaaaaagggttctaaaatctggggggcccccggcccgggccttttggggaatttttttaagaacctttatagggttccctggggaaccgga

SEQ ID NO: 81137 - protein, 139 aa, Zea mays
  misc_feature: Ceres CLONE 1566562
  misc_feature: SWISSPROT Homolog: EC 6.3.2.19 Ubiquitin--protein ligase
MTLGSSGAGSSVVVPRNFRLLEELERGEKGIGDGTVSYGMDDADDIYMRSWTGTIIGPHNTVHEGRIYQLKLFCDKDYPEKPPSVRFHSRINMTCVNHETGMVDPRKVGLLANWQRDYTMENILTQLKERDGCLRRIES

SEQ ID NO: 81138 - DNA, 954 bp, Zea mays
  misc_feature: Ceres CLONE 1566564
  misc_feature: Translation starting site: 478
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (682)..(682): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (711)..(711): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (723)..(723): n is a, c, t, g, unknown, or other
  misc_feature (724)..(724): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (754)..(754): n is a, c, t, g, unknown, or other
  misc_feature (762)..(762): n is a, c, t, g, unknown, or other
  misc_feature (763)..(763): n is a, c, t, g, unknown, or other
  misc_feature (770)..(770): n is a, c, t, g, unknown, or other
  misc_feature (771)..(771): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (842)..(842): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (867)..(867): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (898)..(898): n is a, c, t, g, unknown, or other
  misc_feature (924)..(924): n is a, c, t, g, unknown, or other
tggagctccccgcggtggcggccgctctagaactagtggatcccccgggctgcaggaattcgtctcacccctagaaaaaacccacgcctccactacaccacacagagccgcagcagactcgcaagggaaaggagatggatcgtctgcccgagtcgacccggagcatgaggaagtacgcgtcggaggccggcgggcttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgtttacgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatggggggccagatcgaggtcgtcaagtgctccctcctcggctccgtccactccaacctgctgctcgtgctcggcacgtccctcttctgcggcggcgtcgtcaacctcggctccgtacagccgtacgacaggacgcaagcggacgtcagcacgggcctcctcatcctcggcgtgctgtgccagtcgctgcccctggnnnntaaanaaaaggggggggggggnnnnnaaaaaaanannnnnnnnaannaaaaaaagggggaagaacannnannnnganggaaagannagggggnngnnnnnnnnnnngnnnnnnnnnnnnnnnnnnnnnnnnaannnnnannnnnnngnnnnnnnnnnnnngaggngnnnnnannnnnnnnnnnnnnnnanannnnnaaaaaagnnnnnnaagaggaaaaanaagggggaggagggggggagggaaanaaaagaagggggggaagggggaaaaaaggg

SEQ ID NO: 81139 - DNA, 1146 bp, Zea mays
  misc_feature: Ceres CLONE 1566565
  misc_feature: Encodes the peptide sequence at SEQ ID NO. 81140
  misc_feature (11)..(11): n is a, c, t, g, unknown, or other
  misc_feature (12)..(12): n is a, c, t, g, unknown, or other
  misc_feature (65)..(65): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
ggtgtttgttnntgggggctctaatactccctccgcctcccccctccccgcccggtctgtgtganccccacaannnnaaaaactgggactccccgcggtggcggccgctctagaactagtggatcccccgggctgcaggaattcgtctcacccctagaaaaacaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagcccgaaagcatcactaggcttacgccttctgaccccgaattaggcatgggggcacgttggaaattccccgtgttgaaatcagccaaaggacccaccctttgccaagggcctaaaaataacctccctggggggtgaacccgaaataggcggaaaagctaaggtaaccccggtgcaagggggaaaaaaggggtgggaaaaagaagaaaaccccccccccaagtttgggggggttaaaggtttgtgaaaaaaatataaggaaaaacacccggtgtggaaaacaaccccctgttgggcccttggaaagccctcttccctccacaaaaacacattaattgggcggggaaaaggggcggtgaaaaaaagggggaaaattcttcccctgtgaacaccgccccgcgtgggcccccgtgtttttggaaaaacaataatggaaggcccccggggcggaaaacttccaatataaggcccacgttggggccttcttgggctttaaagcgggggaaaattgtgaaaaccctcccaccccgcggaaggctccgttaagcccgcaaaagaggcagaagtctcttttcatataggggggcggaaatgggtccacctcggccttttagtggggaccccgcaaaaaccctgtg

SEQ ID NO: 81140 - protein, 39 aa, Zea mays; identical to SEQ ID NO: 59176
  misc_feature: Ceres CLONE 1566565

SEQ ID NO: 81141 - DNA, 944 bp, Zea mays
  misc_feature: Ceres CLONE 1566566
  misc_feature (344)..(344): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (462)..(462): n is a, c, t, g, unknown, or other
  misc_feature (463)..(463): n is a, c, t, g, unknown, or other
  misc_feature (467)..(467): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (486)..(486): n is a, c, t, g, unknown, or other
  misc_feature (490)..(490): n is a, c, t, g, unknown, or other
  misc_feature (495)..(495): n is a, c, t, g, unknown, or other
  misc_feature (505)..(505): n is a, c, t, g, unknown, or other
  misc_feature (507)..(507): n is a, c, t, g, unknown, or other
  misc_feature (514)..(514): n is a, c, t, g, unknown, or other
  misc_feature (515)..(515): n is a, c, t, g, unknown, or other
  misc_feature (528)..(528): n is a, c, t, g, unknown, or other
  misc_feature (530)..(530): n is a, c, t, g, unknown, or other
  misc_feature (535)..(535): n is a, c, t, g, unknown, or other
  misc_feature (537)..(537): n is a, c, t, g, unknown, or other
  misc_feature (538)..(538): n is a, c, t, g, unknown, or other
  misc_feature (548)..(548): n is a, c, t, g, unknown, or other
  misc_feature (570)..(570): n is a, c, t, g, unknown, or other
  misc_feature (595)..(595): n is a, c, t, g, unknown, or other
  misc_feature (596)..(596): n is a, c, t, g, unknown, or other
  misc_feature (602)..(602): n is a, c, t, g, unknown, or other
  misc_feature (604)..(604): n is a, c, t, g, unknown, or other
  misc_feature (609)..(609): n is a, c, t, g, unknown, or other
  misc_feature (613)..(613): n is a, c, t, g, unknown, or other
  misc_feature (615)..(615): n is a, c, t, g, unknown, or other
  misc_feature (617)..(617): n is a, c, t, g, unknown, or other
  misc_feature (621)..(621): n is a, c, t, g, unknown, or other
  misc_feature (649)..(649): n is a, c, t, g, unknown, or other
  misc_feature (650)..(650): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (669)..(669): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
  misc_feature (685)..(685): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (734)..(734): n is a, c, t, g, unknown, or other
  misc_feature (740)..(740): n is a, c, t, g, unknown, or other
  misc_feature (752)..(752): n is a, c, t, g, unknown, or other
  misc_feature (755)..(755): n is a, c, t, g, unknown, or other
  misc_feature (775)..(775): n is a, c, t, g, unknown, or other
  misc_feature (776)..(776): n is a, c, t, g, unknown, or other
  misc_feature (778)..(778): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (801)..(801): n is a, c, t, g, unknown, or other
  misc_feature (803)..(803): n is a, c, t, g, unknown, or other
  misc_feature (815)..(815): n is a, c, t, g, unknown, or other
  misc_feature (823)..(823): n is a, c, t, g, unknown, or other
  misc_feature (825)..(825): n is a, c, t, g, unknown, or other
  misc_feature (828)..(828): n is a, c, t, g, unknown, or other
  misc_feature (830)..(830): n is a, c, t, g, unknown, or other
  misc_feature (838)..(838): n is a, c, t, g, unknown, or other
  misc_feature (849)..(849): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (861)..(861): n is a, c, t, g, unknown, or other
  misc_feature (863)..(863): n is a, c, t, g, unknown, or other
  misc_feature (868)..(868): n is a, c, t, g, unknown, or other
  misc_feature (896)..(896): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (921)..(921): n is a, c, t, g, unknown, or other
  misc_feature (930)..(930): n is a, c, t, g, unknown, or other
  misc_feature (939)..(939): n is a, c, t, g, unknown, or other
ctccccgcggtggcggccgctctagaactagtggatcccccgggctgcaggaattcgtctcacccctagaaaaagacctggccctggctggctccgcctcctccgttccgtctcatcgctccttcctcgtcagttgttgccaccacccctccctcccatcctctccgcgtcgcccccatcccatcttggcctggacacctgggctgcctcgctccgtttccgcgctcgcggacgcgccgagtcgccggccgaaccagtcgcccgcccgcccgccctccctccctcccgccgctaccagcgtcgatctgcgaccgaagagcgattcaaaggcagggtgagggggnggggggnnnnnnnnnnnnnnnnnnnnnnnnnnnnnnnnnnnnnnnnnnnnngnnnnnnnnnnnnngnnnnnnnnnnnnnnnnngnnnnggnnnnnngggnnnngnngggggnnnnggnngggngggggggggggnnnngggngggnggggngggggggggngnggggggnnggggggggggggngnggggngnngggggggggngggggggggggggggggggggnggggggggggggggggggggggggnngggggngnggggngggngngngggngggggggggggggggggggggggggggnnggggnnnnnnngggggggngggggggggggnngnnggnnnnngggggggggggggggnnnggnnnggggggggggggggggggngggggngggggggggggnggngggggggggggggggggggnngngggggnnnngggggggggggggngngggggggggggngggggggngnggngngggggggnggggggggggngnnnnggggggngnggggngggggggggggggggggggggggggggnggggnnngnnngggggggggggggnggggggggnggggggggnggggg

SEQ ID NO: 81142 - DNA, 879 bp, Zea mays
  misc_feature: Ceres CLONE 1566567
  misc_feature: Encodes the peptide sequence at SEQ ID NO. 81143
tccccgcggtggcggccgctctagaactagtggatcccccgggctgcaggaattcgtctcacccctagaaaaagtgcactgttgcactgaccatcgtctcactcatctcatcaccgctttccgtttcgctcgtccgatcctcatcaccagctcgggagggaggtcgggagagagcacggacgatgtggcacgccgcggcggcccccaacaaccttcacccggccgtcgccactacatcgtcccctgcccttcgccgtgcgaggtggcccatcgctcgaccctcgtcgtcggtgaaggtccagtcctccaccaggaacggcaatggctccgctgacaacctggaccacctgcagagggcgtccaagggcaggcagcagcggcaggggccccccgctccaggcccgagggctagaagggtcgtccgcaccacaccattcgggctgtggtgggacagcttcccggaagcaaggactctggaccagatggtgcggaccatcatggacgccgacgacgctgaacccgacacccgcttcggcggcgtcgtgcctgcggcggtggcggcggcccccaccgccgtgccgcgcgcccgacactggcggacgccctgggaaggtcagggagcgcacgggggagtacctgggtccggttccacatgccagggatggcgcgtgacgacgtgcgggtccgcgtgccggaccgggacgcccgttgggggccgcaaaaaataatcaactcctgctagctacagcggccgccaaccacgagggaaattatcacgaggaagcctggccctcctgctaccttcggggggtaagggaccgggtgggactctccgtgaaaacgggaactggaatagtacccccccttaagtgaagcacc

SEQ ID NO: 81143 - protein, 181 aa, Zea mays
  misc_feature: Ceres CLONE 1566567
MWHAAAAPNNLHPAVATTSSPALRRARWPIARPSSSVKVQSSTRNGNGSADNLDHLQRASKGRQQRQGPPAPGPRARRVVRTTPFGLWWDSFPEARTLDQMVRTIMDADDAEPDTRFGGVVPAAVAAAPTAVPRARHWRTPWEGQGAHGGVPGSGSTCQGWRVTTCGSACRTGTPVGGRKK

SEQ ID NO: 81144 - DNA, 846 bp, Zea mays
  misc_feature: Ceres CLONE 1566570
  misc_feature (395)..(395): n is a, c, t, g, unknown, or other
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
ggagctccccgcggtggcggccgctctagaactagtggatcccccgggctgcaggaattcgtctcacccctagaaaaaggccttcttaccctttgcttctcttctctgccgctagggaggcgctgacactgttcctcttccctcctcctgctctctccccatgtcctcctcctccggtcctcggcggccatgactgctgcggcctctttcgtccgtgcctgcgcgctgcatggctgctgccagctctagatacacactcctagctaggcagctgttgccttcacctgctgccgcgcgctgctcgatcgactgcacgtcttcacagttcacaccacagagtagagtggagagagaaagccaagaagccggcaggggagagtagggagagagagaangggggaggagtcnntnatgatagaaagaatctggaattgctttccctctcgttttgtcccccctgcgcctccttgattattgtgttgcttgctgttcctccctgcctgcttgccccctgcttcgggttggaggccttttcatgcatcaaacctcttagaatctctctacccctcctccaaacataacccccttgtctgaagccctgaatctggtttgccccatcctcctttctccctacaacagtgtcgcctcccggttactggtctggcacatcttcccttcaagctaggttttgttccgctagcgagtctagggtccccgcagggggttgtatttcttggtgaaattcctgcaattttcccacccccgccccgtgggcaaaagtccgcccaaaacctacttagcggcccccatggacgggcaaggggacatcagtgtttccatcctctg

SEQ ID NO: 81145 - DNA, 975 bp, Zea mays
  misc_feature: Ceres CLONE 1566571
  misc_feature: Encodes the peptide sequence at SEQ ID NO. 81146
  misc_feature (807)..(807): n is a, c, t, g, unknown, or other
  misc_feature (809)..(809): n is a, c, t, g, unknown, or other
  misc_feature (810)..(810): n is a, c, t, g, unknown, or other
  misc_feature (822)..(822): n is a, c, t, g, unknown, or other
  misc_feature (919)..(919): n is a, c, t, g, unknown, or other
ggagctccccgcggtggcggccgctctagaactagtggatcccccgggctgcaggaattcgtctcacccctagaaaaagccagacgcggacagcgagcgcgaccacatctatctaggacccgtatctctctctctcctcccgaccagcacgtcacgtgccacggacaggggtcaagcgcggtcgccgatgtcggcggcgggcggcagcggcagccgcgcccgcgccacctcgcggcccgcggcggcagcatggctgctgctggcgctggccacagcagcagcagcgtcggcgctggcgctgccagcggccgcgggcggcttcagctgccgtcctgggtcccggccggtgctcttcaacttcggggactccaactccgacacgggcggcatggcggcggccaaggggtggcacctcacgcgcccggagggccgcgccttcttcccacgccccaccggccggttctgcgacggccgcctcgccatcgacttcctctgcgaaagcttgaacatcagctatttgagcccatttctgaaggcgttaggctccaattacagcaacggtgcaaatttcgccattgctggcgcagcaacgcaaccgcgagatgttccatttgcgttgcacatacaagtgcaggagttcttgtacttcagagatagatccttggaactcatcgatcaaggtctaagtggtccaattgatgcacaaggattccaaaacgctctatatatgatagacatagggcagaacgatgtaaacgctcttctgtcaaacttgccctatgatcaaagtattgccaaattccaccnanntctgctgagatnaaggacgctgtccagactctatatagcaacggtagccgaacttctgggatcatgggacgggggctcttgggtgcttgccgcaaaagctgccataccntagaaaacgacggcgatcttgatcagtatggctgttcaagaccttaacaagactgc

SEQ ID NO: 81146 - protein, 244 aa, Zea mays
  misc_feature: Ceres CLONE 1566571
  misc_feature (55)..(242): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature (207)..(207): Xaa is any aa, unknown, or other
  misc_feature (208)..(208): Xaa is any aa, unknown, or other
  misc_feature (212)..(212): Xaa is any aa, unknown, or other
MSAAGGSGSRARATSRPAAAAWLLLALATAAAASALALPAAAGGFSCRPGSRPVLFNFGDSNSDTGGMAAAKGWHLTRPEGRAFFPRPTGRFCDGRLAIDFLCESLNISYLSPFLKALGSNYSNGANFAIAGAATQPRDVPFALHIQVQEFLYFRDRSLELIDQGLSGPIDAQGFQNALYMIDIGQNDVNALLSNLPYDQSIAKFHXXLLRXRTLSRLYIATVAELLGSWDGGSWVLAAKAAIP

SEQ ID NO: 81147 - DNA, 869 bp, Zea mays
  misc_feature: Ceres CLONE 1566572
  misc_feature: Encodes the peptide sequence at SEQ ID NO. 81148
  misc_feature (638)..(638): n is a, c, t, g, unknown, or other
  misc_feature (680)..(680): n is a, c, t, g, unknown, or other
  misc_feature (727)..(727): n is a, c, t, g, unknown, or other
  misc_feature (733)..(733): n is a, c, t, g, unknown, or other
  misc_feature (869)..(869): n is a, c, t, g, unknown, or other
ggagctccccgcggtggcggccgctctagaactagtggatcccccgggctgcaggaattcgtctcacccctagaaaaaactcacctctctcacacccgtgtcttccaccaagaggaagccgccgccacctccgcctgcgtgcccgctcccacccgcgcccgccgcgctcgccggtgcccccgtctaggccaaggtttgtgtcgctactcgctagactagaattccgcgcgcggacctttgccggctgagccgttctacggcatctcggtggggacaaccatgcgaatttccttggcgtcgacgttgacgccacctgcgccaccaccggtgaaggcctgcaggccgctgacctccgagacaggggaggcgcccgagctccacaacggtcgcggcctcgacgactggactaaggccgagcgctcgtcgaagttggactgccgctgcgtcggcccccgcgatgagtgcatcgagtacagctcggcggcgccgaagctcgaggcgcgcgcgccagtcgccggcgtgggcggcgcgccgtcgaccatggcgaagaagtcggcgtggttgaagttggagccctgcgggctgtgctgccgcgacaagctcatcgagtatatctccgcgcccgtcaggttggaccngcagcggcgtcgccatcagcagcaaccgatgcgacgccgacnaacagcgcaccgtgacgtgaagcctgccgtccctcgccacctcgggnctcatntcggcacgcccgccctacagcgacaaacacgttcgggtcacgtgcagcgacgccatggcccgccgtggtgtctaggaactggtctggcaatgagcgtcgtgcggcatgaaacttgagaagaacagcagcagtgtgn

SEQ ID NO: 81148 - protein, 189 aa, Zea mays
  misc_feature: Ceres CLONE 1566572
  misc_feature (120)..(120): Xaa is any aa, unknown, or other
  misc_feature (134)..(134): Xaa is any aa, unknown, or other
  misc_feature (150)..(150): Xaa is any aa, unknown, or other
  misc_feature (152)..(152): Xaa is any aa, unknown, or other
MRISLASTLTPPAPPPVKACRPLTSETGEAPELHNGRGLDDWTKAERSSKLDCRCVGPRDECIEYSSAAPKLEARAPVAGVGGAPSTMAKKSAWLKLEPCGLCCRDKLIEYISAPVRLDXQRRRHQQQPMRRRXTAHRDVKPAVPRHLGXHXGTPALQRQTRSGHVQRRHGPPWCLGTGLAMSVVRHET

SEQ ID NO: 81149 - DNA, 769 bp, Zea mays
  misc_feature: Ceres CLONE 1566573
  misc_feature: Translation starting site: 406
ctcaccgcggtggcggccgctctagaactagtggatcccccgggctgcaggaattcgtctcacccctagaaaaatttggctggagcctggagccgacggagcagaacgacggttccttgcggcggctgcgaccttgagttgagggcggctagaagagcgggaacaactcgatctccctttgctagctagatagtgccgcgatggacccgaaggttccttgcggcgacggcggcacccgtaacctagggccacgagaacgcatcgacgggagggctgagccaaaccacgtcctcgatgcgcgaatcctggagcctcagcgacagagcatcgaatccaatcaggaacaactttcatctataaactcaacgagaggtctcacctctattgaaacaccatgctaaaagaatgtggaatgagtccccaaaatatgatcctgattcaattgagttaaggtctgcagatgctaaacttgatattttatcatgggcagaatcacagtccctgcatagctggtctgccaaggattgccctcttttgccacctcctaggtcaactatggcagctgctttcagtccagatggaaaaacacttgcgtccacacatggtgaccataccgtgaaaataattgactgccaaacacggaaatgtttgaaagttttgactggacatcgacgcactgcgttgtgtggtcaggtatcatccattacattctgacatcctggctagcggaagttgaatacatgaagtcgtctatgggatgctaatactt

SEQ ID NO: 81150 - DNA, 933 bp, Zea mays
  misc_feature: Ceres CLONE 1566575
  misc_feature: Encodes the peptide sequence at SEQ ID NO. 81151
tggagctccccgcggtggcggccgctctagaactagtggatcccccgggctgcaggaattcgtctcacccctagaaaaaaccagcaagcagcagtctaccactgcaccatcccaccaatctcccaaattaagccatccgtcaccagccagccaaccagcactcactcactagctacgtccaactcgtacacaacccctctttctctctatcttctctccatccatccatcctctcgctcgcccttcgacagctagctaagcagtacgacgtagtatactagcatttagcagttcatcaacgcgctcaacctagcacgacgtacggcgatgaggcgccgcggcagcaactcctcgccgcttgcggctgctgccctgcccctcctactcctcctcgtcgccggctgcttccactgcgcggcaacggcagctcgccacctgccttctcctggcgccccagtccaagcgctggatcaccaagccgagaacggtgccaaggctgcatcagctggtgcagacggcgccggcggccttgtgctccaggaaggtggcacgggcaacaacggcgacgagctctcctccaacaccaccctcctcgagacgacgacgactatgggagcggaggcgtgcgacgacgggaacggcaaggacgagtgcgtgctgaggcggctgctcgtcgacgcgcacctcgactacatctacacgcagcacaagggcaagccgtgaccgtcagcgacgaagacggtgccgcggctgcagctgcagaaagcgaggagcgaggaattgacccactcattcctcaactaaaacatctataaatcataccaggggcgatgggtatctcatctgctgctactagctactagtactgcatcgatccaccttctgcgtgtgctgtatatttctgccacgcgcccatatatagcatgcatcatt

SEQ ID NO: 81151 - protein, 131 aa, Zea mays
  misc_feature: Ceres CLONE 1566575
  misc_feature (18)..(130): Pfam Name: PSK Pfam Description: Phytosulfokine precursor protein (PSK)
MRRRGSNSSPLAAAALPLLLLLVAGCFHCAATAARHLPSPGAPVQALDHQAENGAKAASAGADGAGGLVLQEGGTGNNGDELSSNTTLLETTTTMGAEACDDGNGKDECVLRRLLVDAHLDYIYTQHKGKP

SEQ ID NO: 81152 - DNA, 1002 bp, Zea mays
  misc_feature: Ceres CLONE 1566576
  misc_feature (264)..(264): n is a, c, t, g, unknown, or other
  misc_feature (269)..(269): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (510)..(510): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (758)..(758): n is a, c, t, g, unknown, or other
  misc_feature (759)..(759): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (912)..(912): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (940)..(940): n is a, c, t, g, unknown, or other
ccgagctgaagctcaccgcggtggcggccgctctagaactagtggatcccccgggctgcaggaattcgtctcacccctagaaaaattttttgcttagcactggcacagcgcagcacatgaggagaagaagagggaggagtaattatttattaattaacaaagagaagacttcttccttcctcgtcgtctccagcccattccaattcttgattccatcgccccaccatccacaactcccctaatccttccaacctcctcgtcgtnccagntnnnccacctactcttccacgtcgcaatgggccagctggcataggcggcacccaacccgaattccaagggattctttttttctggggagggcggctcttaaagaagcccctctggggggggggggcccccccctcaaaaaaaaaagaatgtatttggggttttctttctccccccgccaagaaatcatttttttttttttttcttttttattggaaggaggcatacctcaccccccccccnccggggacaaataataggggccccccagagggaaaattatattattttttctttggtttttgtggtggtttgacgagttataggggggtcgtgtctctgcctcctcacccctctattcgccgattgtgaacctactatatagaagtgcagtgatgtgatgttttttggcgagggtgcttttaagctcgcgcgggggtggaatctcgtgtcggccgcccccccnnnnnnnaagtaatgagagaagggcnncnnnctgtacctnnntatatagtcgctcgtcttctgtgtagtgtcaaatgagtgatttattttcttatcttccttgggggagggggttggcgcgtggggcgggctctatctccctgcctctcgctcccacaaacagaaccagcagggggcggngtnnnnnttaagtcggagggcgaagatntcaatacatctcctacctatactgccgtcgtgttgtagatccctcgcttgtccgactcatgg

SEQ ID NO: 81153 - DNA, 796 bp, Zea mays
  misc_feature: Ceres CLONE 1566579
  misc_feature (578)..(578): n is a, c, t, g, unknown, or other
  misc_feature (663)..(663): n is a, c, t, g, unknown, or other
  misc_feature (666)..(666): n is a, c, t, g, unknown, or other
  misc_feature (678)..(678): n is a, c, t, g, unknown, or other
ccccgcggtggcggccgctctagaactagtggatcccccgggctgcaggaattcgtctcacccctagaaaaagccacaacatcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtcccaaatcggtcgatggaaaatggaatctcgatggcttttgttaaatctggattgctatgcatgtctagcgatgcacttggatttttggtacagtgagattggtagccgcacatggggaatctcgatggcttttgttaaatctggattgctatgcatgtctagcgatacacttggatttctggtaccgtgagattggtagttgcagatggatacagggggccttagtgaagtggcagcagaagacctgaatatngggggtggacacatcttctcatctggacgttgaagcaatgtcttcagttccttggtggtggtcggttaatgcttctttggaacanggntgtctggcattnaacttgagctgttatggatatctggtctattactatcagcaaaaggccggggctattttgggccttgaactctacaaaaatcccaatgtcacggacacatctcattaaatgtttatac

SEQ ID NO: 81154 - DNA, 901 bp, Zea mays
  misc_feature: Ceres CLONE 1566584
  misc_feature: Encodes the peptide sequence at SEQ ID NO. 81155
ccgcggtggcggccgctctagaactagtggatcccccgggctgcaggaattcgtctcacccctagaaaaacccgtgctcgtcatcaccacccacatctcagttcaccccggcgtcgtcctcttcccccggagctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccagcaacaccttctcgtactatgaccaggtccttgataccacggccatgcttggtgctgtcccagagcgctactcttggactggaggcgagattggcttgagcacctatttctcaatggccaggggaaatgccactgtccctgctatggagatgaccaagtggtttgatacaaacttacacttttattgtccctgaacttggcccaagcaccaagtcacatacgcttctcacaaggctgtttcttgagtacaggagggcaaagcccttcggattgatactgtccccgtggctggtggaaccaagggcaaactggccccttcccaaacccgccaagggggtgggagaaaattttctccctttttttccgcttttggggaaattttttccccttttaaaagggggtttttttctaaaataaaagggacgggggggcctctggggataccggttggaaaaacccacaccccttttaaaaacaccttttgtttttccacaatgtgtggggcctctttctctttcaacaattttttaaaaaaaaagaggggcggtctctttcttggggtg

SEQ ID NO: 81155 - protein, 122 aa, Zea mays
  misc_feature: Ceres CLONE 1566584
  misc_feature (2)..(123): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSSADDLEKVASDLRSSIWKQMSEAGIKYIPSNTFSYYDQVLDTTAMLGAVPERYSWTGGEIGLSTYFSMARGNATVPAMEMTKWFDTNLHFYCP

SEQ ID NO: 81156 - DNA, 825 bp, Zea mays
  misc_feature: Ceres CLONE 1566590
  misc_feature: Encodes the peptide sequence at SEQ ID NO. 81157
  misc_feature (594)..(594): n is a, c, t, g, unknown, or other
acccgcggtggcggccgctctagaactagtggatcccccgggctgcaggaattcgtctcacccctagaaaaagacgatgcgtgcgtgaatgattgacacggactacgcgtacacttgcaataatgctgccgcaaccccccagcagcagtgcagcaccccgtcccctccccctattaataaaaaaaaagattctgacagccgaaagcgcgcacggtgctgctgacctgccctgcccacgccatgttcgcgcccacccgcttcacgtggccggctccccgcggctgaccggatcgttgagcccggtcgtacgtacgtacgtcgcccgctgccccctcgtcgtcgaccccggcattccccattcccgttcccaggcagtgcgttgcttgcagttgcggtggccggccgcggaggcgtcgacgaagcatggggaaggcggggcgctggctccggagcttcctgtcgggcaagaaggacagacaggcggcgcctcccaaggacaagcggtggagcttcaggcggcccccgccggcggcgcaggaagggacggcggcggaccagcaccaccatgggccgccgctcggtctgccggcgccnggcgtcgacgagctcgacttcgaccagaagaagcacgccgtggcggtggccgtggcgaacgcggcagcggccgacgcggcggtgggcggcccgcacgccgcagccgcggtggggcgcctgtcctcccgggccgggccgggctttgaaccgccggcggggcctcgtcaaggaacccgcggcccgtcaggaatccaggcccctttcaaagggtatctgggccggggacgggtt

SEQ ID NO: 81157 - protein, 134 aa, Zea mays
  misc_feature: Ceres CLONE 1566590
MGKAGRWLRSFLSGKKDRQAAPPKDKRWSFRRPPPAAQEGTAADQHHHGPPLGLPAPGVDELDFDQKKHAVAVAVANAAAADAAVGGPHAAAAVGRLSSRAGPGFEPPAGPRQGTRGPSGIQAPFKGYLGRGRV

SEQ ID NO: 81158 - DNA, 1238 bp, Zea mays
  misc_feature: Ceres CLONE 1566591
  misc_feature: Encodes the peptide sequence at SEQ ID NO. 81159
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (838)..(838): n is a, c, t, g, unknown, or other
  misc_feature (1238)..(1238): n is a, c, t, g, unknown, or other
ggggggggacgnntctntaaaaaacggggcggataggcaggagcttcaccaaaaacannnnnnnnnnnnnaagagctggagctccccgcggtggcggccgctctagaactagtggatcccccgggctgcaggaattcgtctcacccctagaaaaactccgccgcacaggcgctcagctccgcaacgccgccggaaatggtcgccgccaccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacacagcaccgcttccgggacgtgcttgttacggaaggccttggccgccccgggcgggaactttaccaccttcaaaccgccccgaagaaagggtaccccccgggacgagggtctccaacgagctttcaagccttaccgagcctccatttctacaactggcccgctggacacacgcgtaaatgaaaggccccgacttcgggatttttggggggacaccagtaatagttcgcccggtcacaccagaccctgctatgcgcgggggctaaaatttctggagagctcccgcacgccctcacattgaatccatcaactctttgcattatcgttccactgatttgagctcgcgtagataggccgccacattctatcacaccactgtatcgtaccgggtaatcagatatatctgactatcgtgatactnagacgacgtaccgcataatagtatggacttctcaaaaatgagggagtgataaatcacaaggccaacgtggagcataacattttatggtaatatgagtatctattggcgcgaaatactttaaacttcctattgaggacgccggtgtttagtcagggcatcacgtatacgaatttgtgctgtcgcgcaccgctgtagggacacgtactatcagtgcccgaagttatgtcgttcccgcgcagtgtgtgttacagagataatcctccttatttgggacgggcgaaggccctgactcagactgcgtatgtgctgcccacgtgctctctgggctgacgctaccttgtgttaccacgtcggagtgactttagtgtcggtcggccccttacactagccacagctgttn

SEQ ID NO: 81159 - protein, 126 aa, Zea mays
  misc_feature: Ceres CLONE 1566591
  misc_feature: SWISSPROT Homolog: EC 1.3.3.4 Protoporphyrinogen oxidase
MATAASPLLNGTRIPARLRHRGLSVRCAAVAGGAAEAPASTGARLSADCVVVGGGISGLCTAQALATQHRFRDVLVTEGLGRPGRELYHLQTAPKKGYPPGRGSPTSFQALPSLHFYNWPAGHTRK

SEQ ID NO: 81160 - DNA, 881 bp, Zea mays
  misc_feature: Ceres CLONE 1566593
  misc_feature: Translation starting site: 146
  misc_feature (798)..(798): n is a, c, t, g, unknown, or other
  misc_feature (799)..(799): n is a, c, t, g, unknown, or other
ggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggctgccccgctcggcgaggtcgtcgacccgctctatcccgggcgcagcttcgacccgctcggcctcgccgacgaccccgaaggcttcgctgagctcaaggtgaaagagctcagacggnncgctcgccatggtctcatgttcggatttctcgtcaagcatcgtcaccgggaggggccgctcaagactcgctgacactttgcc

SEQ ID NO: 81161 - DNA, 841 bp, Zea mays
  misc_feature: Ceres CLONE 1566594
  misc_feature (154)..(154): n is a, c, t, g, unknown, or other
  misc_feature (192)..(192): n is a, c, t, g, unknown, or other
  misc_feature (255)..(255): n is a, c, t, g, unknown, or other
  misc_feature (257)..(257): n is a, c, t, g, unknown, or other
  misc_feature (284)..(284): n is a, c, t, g, unknown, or other
  misc_feature (286)..(286): n is a, c, t, g, unknown, or other
  misc_feature (298)..(298): n is a, c, t, g, unknown, or other
  misc_feature (302)..(302): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (335)..(335): n is a, c, t, g, unknown, or other
  misc_feature (337)..(337): n is a, c, t, g, unknown, or other
  misc_feature (408)..(408): n is a, c, t, g, unknown, or other
  misc_feature (413)..(413): n is a, c, t, g, unknown, or other
  misc_feature (443)..(443): n is a, c, t, g, unknown, or other
  misc_feature (481)..(481): n is a, c, t, g, unknown, or other
  misc_feature (534)..(534): n is a, c, t, g, unknown, or other
  misc_feature (535)..(535): n is a, c, t, g, unknown, or other
  misc_feature (669)..(669): n is a, c, t, g, unknown, or other
  misc_feature (742)..(742): n is a, c, t, g, unknown, or other
  misc_feature (746)..(746): n is a, c, t, g, unknown, or other
ccggtggcggccgctctagaactagtggatcccccgggctgcaggaattcgtctcacccctagaaaaaaccctcgcaccctcaccgaaaggagaaggcttcagccttcaagcgcacacagccacgcaaatcccctcttcatcaacctcgactcnagtccgcgcgcgtccccgaatccagaggagatgagtcntccgcatgacggtcacaggtccttctttcccatggggaatcccttcaggatgattctcccaanangaacccgcctgtcacccaaactcactnanctgctcacttcntatnaannnaagggccctggcccccccaacccttttnanaaaaagtccaaaaccccccaaaaaccccccccccctaaggaggggggggggggtcgtctacgccgaccccnccccnaaaaaaaaaaaccccccccccccccccttntaaaaaaacccccttttttcctttaaaaaaaccccccnccccccccccccccccaacaaaaaaaaaaaacccccccccccccccccccccnncacttcctcccactcccccaaccaccccacaaaaaaaacatactaccccccccccccccctctcttctataacccccccaaccaccctccccccctattatccccccataaacacaaaccaacccacaaccaanaaaaaccttcccacccatacatacaacccttccccttattcctcctaacccctcccccccaccccccataacncctncccccccaaaaatacatccaacataatcttcaccccccctcccccaccacctaaccccctcaccacctcatttttctataataaggggggggggg

SEQ ID NO: 81162 - DNA, 841 bp, Zea mays
  misc_feature: Ceres CLONE 1566595
  misc_feature: Encodes the peptide sequence at SEQ ID NO. 81163
  misc_feature (759)..(759): n is a, c, t, g, unknown, or other
ccccgcggtggcggccgctctagaactagtggatcccccgggctgcaggaattcgtctcacccctagaaaaaacctccccgctccgctctcccttgtcgagttctcagcaccggccgatccatcctcctccgcctccctcggttcggcctctggcctgcacaccatgaactctcgcttccggagcctctggagagccatggctggggctttgcagccgccgtgccgcctcggagctgccgcgtgtagcttgctcgctgagcagcagctatagtagctgagcgagtgcgtccatcgatcggagtcgtccacctccgtctccctttgcgattcggcgtcgtgaactcgtgttcttgagcgtgggggcaaggggcagagcaacaaggagacacttcttcttcttctttacaacaaataagaaagcaacggcaatggagggagctggtctgcagtgacagtgacacgagccatggatcccgagccattcgtgcggctctcagttgggcagctcggtctgaagctccccggcgggaacgctagcaaggcggccggccggctctgcgactgcgagatccggctgggcgggttcccggtgcagaccgctccggtgccgctggtccactccccggcgttcaacctcgacccatttcacaacgcggcggttttctccctcgaggaatccgacctcaggcgctggcggcgccggggtgcttccgggccccgcggtcgtcgtgctttgaagtcgcggtgtactaactggnccggcttcgggcttcacgctgtggtggccctcccctgcggaaggaagcggcttgtttgcctggttcagggtggagctcgctt

SEQ ID NO: 81163 - protein, 124 aa, Zea mays
  misc_feature: Ceres CLONE 1566595
  misc_feature (98)..(98): Xaa is any aa, unknown, or other
MDPEPFVRLSVGQLGLKLPGGNASKAAGRLCDCEIRLGGFPVQTAPVPLVHSPAFNLDPFHNAAVFSLEESDLRRWRRRGASGPRGRRALKSRCTNWXGFGLHAVVALPCGRKRLVCLVQGGAR

SEQ ID NO: 81164 - DNA, 904 bp, Zea mays
  misc_feature: Ceres CLONE 1566596
  misc_feature: Translation starting site: 187
  misc_feature: SWISSPROT Homolog: EC 2.7.10.2 Non-specific protein-tyrosine kinase
tggagctccccgcggtggcggccgctctagaactagtggatcccccgggctgcaggaattcgtctcacccctagaaaaaattcggcctatcacaaccacttactctcgtgcgctctccgtgggagcgaggactcgcggccggcgcagcggcaggttctcctagatctccggcatcatcagtaacaaatggctgacggtgaggacattcagccccttgtttgtgacaatggaactggcatggtcaaggctggttttgctggtgacgatgcgccaagggctgttttcccaagcattgtcggacgcccccgtcacactggtgtgatggttggcatggggcagaaggatgcgtatgttggtgacgaggcccagtccaagaggggtatcctgactttgaagtaccccatcgaacatggtattgttagcaattgggatgacatgggagaagatctggcaccacaccttctataatgaactccgtgtggcgcctgaagagcaccctgtgctgctgacggaagccccactcaaccccaaagctaacagggagaagatgacccaaatcatgtttgagaccttcaaatgtcctgccatgtatgtcgccatccaggctgtgctttccctgtacgccagtgggcgtacaactgggattgggttggactcggggggatggtgtcaccccacccgtgccaatctacaagggtatgccccttctcaggccatcctgggttttggaccttgctgggggtgacccgactgacacccggatgaaaatcccccccgaaagaggtcccctttcacccccggcgcaaagggaaaatgtgggggaatctaaggaaaacggggaaccgggcctctggatattttcggggggggggaaaccccaagaaccccctctgggaaaaaaacc

SEQ ID NO: 81165 - DNA, 834 bp, Zea mays
  misc_feature: Ceres CLONE 1566597
  misc_feature: Encodes the peptide sequence at SEQ ID NO. 81166
  misc_feature (834)..(834): n is a, c, t, g, unknown, or other
acccgcggtggcggccgctctagaactagtggatcccccgggctgcaggaattcgtctcacccctagaaaaaatgcccagtgcggcagtgcctgccaccgtctaagcccaccccaagtctccgccgtcaacccgtcctccccatggccgccgccgccgccatctctctatccttccactttcgtttccgcccgccccttccatctccacgtacccccacgcgccacgctcccttttccttgttctccccttcccttcttgccccctgccgcctccgcgtcgctcccggccgcccctcaccgtccccgtggcgccccgacgtgcgggcgcgcgctggaagcaccatcggggcgccgcctgcgcttgtgcgcccaggcggaagccgtggagacggaccgcctccccctcgacgtgcgggaccggggcatgggaggcgggcgatcaacctcggggggtcggggtcaccataaggagacgtcgcttctcggggctggggctgcagcttcggggagggcggaacgcgcgcctccaaggaattcgccgccgaacacttaaaggctccccgggaggtattcggaaagaacggggaaggggcctaaacctttttccccaaaaggaataaaaggggaaaagattgggggggaaaaaacttttttaagggaaggcgggttcaaaccccccttgggttaaacaaaaacacaaaaaaaggggggggcgctttatggggggaacgggtgtttctatttttgggcactgggcccctcaattggcccacaaatggggggggggggggaaaacaaaaaaaaaaaattggcatattttttctcgaggggtn

SEQ ID NO: 81166 - protein, 42 aa, Zea mays
  misc_feature: Ceres CLONE 1566597
MGGGRSTSGGRGHHKETSLLGAGAAASGRAERAPPRNSPPNT

SEQ ID NO: 81167 - DNA, 900 bp, Zea mays
  misc_feature: Ceres CLONE 1566599
  misc_feature: Encodes the peptide sequence at SEQ ID NO. 81168
  misc_feature (14)..(14): n is a, c, t, g, unknown, or other
ggaagaccgtcaantaaaggggccccgggctgcagtccacgtctgagggctagaaaaaaagaccaagaccaacaccactccactccctctatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccgcctcgccggcgacgcgaagaagtccggcgccggcacgctcaggctggatgactgggtgctgtgccgcctgtacacaagaagaacgagtgggagaagatgcagcagcagaaggagaaggagaagaaggcgaatggagtcgggaagcgttgcctctcggtctcgcactcccactccgaaaagcggaccccggaagtcgagatcgacgacgacccgttcccggaactgggctctctggcggggtttcaacgaatgtgggccaggcgcaggccccagcca

SEQ ID NO: 81168 - protein, 236 aa, Zea mays
  misc_feature: Ceres CLONE 1566599
  misc_feature (21)..(147): Pfam Name: NAM Pfam Description: No apical meristem (NAM) protein
MAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTAGIKKALVFYHGKPPRGVKTEWIMHEYRLAGDAKKSGAGTLRLDDWVLCRLYTRRTSGRRCSSRRRRRRRRMESGSVASRSRTPTPKSGPRKSRSTTTRSRNWALWRGFNECGPGAGPS

SEQ ID NO: 81169 - DNA, 888 bp, Zea mays
  misc_feature: Ceres CLONE 1566602
atagctggagctccccgcggtggcggccgctctagaactagtggatcccccgggctgcaggaattcgtctcacccctagaaaaaatccccatccactctactttacaccgcaggcagtgagccagccactgagccacaaagctatctatctctgagcgacgtcaagcaccaacgcaacgaccaccaccaccacggcaccacctggagctacaagctatggcgaagcgtctcctccgctcttcgtcccttcctctggccctggtgccgccgccgctgctgcttctcctggtagcgggatcgctcgcaggggcaaccgcgcttggcagcttccctggggaacgtcgtggtcgaagcctgcagcagctgccaaacccgatgcctcagcctgtcccgcagccgcagccagacccaaacgtacggccgcaaccggggccgccgaacccgctgccaccacagcccctgccgcaaccaaatccaaaccctcagccgcagccccttccgcaaccacagccaggcccgcagcctgacccaaacccacaacctcagcctcagcctcagcccctcccgcagccacagcctggcccaatcccgccacagcctgacccgaacccacagccacaacctcaacccttgccacagcctagcccgatcccacagcctggcccgatcccaaacccacagcccatgccgatgccagacccaaatgtgcagcagccacaaccacaacctgctcccaacataatccacagccgcagtctgatcagctctccggggggtccacagcacttccaacagcgtaacaaggatgttgaacccgcgatacacatggcttttagctttgctgctttgtactatatagctctgtacatacacagtttttttccgtgt

SEQ ID NO: 81170 - DNA, 822 bp, Zea mays
  misc_feature: Ceres CLONE 1566603
  misc_feature: Encodes the peptide sequence at SEQ ID NO. 81171
ccccgcggtggcggccgctctagaactagtggatcccccgggctgcaggaattcgtctcacccctagaaaaactaccgcttgtccgtttcttcctcttccgaggtagcaacgtggtgagtgaggcagccgctgctgtgctgcactgctgctgcggaggcccaagccgaccggcggagagcacccgtccttgggcggcggagggtggaaggtggatgctctaagcccccgcctctctctgccgccttatacccccgcgttttatccttcttctagcttcttcattcacctgttccagaataaggccgggcttgcggatgccggggtgcggagtagcggggagaggtggtgtggagggtatcgtcggccgcgcgccgcactccgccacaaaggaagagccgcccctgcctctggatgactatcgctcgcggctacgggaggcaacatgagctcaaatattgcacatcgccacaaagcaaatctgtgttactagaagcaagatttggtcgacatgttactaggagcactgcttatctgctccaaaattcccggagcactgcaatgaccagactacagaagtctggggagtttctgcaacctgtcttggactcctcaagaattatttgactagtacattctacaatgcaggcttggaagaggagagttctgtccgagggttgagtgctttgctgtctccagatccaataaacaatgcctggggtgaaaccaaggacaggcggaaaaacttcccccaatttggggaaagccccctgggtgtcccaccccgaaaaatccacccttcccctgttcagggaacacccggt

SEQ ID NO: 81171 - protein, 70 aa, Zea mays
  misc_feature: Ceres CLONE 1566603
MTIARGYGRQHELKYCTSPQSKSVLLEARFGRHVTRSTAYLLQNSRSTAMTRLQKSGEFLQPVLDSSRII

SEQ ID NO: 81172 - DNA, 945 bp, Zea mays
  misc_feature: Ceres CLONE 1566604
  misc_feature: Encodes the peptide sequence at SEQ ID NO. 81173
ggagctccccgcggtggcggccgctctagaactagtggatcccccgggctgcaggaattcgtctcacccctagaaaaaacgcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcggtcgcgcggttctggtgccacttcgccgacgacaagctcgggccggcggtgggcgcggtgttcgcgtcgacgggggagggccaggaggcggcggtgcggcaggtgcacgagaacctggcgctgatcgagtccgagctccgcgacggcgcgttccggggccgccgcttcttcggcggcgacgaggtgggcctgctggacgtcgtcctgggctgcggctcctactggctcgccgtgttcgaagaggtgatcggggtgcgcctcgtggacgccgacgcctttccgcgcttccacgcctggctgcgcgactttctagccctggacgaggtccgggagaccatccccgccgtggacgcctgctcgagtacccgcgcgggctccgccccatgctgctcggccctccgggggccgggcgcggggccaggccggaccgcccttcaacgaaggccccggcggaaccggcgggcttggtgtgaatccccgtcgaattttaaaccaaggcgttctctccccggggtgttt

SEQ ID NO: 81173 - protein, 277 aa, Zea mays
  misc_feature: Ceres CLONE 1566604
  misc_feature (14)..(87): Pfam Name: GST_N Pfam Description: Glutathione S-transferase, N-terminal domain
  misc_feature (108)..(211): Pfam Name: GST_C Pfam Description: Glutathione S-transferase, C-terminal domain
  misc_feature: SWISSPROT Homolog: EC 2.5.1.18 Glutathione transferase
MEKTSENAIPPAASPLMLFGSWASSYTHRVQLALRLKGLEYDYVEEDLGNKSDELLRHNPVHKKVPVLVHGGRALPESVIILQYLDDAWPETRPLLPADAFDRAVARFWCHFADDKLGPAVGAVFASTGEGQEAAVRQVHENLALIESELRDGAFRGRRFFGGDEVGLLDVVLGCGSYWLAVFEEVIGVRLVDADAFPRFHAWLRDFLALDEVRETIPAVDACSSTRAGSAPCCSALRGPGAGPGRTALQRRPRRNRRAWCESPSNFKPRRSLPGVF

SEQ ID NO: 81174 - DNA, 783 bp, Zea mays
  misc_feature: Ceres CLONE 1566605
  misc_feature: Encodes the peptide sequence at SEQ ID NO. 81175
ccccgcggtggcggccgctctagaactagtggatcccccgggctgcaggaattcgtctcacccctagaaaaaaactcaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcatcccctacaccatcagcacctccaccgactgctccagggtgaactaaaacctagaccacgcgcgacgacggccgcctgatcgatcgaccaaccattccgccgtcgccgccggccggatcatcgatcgtcgtcatgatgatatctatcaatctacgcgtgatgatcgatggctacttgtctactgctatgtactactaaataaaatctctccgtgtgtgcacgtacgcttgcatgtgcatggtagcatgtatgtacgacgtcgtccatgtatgtgtgtgtgacgtgtgagacagaaga

SEQ ID NO: 81175 - protein, 121 aa, Zea mays; identical to SEQ ID NO: 62569
  misc_feature: Ceres CLONE 1566605
  misc_feature (32)..(117): Pfam Name: Tryp_alpha_amyl Pfam Description: Protease inhibitor/seed storage/LTP family

SEQ ID NO: 81176 - DNA, 846 bp, Zea mays
  misc_feature: Ceres CLONE 1566606
  misc_feature: Encodes the peptide sequence at SEQ ID NO. 81177
tccccgcggtggcggccgctctagaactagtggatcccccgggctgcaggaattcgtctcacccctagaaaaactcgcatcggcctgtacctagccgccgtcgccacagagccctcatctcgtccgtcctcggcggcctccgcggagcagccgtcgctggagaccaaagatccggccagatctgatgtcaggagggactggctcatccgggcgcgcggccccgcggtacgccccggatgacccgacgctgcccaagccgtggcgcggcctcgtcgacggcaccaccggctacctctactactggaacccggagacgaacgtcacgcagtacgagcggcctgtgccccccgagagccagctcctcccgcctccgcctccgttgccacccccgcctccacggagccgcgaccgccgcgacaggtccagatcccgatcccgcaccccgccccggcgcgaccacagggaccgcgaccgtgaccgtgacaggcgccacgacgagcacgcgtcctccaagacggcgtctttccaccaccatcccgctccggaagccgtcgccgacgatccttccaccgaaggataccgccgcccccatgagatcaccgtcacgggggaatatgtgccgactcccataacttcatttggaggcttggtggcttcctcggtcgaaattcctgaaaggaaataccacgtggcctgggattcgcaaagccccaacacctaatccaagccccagtcaatgggccaaagttgctattccaaaattcaagaatggtaggaagctttttggccaaagaactgggaatccgggccaagaaccccctgtggggaaatcaaccatctcccggg

SEQ ID NO: 81177 - protein, 178 aa, Zea mays
  misc_feature: Ceres CLONE 1566606
  misc_feature (22)..(52): Pfam Name: WW Pfam Description: WW domain
MSGGTGSSGRAAPRYAPDDPTLPKPWRGLVDGTTGYLYYWNPETNVTQYERPVPPESQLLPPPPPLPPPPPRSRDRRDRSRSRSRTPPRRDHRDRDRDRDRRHDEHASSKTASFHHHPAPEAVADDPSTEGYRRPHEITVTGEYVPTPITSFGGLVASSVEIPERKYHVAWDSQSPNT

SEQ ID NO: 81178 - DNA, 965 bp, Zea mays
  misc_feature: Ceres CLONE 1566607
  misc_feature: Translation starting site: 198
  misc_feature (664)..(664): n is a, c, t, g, unknown, or other
  misc_feature (701)..(701): n is a, c, t, g, unknown, or other
  misc_feature (823)..(823): n is a, c, t, g, unknown, or other
  misc_feature (893)..(893): n is a, c, t, g, unknown, or other
  misc_feature (965)..(965): n is a, c, t, g, unknown, or other
ggagctccccgcggtggcggccgctctagaactagtggatcccccgggctgcaggaattcgtctcacccctagaaaaactcccagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcctggacttttggctcacagcgtttttgagccatcctctactaagtgagcttctgactgaagaggatcagaagatattcaagtacttggactccattgatgtcgatgattctgatgttaaggcaggatattccatttaccttaacttctctgagaacccgtactttgaagacacaaagcttacaaagacctattcctttgttgatgatggaacaaccacaataaaagcttctcnaattaagtggaaggatggaatgggaccctgcaatggnaatggtattaacaagaacggaaacagcggccattagtagtggaaagtttttctcctggtttagtgatacagagctcaagagtcttgctgatgggtgtgcagatgaggttgcggagatcatcnaggaagacttgtggcttaatcccttgaaggacttcaacatgaagtttgagatgaatttgaggagatgaangagatgatgacgacgacgacgacgatgattatttggatgttgatgacacgagaccctcgaagtacccatttn

SEQ ID NO: 81179 - DNA, 816 bp, Zea mays
  misc_feature: Ceres CLONE 1566608
  misc_feature: Encodes the peptide sequence at SEQ ID NO. 81180
tccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtgcaacgagtgcgccttccccgtctgccgggactgctacgaatacgagcggcggggagggcacgcagaacttgccccccgtgcaagactcgatacaagcccctcaagggctgcccagcgtgtgaaccggggaaccaggaggaaggaaccggctccaatgacctggaacaaccaagttcactggggacggcttgaacccccattttggggccaaattcattgttttaagggccacttggattacggcccgggggggggccccctaagggggggcccaaaagttttcccggttacaccccagttttcccttcctcccacacaggggaaaaggggggggaaaaacttcccccccggaagaccccccgccgggggggcctctttttttg

SEQ ID NO: 81180 - protein, 185 aa, Zea mays
  misc_feature: Ceres CLONE 1566608
  misc_feature: SWISSPROT Homolog: EC 2.4.1.12 Cellulose synthase (UDP-forming)
MEASAGLVAGSHNRNELVVIRRDGDPGPKPPREQNGQVCQICGDDVGLAPGGDPFVACNECAFPVCRDCYEYERRGGHAELAPRARLDTSPSRAAQRVNRGTRRKEPAPMTWNNQVHWGRLEPPFWGQIHCFKGHLDYGPGGGPLRGGPKVFPVTPQFSLPPTQGKRGGKNFPPGRPPAGGASFF

SEQ ID NO: 81181 - DNA, 952 bp, Zea mays
  misc_feature: Ceres CLONE 1566610
  misc_feature: Encodes the peptide sequence at SEQ ID NO. 81182
  misc_feature (584)..(584): n is a, c, t, g, unknown, or other
  misc_feature (644)..(644): n is a, c, t, g, unknown, or other
  misc_feature (645)..(645): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (682)..(682): n is a, c, t, g, unknown, or other
  misc_feature (687)..(687): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (731)..(731): n is a, c, t, g, unknown, or other
  misc_feature (732)..(732): n is a, c, t, g, unknown, or other
ggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaaagcggggctgctgtcgagcaattcacggttatacatttcaaggaagacctctngaggtgaactgcgggccaccgccacctagagatggatccgcaccagagcacaaggtggtnntttnnnnnnnggtggtttttccnnnnnnttttttttnttttnggggnnnngggttttttgggggaaccttggtttgggggggtggnnattccggctcttgggaaacttttccgtgggccagggaaagggccggggaagcaaggggcccccccaacgggttaccgcgccggcccacgggggtttggttttaccaccccaagggcctcccccggggggttaacaaaggctaattaaacaccctgaggggccccccgggggggggaggaggaccccccacgccgggtgtgaaaaaaaaacaccgcgcggg

SEQ ID NO: 81182 - protein, 149 aa, Zea mays
  misc_feature: Ceres CLONE 1566610
  misc_feature (79)..(148): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (148)..(148): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEESGAAVEQFTVIHFKEDLXR

SEQ ID NO: 81183 - DNA, 797 bp, Zea mays
  misc_feature: Ceres CLONE 1566612
  misc_feature: Encodes the peptide sequence at SEQ ID NO. 81184
caccgcggtggcggccgctctagaactagtggatcccccgggctgcaggaattcgtctcacccctagaaaaaaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccggcaagaccttcccaactctggaccctcgtacaggggaggtgattgctcatgtggctgagggtgacgcagaggacattaaccgtgcagtagctgcggctcgcaaggcttttgatgaaaggccatggcccaagatgactgcctatgagagggccccgtatcctactgcgggtttgctgaattgatagaaaaagcccaatgacgagccttgctgctttgggaaacatgggacaacgggaagccctttgaggcagcccgcccaaattgaagtacccctggggggccccgtcttatgcgttaacgaagctgggttggggctaataaaat

SEQ ID NO: 81184 - protein, 142 aa, Zea mays
  misc_feature: Ceres CLONE 1566612
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINGNFVDSASGKTFPTLDPRTGEVIAHVAEGDAEDINRAVAAARKAFDERPWPKMTAYERAPYPTAGLLN

SEQ ID NO: 81185 - DNA, 1325 bp, Zea mays
  misc_feature: Ceres CLONE 1566613
  misc_feature: Encodes the peptide sequence at SEQ ID NO. 81186
  misc_feature (1325)..(1325): n is a, c, t, g, unknown, or other
attcggccccctttttttcgatgccgcgtatatagacgctggtgacatagtcagtcgcggctgttctgagtcgggtggccccccccggggtggcagcctctctataatagtgcatcccccgggctgtatgaattcctcccaccccaagaaagatcaggggaaaaccaagcctgtgtttcagagacaagtcaggcgacgcgatggcgatggcggcgctgcgacgcgaggggaggcgcctcctcctcgcccccaccgtccacaacctgttttcggttgccgcatccgctgcttgagacgcgatcctccgccatgtcgcaaccggagatggttccacttggcgaacgctctagttcaactcaagtcgcgaggaagcgtgttgaagagtatcaaaaacatccagatcatctcaaaggctatgaagaccgtcgcagcatctaagcttcgagctgttcagactaggactgtaaattcactcggctttgggcacccatccaccgctcttgcttggggacgctcccaccgtttacttccataacaatcgtgattgtggttcacagcccttagtatcacgggtcttctgagcgtgtctatctactctccatcttgcggcggaatagctaaatcattatcgtcccttttacaaaaccggaggatttcttgggccccgcatgtagtcgaacagctattgtcccccgcctatcatcctaatgttacaaattggagtgcccaacacttcttccactccgcgatttctcccttatcgctctcctcggttgaaaaccatgtcctagctgtgcggataacccgtctaccttctcccccttgaagagggcgatgctctccattgttgcacatatagtctacacttcccctgtatgtcttgtcgtctccctcctcgcaccaacctagatcaccacattgtctcctctgtgtgcacattcaccaccctcgcatatatcatatgctattcatctcgccaataaaccatcatattgtcccgtcgcaatacacactcgatctgtatatgctcactacacggagggagcgtagtgctcttacggagactactataattatgcccataatgcccatggtctaatgatacttacgtattgcgactacccctcgacacatttgtctttctcttttctttctatattactgccctccgtggcacagggtctgttctactaatacagataactccgtacttctcgcggtcgtgatccacaaactgtggggtgcacacgccacatctacctctgtcctccctcttctctgtgacgactcagttcaaggattagcgctgataattcttgtgtatn

SEQ ID NO: 81186 - protein, 135 aa, Zea mays
  misc_feature: Ceres CLONE 1566613
  misc_feature: SWISSPROT Homolog: EC 3.6.3.14 H(+)-transporting two-sector ATPase
MNSSHPKKDQGKTKPVFQRQVRRRDGDGGAATRGEAPPPRPHRPQPVFGCRIRCLRRDPPPCRNRRWFHLANALVQLKSRGSVLKSIKNIQIISKAMKTVAASKLRAVQTRTVNSLGFGHPSTALAWGRSHRLLP

SEQ ID NO: 81187 - DNA, 864 bp, Zea mays
  misc_feature: Ceres CLONE 1566614
tccccgcggtggcggccgctctagaactagtggatcccccgggctgcaggaattcgtctcacccctagaaaaattttttgcttatcactggtacagcgcagcacatgagggagaagaacatggaggagtaattatttacttccttaacggagagaagacttcttcctacctcatcttctccggaccattccaattcttgattctatcaccccaccatccacaactcccctaatccttccgaccacctcgacactccagacaaccacctccacgcacaatgtgcaattgatacgccgcaccaaccagatcacaacgattcatttcatccggtatcccacctctccagcctccatgggcagctacccctacaagtactgcatgtgcttcagcacgcaagttccaatcccccgacgcccaatcgacggcggacctccccaccgcccaactctccttcttctctgacttccatgcccacaaccttcttcgtcgctcgcatgccgcgcaatcctcttgaaagacatggatggcatcctcaacatgcactcaggtggcgacaggctgcaatcgcccgcctcgtcacagagtcggctgagtctccacacaacgatccaacatgtctagttcttactattatcccccgacctcgaacagacatcggtgtcaggtctcacgaaagatatcatcaccctactcactctgcctcgtgatcactgggcataatacgtactacacggggagcgacataagtatgacatctctgacgttcagctgaataccgaactcatagacgtgtcagattcatgcatccaatcgcctgctgatcttgcaacgacatgatcatctgtaccgtacggacgtgactcc

SEQ ID NO: 81188 - DNA, 851 bp, Zea mays
  misc_feature: Ceres CLONE 1566616
  misc_feature: Translation starting site: 134
  misc_feature: SWISSPROT Homolog: EC 5.3.4.1 Protein disulfide-isomerase
  misc_feature: SWISSPROT Homolog: EC 1.8.3.2 Thiol oxidase
  misc_feature (759)..(759): n is a, c, t, g, unknown, or other
  misc_feature (816)..(816): n is a, c, t, g, unknown, or other
tggagctccccgcggtggcggccgctctagaactagtggatcccccgggctgcaggaattcgtctcacccctagaaaaagtgtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgaaaccttgctaccaagtacgagatccaagggttcccaaccatcaagatcttcagggaccaggggaagaacattcaggaatacaagggccctagggaggctgatggcattgtggattacttgaagaagcaggttggccctgcgtccaaggagatcaagtcaccagaagatgcgacggcccttatcgatgacaagaagatctacattgttggtatcttcgctgaattcagcggcaccgaatttacaaacttcatggaggtcgcagagaagctgaagtctgactacgacttttgccacactttgcatgccaccacctcccacgtgntgatgcagcagtggaacggccattggtcaggctgctgaagccatttgatgagcttgntgttgacagcaggattttgatgtcgctgcactgaa

SEQ ID NO: 81189 - DNA, 926 bp, Zea mays
  misc_feature: Ceres CLONE 1566617
  misc_feature: Encodes the peptide sequence at SEQ ID NO. 81190
ggagctccccgcggtggcggccgctctagaactagtggatcccccgggctgcaggaattcgtctcacccctagaaaaaattccaagcgtccaaaccccccatacaaccaactcgcaactcatcgcgcggttcctcgatcgaagtctccagacgcccagcgtcgatcgcgacgacatacgccaagccgcagcaaagctccggcggcgcgcgcggcggtgtgcggtgagaatatggcggtggtagtgtcagcgctggccaagtacaagctcgtgttcctgggcaaccaggcagtgggcaagacggccatcatcacccgcttcatgtacgacaagttcgacgacacctaccaggcgacgatcgggatcgacttcctgtccaagacgatgtacctcgaggaccgcaccgttcgccttcagctctgggacacagctgggcaggagaggttccgcagcctgatcccgagctacatcagagactcctccgtagccgtcatcgtttacgatgtgaccgacaggcagtcattcttgaacacgtcaaagtggatcgaggaagtaaacacgcaaagaggtggagacgtgctcatcttcctcgttggaaataaaactgaccttgttgacaagaggaaagtgtccaccgacgaaggagaagccaaagcacaggagcatggtgctatgttcatggagaccagtgcaaaagctgggttcaacgtcaagccactgttccgcaagatcgctggatcccttccaggactggacgcactttcgtcaggaaagcaggaagacatggtcgacataaacctcagacctgccagcggttcgtcggcttcaggagcagccgcgcagctggagcagaaatcaggcgggtgctccctgagaggactcgacagttttgtggtcagagaagatacacagtactttcacatcgag

SEQ ID NO: 81190 - protein, 232 aa, Zea mays
  misc_feature: Ceres CLONE 1566617
  misc_feature (12)..(173): Pfam Name: Ras Pfam Description: Ras family
  misc_feature (12)..(126): Pfam Name: Miro Pfam Description: Miro-like protein
  misc_feature: SWISSPROT Homolog: EC 2.7.11.1 Non-specific serine/threonine protein kinase
MAVVVSALAKYKLVFLGNQAVGKTAIITRFMYDKFDDTYQATIGIDFLSKTMYLEDRTVRLQLWDTAGQERFRSLIPSYIRDSSVAVIVYDVTDRQSFLNTSKWIEEVNTQRGGDVLIFLVGNKTDLVDKRKVSTDEGEAKAQEHGAMFMETSAKAGFNVKPLFRKIAGSLPGLDALSSGKQEDMVDINLRPASGSSASGAAAQLEQKSGGCSLRGLDSFVVREDTQYFHIE

SEQ ID NO: 81191 - DNA, 1294 bp, Zea mays
  misc_feature: Ceres CLONE 1566622
  misc_feature: Translation starting site: 272
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (70)..(70): n is a, c, t, g, unknown, or other
  misc_feature (783)..(783): n is a, c, t, g, unknown, or other
  misc_feature (972)..(972): n is a, c, t, g, unknown, or other
  misc_feature (1059)..(1059): n is a, c, t, g, unknown, or other
nnnnttaccccnccnnnnttaattatttaactgttatacgggccccagaccgccccccnnntacaatttnttcaaactggagctcaccgcggtggcggccgctctagaactagtggatcccccgggctgcaggaattcgtctcacccctagaaaaagagtttttcttgtgcggagccgcagcctgtgtttttcatacgtcttcgtcctatcgtgagggtgaaacccgcaagccctcttcctcctgtacaccggccgacatatccacgggcgatgacgctgggtatttccggcgcccgatcgagcgtcatcgtttctcgaaacttcgggttgttacaggagcacgagcgtgcagagaaggccattgcgtgatgggacactgagctatagaatggatgatgctgatgacatctacatgcgggccatggactggcaccctgaatggcgctcacaatacagtacgtcagggtcccatcttctcgcctgaattattgtttctgagaacacgcgacctattccagcagagacccccccacgcagtccgtaattccaattccaagaattccgacgctgaactttcgggtttttacaagtggagccccccgggaatgggtttggcctcccaatggaaaatttcttgcgatttttgcttatgccgtaacatcttgcgcttatgcccggtgtatcataaacaaccgaatatggggatggataagatatattacttttttatactcttatagatctgtgttctatgtgttaatacatgaaaacagttcttgagncttgtggaacacatcatttgggccgctgaggaaagaatttatctgcgagaaaaataagagatatttttcatgtggggggaaagaatcaaccgtgttttatatagagaaaagggcgggggcgatatacgaatgtgttaacttgtgcggcccaaacccggggaaacagcattgggactctctaaccttttnagggcggctgcgccccttgttactgtttcagaggaaaatctcaataattatatgtgtctcagattcttttcacataaaatgtttttntagattgagggggggattctagaatgacaacaccgatgtcgtggtacgtagttatattctttggggggtacccgtactgaggacaccgtttttgcttccgtgtggattgtgtttttctgtatcgtaccatgtatttgtgttccacatggggaatagcggtgaaattaagcttgtatgtgatgccacttgtgagttctatcaatggaatttcacccgagtattttttgtatgtgga

SEQ ID NO: 81192 - DNA, 828 bp, Zea mays
  misc_feature: Ceres CLONE 1566623
  misc_feature: Encodes the peptide sequence at SEQ ID NO. 81193
  misc_feature (403)..(403): n is a, c, t, g, unknown, or other
  misc_feature (404)..(404): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
agctccccgcggtggcggccgctctagaactagtggatcccccgggctgcaggaattcgtctcacccctagaaaaaaggaacccactccaactggtgcggcgcgtccaaaaatacaaaaggcaagcgagcgagctccaagttcggctgctccaatttcactcggcatggctcctcaggcgtgggtcgtggcggagaacggcgaggacctccaacaacccagggaattcctgccgctctctaagcttgaagatgttggcgtgttgtattggcatttggaccctaagaagtctgaaagcgaggaggaactagcaaaaatccgcagagacagaggctacagttacatggatcttattgagatatgtcccgacaaactgggaaactatgaggagaaggtgaagaacnntctctgtgagcacatgcacgctgacgaagagatccgctatttgctggaggccagcgggtacctttgacgtcccgcgacaaagatgacaagtggattccaaatcccgattagaaaaagggaaaatgggtcttccctcccggccggaaatttttcatccggttcccccccccaaaaggggttaaaattcccaaaaacccctggggggttttttttttgggggaaaaccctttggggagccgcgttttaaaacccccccctggaagagggcacccccccccgggaggggaaaaaaaaaattttttctcaaaaaaaggggttgggggggggggcccccacattttttttttttttctttccctcccccccacccaaaaaaaataaaaatattattttttttttgtnnnnnncccccccccgccgagga

SEQ ID NO: 81193 - protein, 101 aa, Zea mays
  misc_feature: Ceres CLONE 1566623
  misc_feature (4)..(102): Pfam Name: ARD Pfam Description: ARD/ARD' family
  misc_feature (80)..(80): Xaa is any aa, unknown, or other
MAPQAWVVAENGEDLQQPREFLPLSKLEDVGVLYWHLDPKKSESEEELAKIRRDRGYSYMDLIEICPDKLGNYEEKVKNXLCEHMHADEEIRYLLEASGYL

SEQ ID NO: 81194 - DNA, 938 bp, Zea mays
  misc_feature: Ceres CLONE 1566625
  misc_feature (13)..(13): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (119)..(119): n is a, c, t, g, unknown, or other
ttggttttttttntttttttttgtcgtcataaacccaccctccctcttcaacacgcgcccccggggagggcggaacacaggtaaatnnncctaaaaaaaaaaaaactggaactccccgncggtggcggccgctctagaatagtggatcccccgggctgcaggaattcgtctcacccctagaaaaaatgaccaatctgctccgggcaccatggagaggatcagtggcccgcgcctcgctgtcctgctcgctctcgccgtcctcaccgccgtcgccgcagcgaccacggacgaggtgcgcgcgcagtcacctacatcatccacctcgccccagccacccgggccttccgcaacggggaaaaacgggggaacaagggggctttcggggcttttttccggcccttgggggccccaaagcccccttttttttattctaaaaaaacgttttccaggggaattccccgcgggggttaaccccccaaaggggggggaaaaccccccgtcccgggaagaaggggttctttggcccttttaccccccccaaaaaaggggcgccccaaattttttaaaaaaaaaattaaaaacaccgggggggggtttttttcccccccccctaaaaaaaaaaaaaaaaaccccccccccggggggagttcctcccccccccccttttttatcaaaaaaaaaagggggggggggcgctccacctcgtcacaaaattgttggcgggggtgtgaatatggaggggggggaaaggtataaaaaacccaaaggggggggttgttttaccccccccctcattgtattagggtggccccccctatcttttacattttcttgttatatagaaaaaaaaagaattttattttaaaacacgggggagcccctccaccccatcattatatttatttttttggttgagaaggagaaagacaacaaccccc

SEQ ID NO: 81195 - DNA, 849 bp, Zea mays
  misc_feature: Ceres CLONE 1566627
  misc_feature: Encodes the peptide sequence at SEQ ID NO. 81196
ggagctccccgcggtggcggccgctctagaactagtggatcccccgggctgcaggaattcgtctcacccctagaaaaagttcgtgtccgactccagtggacaaggcatggcggggagaggcggcggcggcaaaggcgccgcagggaggatgatgtcgctgcaggaattcgtgtcctgcatgcagccgctcatcgatctcgagaaggcggcggagatatcggcggagtccgagacgagcgctaagagcctggagaggagggggtgcgtcattgccaacctcaagtgcaccgatgcccagacgggactgatggggaagacgctcctggagttccaacccaacaaaggcgacgttctcccgtctcacaagtttggaacacatgatgtggttgccctgaagccaaataaggcagatgctggatctgcttcacttggtcaaggtgtagtttatcgcttaaaggattctcccatactgttgcttttgatgatattcctgaagatggcttaaaacagccctctgcgtcttgagaagcttgcaaatggaggtccctatcgccggatgaaagatggcctaatttaactttagcaaggctggtcaaaccccaacctttggcaaacctggttcctgtttttttttgggaagaagggccccctggccccccagggaggccttagaaattccgctcctttcaaaaagaaactttggatgttttcccagaaaagggggttttttttcaaaggtccttggggaataagggggagtttttcttttgtgttttcggggacacccttgggaaaagggggggaaaaaccaccccccctttttttttgtgaggaaaaatatttttgcgg

SEQ ID NO: 81196 - protein, 132 aa, Zea mays
  misc_feature: Ceres CLONE 1566627
MAGRGGGGKGAAGRMMSLQEFVSCMQPLIDLEKAAEISAESETSAKSLERRGCVIANLKCTDAQTGLMGKTLLEFQPNKGDVLPSHKFGTHDVVALKPNKADAGSASLGQGVVYRLKDSPILLLLMIFLKMA

SEQ ID NO: 81197 - DNA, 827 bp, Zea mays
  misc_feature: Ceres CLONE 1566628
  misc_feature: Encodes the peptide sequence at SEQ ID NO. 81198
tccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcgggccgacgacgggggagctcgccgcgcggtgggcgggaggttcacggcagcaacaactgggaggggtctgctggacccccatcgacggcggtgctccttccaggaagctcaatcccctaacggcgagttcgcccagggccacctacaaaaagcttcgaactacgaacggctttttcccccctatgggggaagcttgaaatacccccggggaaaaaccttttttcccaaaaaatttgggccttggggggggattggctaaaaagggtaacccccgtatccttttatgcgccccctggaaaaaaaccttaaagtttccccaaaatttttggggattaaaaaaggggcgcccaaaagccaaaaaatgggggagg

SEQ ID NO: 81198 - protein, 109 aa, Zea mays
  misc_feature: Ceres CLONE 1566628
MAATVSSCLSLVPTVHHRAGGFPSSVALTNTLQRRRRSRRYLVVASATRAEQEAAPVTIEDVDLSSHQAAGRRRGSSPRGGREVHGSNNWEGSAGPPSTAVLLPGSSIP

SEQ ID NO: 81199 - DNA, 819 bp, Zea mays
  misc_feature: Ceres CLONE 1566630
  misc_feature: Encodes the peptide sequence at SEQ ID NO. 81200
  misc_feature (674)..(674): n is a, c, t, g, unknown, or other
  misc_feature (724)..(724): n is a, c, t, g, unknown, or other
ctccccgcggtggcggccgctctagaactagtggatcccccgggctgcaggaattcgtctcacccctagaaaaactagccgcgattcatggcccgcaagcgccgcgcgccttcgcctcctccgcctccgcaggaggagtcgtcctctgaggaatctggctccgaagagttggaggagcctcctcgcctccccgagctccgtagtcccccgcaggccgcggccaacaacgccgactcgtcggaggcggacacggactccgacaccgacgctcaagctttccagatgcgccaggtgccccgctccctcactaagcatacgcatccagttccccagccagaatccgatcccgaagaggaggagggcgagtcatcggagtcggagcatgagaaccctgtgcctgtggttcagaagaaggctgcggcggcggccgtgttgtccaaggcagagcaggaaaggaagagacccccctcggatcctgctcctaccgggaaggcaaaaaagatgaaggctgtggctacccctcttgccaaggcgaagaagggcaaggccgagctagagaagccggcgcctgaggccactccagcaggaaatgcaaagaagggcaaagctgagctagagaagccgacgtttgatgccattcccagcaggaaggcgaagaagggcaggcccaaggnagcagctcctgaggccacgccctcaggcaaggggaggaaagatggggacnaactagaagagtcagcagcccttgatccctcccatccagacagcagtcttgaaaagcttgggccccccacttggggggaagaatattgaaattac

SEQ ID NO: 81200 - protein, 241 aa, Zea mays
  misc_feature: Ceres CLONE 1566630
  misc_feature (196)..(196): Xaa is any aa, unknown, or other
  misc_feature (213)..(213): Xaa is any aa, unknown, or other
MARKRRAPSPPPPPQEESSSEESGSEELEEPPRLPELRSPPQAAANNADSSEADTDSDTDAQAFQMRQVPRSLTKHTHPVPQPESDPEEEEGESSESEHENPVPVVQKKAAAAAVLSKAEQERKRPPSDPAPTGKAKKMKAVATPLAKAKKGKAELEKPAPEATPAGNAKKGKAELEKPTFDAIPSRKAKKGRPKXAAPEATPSGKGRKDGDXLEESAALDPSHPDSSLEKLGPPTWGEEY

SEQ ID NO: 81201 - DNA, 826 bp, Zea mays
  misc_feature: Ceres CLONE 1566631
  misc_feature: Translation starting site: 165
  misc_feature: SWISSPROT Homolog: EC 1.7.1.3 Nitrate reductase (NADPH)
ggagctccccgcggtggcggccgctctagaactagtggatcccccgggctgcaggaattcgtctcacccctagaaaaaattctccccgcctccccctccgaccctcccaaatcagcaccacccataggggccacggccgcgcaatgccgccctctgccgacgcaatgccggcccccggagacgccgcgtgcgccggcgacgtgcgcttgatctcctccaaggagctccgcgagcacgcgtccgccgccgacctctggatctccatctcgggcgacgtgtacgacgtgacgccctggcttccccaccacccgggcggcgacctcccgctcatcaccttggcggggcaggacgccaccgacgccttcgccgcctaccacccgccctcggcgcgcccgctcctccgccgcttcttcgtcgggcgcctctccgactacaccgtctcccccgcgtccgcggactaccgccgcctcctggcgcagctctcctccgcgggcctcttcgagcgcgtcggccccacccccagggtacagctcgccctgatggccgtcctcttctacacggcgctctatcatcgtctcgcctgcgccagcgtctcggcgcacatgctcgctggggggctcatccggctcgtctggatccagtccggctggatgggctacgactcggggcaccaccgcatcacgggccatcctgctcctggaccggctcttgcaggtgctctccggaaactgcctaatgggcctcagcatcgcctggtggaaaggcaaccccaaaaagttccacattgccctgaaaagtcttggaccatggaaccggaactccagct

SEQ ID NO: 81202 - DNA, 802 bp, Zea mays
  misc_feature: Ceres CLONE 1566636
  misc_feature: Translation starting site: 146
  misc_feature: SWISSPROT Homolog: EC 4.2.1.20 Tryptophan synthase
aaagctggagctcaccgcggtggcggccgctctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacggaggtacgacgcggccgtcgtcgtcactaccaccaccactgctagagctgcggcggctgctgtcacggttcccgccgccccgccgcaggcgccggcgccggcgccggtgccaccaaagcaagcggcggcacccgccgagaggaggagccgtccggtgtcggacaccatggcggcgctcatggccaagggcaaggttcgtatagtacgcgcgcgtgtcgtcgtcgttattttgcgcataggcgcggacatacacgtgctttagctagctaacagctagatcatcggtgcagacggcgttcatcccgtacatcaccgccggcgacccggacctagcgacgacggccgaggcgctgcgtctgctggacggctgtggcgccgacgtcatcgagctgggggtaccctgctcggacccctacatcgacgggcccatcatccaggcgtccgtggcgcggggctctggccagcggcaccaccatggaacgcccgtgctggagatgctcagggaggtgacgcccggagctgtcgtgccccgggggtgctccca

SEQ ID NO: 81203 - DNA, 830 bp, Zea mays
  misc_feature: Ceres CLONE 1566641
  misc_feature: Encodes the peptide sequence at SEQ ID NO. 81204
ctccccgcggtggcggccgctctagaactagtggatcccccgggctgcaggaattcgtctcacccctagaaaaactctccatctagacactgaaacggccgttgaaaaaaaaggaaatacttgggaaaagccctccccttctcttctctcgccttcaccacgcgccgcccgatccgccaccgcccgccgcagccagcaagccaaggccagatggcggcctcactcgtgtcctcgtttactgtgcccctcgtctccgccgtcctcggtgccgccatcgccctcgtcttcctcgccggctacctccgccgcaagcgcgccgccatcgcccacatccctcccaccgaaaccgccgccgccccggaccagcctaagcatgtccgcccctccaaccaggcccagtacaagaagggccatctccgcccgcatcaccacgcggccgacaaggacgcggccaagaagcaccaccatcttgatgtcaacaccttgagggggcatactgactccgtcactgcacttgccttctccaatgacgcctgcaacctagttaccgtatgtgctgatggagccatcagggtattcaggatcgatgatacctctagcaagagcttcaagattcttaggataaacttgccagctggagcgcaccctacggctgtttactttctcagaggggtcatcatctgttgttgtggcggcgcaggcggcttctggggaccatctcctttatatggatgccggatgttagcggctcctccaaccgcggaaaaacaaactgcaaggaaaaggctttctcccccgtggaaatcaagtgggaggcaccccccaagatt

SEQ ID NO: 81204 - protein, 206 aa, Zea mays
  misc_feature: Ceres CLONE 1566641
  misc_feature (86)..(124): Pfam Name: WD40 Pfam Description: WD domain, G-beta repeat
MAASLVSSFTVPLVSAVLGAAIALVFLAGYLRRKRAAIAHIPPTETAAAPDQPKHVRPSNQAQYKKGHLRPHHHAADKDAAKKHHHLDVNTLRGHTDSVTALAFSNDACNLVTVCADGAIRVFRIDDTSSKSFKILRINLPAGAHPTAVYFLRGVIICCCGGAGGFWGPSPLYGCRMLAAPPTAEKQTARKRLSPPWKSSGRHPPR

SEQ ID NO: 81205 - DNA, 1323 bp, Zea mays
  misc_feature: Ceres CLONE 1566642
  misc_feature: Encodes the peptide sequence at SEQ ID NO. 81206
  misc_feature (804)..(804): n is a, c, t, g, unknown, or other
  misc_feature (814)..(814): n is a, c, t, g, unknown, or other
  misc_feature (1125)..(1125): n is a, c, t, g, unknown, or other
  misc_feature (1323)..(1323): n is a, c, t, g, unknown, or other
ccattaaaaataggttttttgtcgcctaatcaatctgctgttgatttgtttgtgtgtcttttcaaactggagctcaccgcggtggcggccgctctatactagtggatcccccgggctgcttgaattcgtctcacccctagaaaaaaccccaacagcccgagcctgaggttcttcgacgtggtggaccgcgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttctacgccacccaactcgtcgactacttcgcctcctagaacctcagcctcgaggacatggttgtcctctccggtgcacactccatcggtgtctccccctgcggccgcttcgccggaattaacgacacaggcgaccggctctacaactttcatggctcatccgacgggattgatcctgtcgctgagcatagcccacgcgttcctcactcatagcatttgcccctccaaacagacggccggtttctttcgcctacacgaactacgtttcctgggaccctcaatcaacgaccgggcctaagttgcagaacaacaaggtatctacgggtagggacgtcagcaaaacaaacaatgggggacctctttccgaaggtccaataacgccggtacgcctgtccctaatcacaaacgcgccatacccacaggtcaaagagcggncccgatgggncaataacctccaccattccggttgggctgccagaaacgcgaatggcgcccatccacttgtgggtaaaaagaacacccacacgttgttctcccagcccaataatgttcccgatatgtccatcccacagatatgtgggggggggcacagaatatcctctaaggggtgtgcccgcccacgcgggggtgactcatgcccgagagatccgcaaagaatattactggtgtcgtacaatactgtcccatggtggggcacctctctgtatctcccgggcgctatagaggccccccgccactcaccttaatcctatagtnctcctccgtggccgccggtatcagactcgaaaagctcttatactctaggggagacccacaccgtgtgccgcgtgagtccatccacaaccttataacccatttcactatctggtgcgagtgtacgcgccgacgtgaggtgttagacgctcgagcggcatatcatggataacttatgctcaatcgtccccatcacgcccn

SEQ ID NO: 81206 - protein, 51 aa, Zea mays
  misc_feature: Ceres CLONE 1566642
MVVLSGAHSIGVSPCGRFAGINDTGDRLYNFHGSSDGIDPVAEHSPRVPHS

SEQ ID NO: 81207 - DNA, 832 bp, Zea mays
  misc_feature: Ceres CLONE 1566644
  misc_feature: Encodes the peptide sequence at SEQ ID NO. 81208
  misc_feature (788)..(788): n is a, c, t, g, unknown, or other
ccccgcggtggcggccgctctagaactagtggatcccccgggctgcaggaattcgtctcacccctagaaaaagtccacgttgtcgccctcataggctggtgcctgcctggtggtcgccattccgctgcgcacaggcgcacagcccaatccagtacaaacagcagcagcttcgcctccacctccacgcgagccaagcgcccggcccggctcccgcagcgcaaaaccctagcctcgcccgccccaaacccttggcggctacggtctctgatcccggtccaatggcgtcgtcgccggacttgttccctaacgttgccttctccgacgtctctgccgccgcccccgcggccgaggccaccgccgcgttcgggctcggcgccaccgccggggccccgcgcctctgcctcgtcaagtccgggaaggacgaggcggagcccacggtcgacatcgacctcgccgatgcgcaggtaattaagttgggacccgatggagtgggctttgcgtgtggcgacgaagtccgaaggcttaaggggctggcggtggaaaaaaaaaaaatctctttttccaaaaaccaaaataatagggggggttctcttttgagcaacaaaaagttcggaaaaaaaaaaaaacccacccccccgtccgggagggggtggctccgccaccaaggggggggagaaaacccccccccccgggattgtttttttatctggtggacaacaaaaacactttccatttttccgaaacaaaaaaacgaataattgtggcggcccaaccaaatgaaacccctntccctaagagaaccaaaccaaaaatgatttcctcgggtcccggg

SEQ ID NO: 81208 - protein, 159 aa, Zea mays
  misc_feature: Ceres CLONE 1566644
MASSPDLFPNVAFSDVSAAAPAAEATAAFGLGATAGAPRLCLVKSGKDEAEPTVDIDLADAQVIKLGPDGVGFACGDEVRRLKGLAVEKKKISFSKNQNNRGGSLLSNKKFGKKKKPTPPSGRGWLRHQGGGENPPPRDCFFIWWTTKTLSIFPKQKNE

SEQ ID NO: 81209 - DNA, 878 bp, Zea mays
  misc_feature: Ceres CLONE 1566645
  misc_feature: Encodes the peptide sequence at SEQ ID NO. 81210
acccgcggtggcggccgctctagaactagtggatcccccgggctgcaggaattcgtctcacccctagaaaaaaaggctgtctgcctgtctctgctcccatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcgtcgcgccggcggtggacgctggtgctggtgaacatggcgtcggtgctggagaaggcagacgaggtgttgctgcccgccgtgtacaaggaggtgggcacggcgctgggcgcttctccgaccgcgctgggctccctcaccctctgccgcgcgctcgtccaggccgcctgctacccgctcgccgcctacgcctccgcgcgccacgatcgggcccgtgtcgtcgccgtgggagccttcctctgggccgccgccaccttcctcgtcgccgtctccggcagcttcctccaggtccgtccgtctccccgatttcctcccaactctttccctcttcctcctgtcgctgacgtggcggacccactgctccacgtttctcccgcagcacgtggttggcattgcactggcacctacctaccacaaacgtagcggttatccgaatattctatttcaatttcgcaacacaaaataaaagatggtcggtgatattttggtgcatctctgacacgtgggcccatccactgactagcaacctgtggctcgcgcgctcgcatacgcatacgcatacgcactgcgcagatggcgatctcgcgggggcctcacggcatcggtctcgcgctggtcctcccggcgatcagtc

SEQ ID NO: 81210 - protein, 146 aa, Zea mays
  misc_feature: Ceres CLONE 1566645
MRDAEAASRRRWTLVLVNMASVLEKADEVLLPAVYKEVGTALGASPTALGSLTLCRALVQAACYPLAAYASARHDRARVVAVGAFLWAAATFLVAVSGSFLQVRPSPRFPPNSFPLPPVADVADPLLHVSPAARGWHCTGTYLPQT

SEQ ID NO: 81211 - DNA, 964 bp, Zea mays
  misc_feature: Ceres CLONE 1566646
  misc_feature: Encodes the peptide sequence at SEQ ID NO. 81212
ctccccgcggtggcggccgctctagaactagtggatcccccgggctgcaggaattcgtctcacccctagaaaaatctgataatccatacagtggttgttcatgtggtgtctcttgtcacctaaactgtgctctaaagaataaaagggctggcattgtcaagaatgggtgcaacaagttagactgtagtttctactgtgttagttgtgggaaaatcaactggctaatgaggtgtttgcagaaacaacttgcaattgctagggaggcaagaagagttgatgtgctttgtgagcggttgtcattgagccataaaataatacaagggtctgaacgttacaaggaaatagcgagcataatcagctcagctgtgaaaacacttgaaatagaagttggtagtgcattggatcaggtctctgtgatcacggggcgtggcatcgtgaaccggcttacttgtggtgctgaagttcagaagctttgttcaagtacattagaaattgtagactctaaagtggataacatcttggagttcgagtccaataatagtccaaaactcctaggtcctcagccccaaatcctttttcatgagatcactccattttctgtggttattgtgttgaactatcagcatgacatcggtaaagagcagattgatggttccaaaatttggcaccgaattgccagggttttgcactattcatcagaacccacatgccacttacttgagcccaaccctaggagccttgttttcgtgccggaacccttacactaataacttttcaaaggtttgccttttacacccacctgggtttaccgggggggaaaaaaatggcgcacccccccctgaacctggaaccacccggggtccactcaaaactcgaaaaaatgggcccaaaaaaattttttggccctcccaaaagagtttttatgtgggaaatccccgaaaaaccctttattatttctcccggg

SEQ ID NO: 81212 - protein, 254 aa, Zea mays
  misc_feature: Ceres CLONE 1566646
PRGGGRSRTSGSPGLQEFVSPLEKSDNPYSGCSCGVSCHLNCALKNKRAGIVKNGCNKLDCSFYCVSCGKINWLMRCLQKQLAIAREARRVDVLCERLSLSHKIIQGSERYKEIASIISSAVKTLEIEVGSALDQVSVITGRGIVNRLTCGAEVQKLCSSTLEIVDSKVDNILEFESNNSPKLLGPQPQILFHEITPFSVVIVLNYQHDIGKEQIDGSKIWHRIARVLHYSSEPTCHLLEPNPRSLVFVPEPLH

SEQ ID NO: 81213 - DNA, 829 bp, Zea mays
  misc_feature: Ceres CLONE 1566647
  misc_feature: Encodes the peptide sequence at SEQ ID NO. 81214
tacccgcggtggcggccgctctagaactagtggatcccccgggctgcaggaattcgtctcacccctagaaaaaaaaaaaaaacacatttttcttctgaaatctacagtacactacatacaaactctagactgtacgtcggcacatgtgaatacattgagcgtacaagcggccatcactgagtagcaagatcgttgcacaccgcgtcggaagagaaatgattgccacgaccggcggcagctcggcaaaggcggcggcggcggtgggcggcaaggcggcgcgcgcctgtgacgggtgcctgcggcggcgggcgaggtggtactgcacggcggacgacgcgttcctgtgccaagggtgcgacacgtcggtgcactcggcgaacccgctcgcgcggcggcacgagcggctgcgcctgtgcccggcgtctccgctgcagacgccgccagctcgctcggcggcggaggcagcgacggctactaataagcgcgagcgtcacgacgaggtggcggtgcccgcgtgattcgggcgcaaggcgcgaaccccacgcggcgggcacgccaaaagcgtcgggcaggtggcgttgtcgcgagcgcctcgtcgtaccgcatgcggctggcggggactcagactcacccgatgagcgaaacggcggcgagaaggagcagctgctctaccgcgtggccatcctcgaccccgccctagccgagttctgctcgcacccgcctctagaggacgcggccaggtctcgcgtcggtgtgcaacgaagaccgcgtcatcgagaaccgctcgaagaccgatcctgcagcgccgctggaccaaatctgcctcgtg

SEQ ID NO: 81214 - protein, 100 aa, Zea mays
  misc_feature: Ceres CLONE 1566647
  misc_feature (19)..(66): Pfam Name: zf-B_box Pfam Description: B-box zinc finger
MIATTGGSSAKAAAAVGGKAARACDGCLRRRARWYCTADDAFLCQGCDTSVHSANPLARRHERLRLCPASPLQTPPARSAAEAATATNKRERHDEVAVPA

SEQ ID NO: 81215 - DNA, 850 bp, Zea mays
  misc_feature: Ceres CLONE 1566650
  misc_feature: Encodes the peptide sequence at SEQ ID NO. 81216
  misc_feature (523)..(523): n is a, c, t, g, unknown, or other
ggcggccgctctagaactagtggatcccccgggctgcaggaattcgtctcacccctagaaaaaaggcgccagcagcaggctagctctgctccgccgctcactactcgctagctactggaccgcgcctccctctctccatcgcgccggcgcgcacggctagggctagctcccggagccgccctttcatggtccccgccgtggtcgggacgagatgcctccgctcgcattcctccgccgctacctccccgcgaggcttctcgcgcgagcgtgcgatggtggagtccgggggagcccgggcgtggcgcgggacgaggaggccggaggcagcggcggactgagcggccggtcggcgggggcgccgtccggggagtgctacgcgtgcacgcagcccggggtgccggcgttccactccacggcctgcgaccaggtgcactcgccggactgggacgccgacgcggggtcctcgctggtgccggtccaggcgcagcagcaggcccagccggcggcggcggcggcggcgcancacgcggcgcggtggctgttcgggcccgtgctggacccgcgcagcaagcgcgtgcagcgctggaaccgctggatcctgctcggccgcgccgccgcgctggcgctggacccgctctttctctacgcgctctccatcggccgcggcgggccggccctgcctctacttggacgccggccctcgccgccccggtcaccgcgcttcgggacctgcggcgaaggtccgcaccttcgcgcactgggctctggaaatttcccctccgcctacgttcccccggaagcccccctcttcgggggggggaaagtcttcctggggaccccccgccctccc

SEQ ID NO: 81216 - protein, 213 aa, Zea mays
  misc_feature: Ceres CLONE 1566650
  misc_feature (104)..(104): Xaa is any aa, unknown, or other
MPPLAFLRRYLPARLLARACDGGVRGSPGVARDEEAGGSGGLSGRSAGAPSGECYACTQPGVPAFHSTACDQVHSPDWDADAGSSLVPVQAQQQAQPAAAAAAXHAARWLFGPVLDPRSKRVQRWNRWILLGRAAALALDPLFLYALSIGRGGPALPLLGRRPSPPRSPRFGTCGEGPHLRALGSGNFPSAYVPPEAPLFGGGKVFLGTPRPP

SEQ ID NO: 81217 - DNA, 957 bp, Zea mays
  misc_feature: Ceres CLONE 1566652
  misc_feature (219)..(219): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (601)..(601): n is a, c, t, g, unknown, or other
  misc_feature (615)..(615): n is a, c, t, g, unknown, or other
  misc_feature (642)..(642): n is a, c, t, g, unknown, or other
  misc_feature (645)..(645): n is a, c, t, g, unknown, or other
  misc_feature (648)..(648): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (688)..(688): n is a, c, t, g, unknown, or other
  misc_feature (712)..(712): n is a, c, t, g, unknown, or other
  misc_feature (721)..(721): n is a, c, t, g, unknown, or other
  misc_feature (756)..(756): n is a, c, t, g, unknown, or other
  misc_feature (757)..(757): n is a, c, t, g, unknown, or other
  misc_feature (775)..(775): n is a, c, t, g, unknown, or other
  misc_feature (781)..(781): n is a, c, t, g, unknown, or other
  misc_feature (804)..(804): n is a, c, t, g, unknown, or other
  misc_feature (820)..(820): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (846)..(846): n is a, c, t, g, unknown, or other
  misc_feature (847)..(847): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (865)..(865): n is a, c, t, g, unknown, or other
  misc_feature (866)..(866): n is a, c, t, g, unknown, or other
  misc_feature (868)..(868): n is a, c, t, g, unknown, or other
  misc_feature (889)..(889): n is a, c, t, g, unknown, or other
  misc_feature (890)..(890): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (915)..(915): n is a, c, t, g, unknown, or other
agctccccgcggtggcggccgctctagaactagtggatcccccgggctgcaggaattcgtctcacccctagaaaaaccttcccatcccccactgctcagcagtcagtcagcactcgccacccacacgcctccgctccgcccacggttccactccaactctccgatctccagtatcccgcgctgaggcgccggcgatggcggctcccatgggcgacgccnaatattgccccaggtcaaaggggccgccccccccctccgggcccttttttaaaaagggaagccccccaattagccccccccgggggggtgggggggggatttttgccggaaaaaaaaaagggggggggaaggggtgttttttaaaaaaaaaaaaaacccccccggtgtaaaacggtgttaaaaaatattttctcccctcccccggccacaaaaaaaaaaaaaaaaaaaaaaaaccccccccccctccttctcttgggggggggccccaaaaggggggggggggcggtttttttttttttttttaaaaannnnnngcccccccccccccccgggggggggttatttgtaaaaaaaacacccccccccccccccccgtgtgttnttccgtgggggggnaaaaaaaaaaaataaaagagggggggnaanaanaaggaggccgccgcgcaggagaggggngnnnnaannnnanaaaaaagagaaaaaaaaaaaaaanaattttttnttgggggggggggggggaggagggaagaaagatannaaccaccccccccccccncctccnttctttgttggtttaggggggtngtttgttttgataganataattataatatatttaatnnnntnngnnnnaannnnnnnnncnncncccccccccccctcccccccnngccnnnntnnnnngggggggggggnggggggggggggggggtggtggtgtataaaaaatactaaaag

SEQ ID NO: 81218 - DNA, 838 bp, Zea mays
  misc_feature: Ceres CLONE 1566653
  misc_feature: Encodes the peptide sequence at SEQ ID NO. 81219
ccccgcggtggcggccgctctagaactagtggatcccccgggctgcaggaattcgtctcacccctagaaaaagtgtcccgtcctcgcatcccacgccacaccctcccaatccctttcccctcgcgtctccacacctttcacacgcgacgccggagagacagagcgcgcgcgcgcgcccgaaagatgtcgacgtgcgcggcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcgggctcaagcacctgcccaggaccggcttcgactacgacttcttcctctaccagtgggccttcgccatcgccgccgcgggcatcacgtcgggctccatcgccgagcggacccagttcgtcgcctacctcatctactccgcgttcctgacgggggtcgtctaccccgtggtgtcgcactggttctgggtccccgacggctggggccggcgccagctccacgtccgggcctgctgctcttcgggttctgcggtcttcaactttcgccggggtccgggcgtcgtccacatgggtcggggggcttcccgggggctggggggggggcccccttctcgggggg

SEQ ID NO: 81219 - protein, 218 aa, Zea mays
  misc_feature: Ceres CLONE 1566653
  misc_feature (36)..(218): Pfam Name: Ammonium_transp Pfam Description: Ammonium Transporter Family
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGVVYPVVSHWFWVPDGWGRRQLHVRACCSSGSAVFNFRRGPGVVHMGRGASRGLGGGPPSRG

SEQ ID NO: 81220 - DNA, 1028 bp, Zea mays
  misc_feature: Ceres CLONE 1566655
  misc_feature: SWISSPROT Homolog: EC 1.11.1.11 L-ascorbate peroxidase
  misc_feature (1028)..(1028): n is a, c, t, g, unknown, or other
aaagctggagctccccgcggtggcggccgctctataactagtggatcccccgggctgcaggaattcgtctcacccctagaaaaaactgcccatcccccactgctaatcagacagtgagcaatggagaacaagacgcataagctccgcccacgggccgaatccaactctacgatgtccaggaatcggcggatgaggcgcccgcgatgggggctcccatggccgacgcccaatacctgggacaggtacacaggggaggaggacacctccaagacctcatactaaacaagggatgcgccccgcatctgctccaccgtcccatggcatgatgctggaacttatgacctgaagaaaaaactggtgatgcacatggcccgtgttaaagatgaagaagaagacacgcatggtgccccccccggactaatgatagcgatcgatctcccggagcctgtcacacttagaatacaaagataacatatccacaccggtatcagcttgctcgactgatggcaaatgacatgaacgcgggggtcaactgagtgaataatatacccgggcagacttagacttacgtccgatgtccccccccactgaacgtccctcgggccacacggcttactatagggcggcacaacaagctgagcggtagctgcgtatttaccgacatgggggctgagtgctcacaaaacaatacttggccgccttctcttagggagggggaaactgttgttggggaaaggggctttaacccttgaaaggctttggcaattcttatgctgccccgggaacaaagcaatcctcctatgaacctttggaaaacggcacaggttagaacaaaccgctcgaatagaaacaaacctgaaagcaaactttaaaggcatccataccggccaaaagggaggcttgagcctaatcgcgggacttgtcgccccgcccctggatctccaatgcacccagttcacaaactccccctccccaacaagtatccgttagattgaacatgaaatctctaatatttaacgctttgggcn

SEQ ID NO: 81221 - DNA, 844 bp, Zea mays
  misc_feature: Ceres CLONE 1566657
  misc_feature: Encodes the peptide sequence at SEQ ID NO. 81222
  misc_feature (627)..(627): n is a, c, t, g, unknown, or other
ctccccgcggtggcggccgctctagaactagtggatcccccgggctgcaggaattcgtctcacccctagaaaaaatccagactatttcgcgcgcgcacaccacgtacacatagcaccccgcacccctttcgttccctaccagcactacgctacgccccccactgccatatagccgtatacgacgctcgcttgcctggccgtcttgatctctcacttcctcgcccccgataagtgagcaagcggcaagaaccagcaggcaaccgcacagtcgcagcagcagcagcggcggcgcgcccatgtcgtcgggagacttccactaccacgacgagctggcggcgctgttcgcgcagcggccggcgccggcgggagagatgacgatggcgctgcagcagcaggcgccggcggcgtcgtggttcgcggactacctgcacgcgggcgcccccggcatggggatggactacgacctgctgtgccgcgcgctggacctgccggtgccgggggatgaggacggcgtcgtcaagcgcgagctgctgctggtggcggacacgggcgggggaggcgcaggcggaggcttcgcggcgctgctcacgcccaacacgacgtcgtccatgtcctcctcgtcagcgnagggcggcgggcgccgtcgtcgtcgccgccagaggaggatgcgggggggagcttttgcgcgcgttggaggaggactccccattccctggggaagggtccaaaaaggaaggacaaccggggaatgggggaggaaaaccaaggcaaagggagggccattaaaggggggaagaggaaacaaaccggaaaccgggaaaaaaaagggggggatattaccttt

SEQ ID NO: 81222 - protein, 182 aa, Zea mays
  misc_feature: Ceres CLONE 1566657
  misc_feature (111)..(111): Xaa is any aa, unknown, or other
MSSGDFHYHDELAALFAQRPAPAGEMTMALQQQAPAASWFADYLHAGAPGMGMDYDLLCRALDLPVPGDEDGVVKRELLLVADTGGGGAGGGFAALLTPNTTSSMSSSSAXGGGRRRRRRQRRMRGGAFARVGGGLPIPWGRVQKGRTTGEWGRKTKAKGGPLKGGRGNKPETGKKKGGILP

SEQ ID NO: 81223 - DNA, 900 bp, Zea mays
  misc_feature: Ceres CLONE 1566658
  misc_feature: Encodes the peptide sequence at SEQ ID NO. 81224
ctccccgcggtggcggccgctctagaactagtggatcccccgggctgcaggaattcgtctcacccctagaaaaaggacgacgcagcgtagcagctgagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtctgtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcatgagctacgtcatcgccatcagcggagagaagaagccgccatgagggagatcatcatcgacgtcgagctcgccacacgactctccccagggggttcatctggaccgtcgacggctaacgcgagctcatcaacggggaactcgtcggcgacgactagacatcggctactactagctgcgcgtgatcacctgactgcactgtgcatatatatagctgctgactagctgggcgcttgaaagtacgtggagaaacatgaatgcttttgaggtaggagagcatgctttgg

SEQ ID NO: 81224 - protein, 181 aa, Zea mays
  misc_feature: Ceres CLONE 1566658
  misc_feature (42)..(180): Pfam Name: PSI_PsaF Pfam Description: Photosystem I reaction centre subunit III
MAALAAASTAAFAAKPRARLSVACSAATGDSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGMSYVIAISGEKKPP

SEQ ID NO: 81225 - DNA, 730 bp, Zea mays
  misc_feature: Ceres CLONE 1566659
  misc_feature: Encodes the peptide sequence at SEQ ID NO. 81226
tggcggccgctctagaactagtggatcccccgggctgcaggaattcgtctcacccctagaaaaaaggaagagcctagctagctttccccagctcttcttccacagcactgtctgtctcgcaattagctgtactaatccgctagtggcactgctgctactctcgtgtactcccagctatctcctctctatactcttgtacgtacgcacgtgtcgcaaccgcaatggagtgcgagaccgggcttgtccgctccctgaacggcgagggcctgtgcatgtcggcggcggcggcggcgccgcgcgccgacgccctgaactggggcaaggccgcggaggacctgtccgggagccacctggacgaggtgaagcggatggtggtggagttcccgcgagcccgctggtgagggatccagggccgccagccctgaaccatccggggaagggggggccccccctggggcccccggggcgcccccggggggaaaagacccccccctggggaaactggggaaaaaaaactcccccccgcgggggccggcgtttaaaaggggcccaacaccaaaaagtggggggtttttttttgacaccaccccctttgttgaaaaaataaggggggggcccccaccaaaaatagaattgggggggggggtgttgcaccccacccccaccccaggggttgttattacgggggggccgcccccccccccccatcttttaaacaacaaaaaagaaa

SEQ ID NO: 81226 - protein, 59 aa, Zea mays
  misc_feature: Ceres CLONE 1566659
  misc_feature: SWISSPROT Homolog: EC 4.3.1.5 Phenylalanine ammonia-lyase
MECETGLVRSLNGEGLCMSAAAAAPRADALNWGKAAEDLSGSHLDEVKRMVVEFPRARW

SEQ ID NO: 81227 - DNA, 748 bp, Zea mays
  misc_feature: Ceres CLONE 1566661
ccccgcggtggcggccgctctagaactagtggatcccccgggctgcaggaattcgtctcacccctagaaaaaaagctctcactaccaccactcactgccccggatccataccagctgcagcagcagcgcgcgcgagctagcttcggtcggtcgatagatcgatcgatcgctcggccatcatggcgacggtgaggagcaggacgtctgcgtgtcgtacgggagatcgtggaaacccccggacgtgggaatccctacagggccccggaaattccccgggtctccccgggaccctttttagggggggcgcgggtgggacccccccccccccgtgggggggaaaatttcccctggggggcggggggaaaccctctaaaaatttggggggcgcccccccgggggggaaaaaaacacttcccttttttgggggagacccccccaccccggggggggggggagaaaaacgtgggggggggaaaaaaaaaaaacaaaactccccggggagagaaaaataaaaatattggccccccacaaacgggagaggaggggccgagagcgcgtgtaaaaaaaaaaaaaaatttttaggggggggggtcgtagccccccccccccccccctcccccataaaaacaaaaaaaaaaaaattatatttttttttttgtttgcgcgtggccagaccaccccatacaccctccctttttttcgtggggtggggggggggagggggaaaatacccaccaccttccctccc

SEQ ID NO: 81228 - DNA, 822 bp, Zea mays
  misc_feature: Ceres CLONE 1566663
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (760)..(760): n is a, c, t, g, unknown, or other
  misc_feature (761)..(761): n is a, c, t, g, unknown, or other
  misc_feature (777)..(777): n is a, c, t, g, unknown, or other
atagagataagaggaaaagtagacaagccctttcgtacttctccaactattatacttaaactggnnntnnnnnngnnnnnnntcaaattggggctcacgcggtggcggccgctctagactagtggatcccccgggctgcaggaattcgtctcacccctagaaaagctatccaccccatcgcgttgccggatcgagcttggctctctcgaaccttgcttcgccgcacggcaccaaaagcacggccgcgctctcatccccctccacacgttttccgcctccggatccataagccgccgtgagcccgcggcgaacataactcctccctctcgaagcttttcagctctcggagggccgggggttattaaaccgggggttttttttattttttgaaaattttacccgggggggggggaaaaccccaatgggaacatattaaaaagccccccaggggaaaaacccccccccctttgggttttccccccccccaggggggttttccccggttttttaaaaaaaggggggggccccacaaaaaaaaaaaatttggggcgcaaaaaaaaacaccccttttggggggaaaacaaaacccccccccttttttataaatacacccggcgggggagaaaaaaaaaaaaaataccctggcggggggaaaaaaaaaaaaaccccccccccccactnnnggcgcggggggggggggtgggcgctcttcctccagaaaaaggaggggaagaaaaaaaagggggggggggcgcgcgtnntgaagaaaaaaaaaanagcttttttttcgtggtgaataaaaaacaacgcccccccccccca

SEQ ID NO: 81229 - DNA, 852 bp, Zea mays
  misc_feature: Ceres CLONE 1566665
  misc_feature: Encodes the peptide sequence at SEQ ID NO. 81230
  misc_feature (768)..(768): n is a, c, t, g, unknown, or other
  misc_feature (803)..(803): n is a, c, t, g, unknown, or other
  misc_feature (832)..(832): n is a, c, t, g, unknown, or other
ctccccgcggtggcggccgctctagaactagtggatcccccgggctgcaggaattcgtctcacccctagaaaaagctagtccccgaaaaacaagaaccatcgtacgggtgacgtggccaacacttccgtttttgttccggccaggcggctcgtgtccccgcagtcggcaggagcgcggacgcagatccgacggcctaggggcactccggggaggccacgcaacgcgcgcggcggcaggcaagaactccgaagtcggcacggccgcacggccgctacgatacggcgccctcacaattgggccgttataaaacgtcacaggaggaggagataggcacacggcgtgccgcggtgggcgaccttttttgcaccgggagataaatcgacagcaccctgacctcaagtcctcaacccgcaggccgcagctgctcccgcccgccgcgcaagcggccaagcgccgccggttcttctcgagcaagagtacatgacttttgagctaagtgtttttcgtgagttctcataaatcattgtcctcataacttgtaatgggtggaagccagtatgatgatgactgggtgttgcccagtgccgatatcactcttgttctggttgggaaacttggctatggcaagagtgcaactggaaatagcatccttggacgggaagcatttgtatcagaatattcacatgccagtgttactaatacttgtcagttgggaagcactaccctgaaggacggccgcacccatcatgttattgatacaccagggntatttgatatgagcattacatcggacgaggctggntaagagattgttaaatgcatgaacatggnctaagatgggatacatgcag

SEQ ID NO: 81230 - protein, 87 aa, Zea mays
  misc_feature: Ceres CLONE 1566665
  misc_feature (17)..(88): Pfam Name: AIG1 Pfam Description: AIG1 family
  misc_feature (76)..(76): Xaa is any aa, unknown, or other
MGGSQYDDDWVLPSADITLVLVGKLGYGKSATGNSILGREAFVSEYSHASVTNTCQLGSTTLKDGRTHHVIDTPGXFDMSITSDEAG

SEQ ID NO: 81231 - DNA, 861 bp, Zea mays
  misc_feature: Ceres CLONE 1566667
  misc_feature: Encodes the peptide sequence at SEQ ID NO. 81232
gcggtggcggccgctctagaactagtggatcccccgggctgcaggaattcgtctcacccctagaaaaaacgcttcgcacttgcaatagttcgtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctggacaccatctacgtctccgggtggcagtgctcgtccacgcacacctccaccaacgagcccggcccggacctcgccgactacccctacgacaacgggcccaacaagttggagcacctcgttcttcgcggcgatctaccccaaccgcaaggcagcggggaggggcgcatggtcgttgccccgcgcccgagcggggcgggggcggcctaaggtcgactttccttaaggcccatctatcgccgaagggggacacgggggttgtggcggggcccacgggccaccggtaaaggctctggcaaggctcttttgtgtcaaacgcgggggggggccccggggtgcccccctcggaggaccgagccccttcgctgccccaagagaagggggggcgcccatgggtgggggtcgaggg

SEQ ID NO: 81232 - protein, 166 aa, Zea mays
  misc_feature: Ceres CLONE 1566667
  misc_feature (21)..(166): Pfam Name: ICL Pfam Description: Isocitrate lyase family
  misc_feature: SWISSPROT Homolog: EC 4.1.3.1 Isocitrate lyase
MASPFSVPSLIMEEEGRFEAEVAEVESWWGTERFRLTKRPYTARDVVLLRGTLRQSYASGEMAKKLWRTLKAHQAGGTASRTFGALDPVQVTMMAKHLDTIYVSGWQCSSTHTSTNEPGPDLADYPYDNGPNKLEHLVLRGDLPQPQGSGEGRMVVAPRPSGAGAA

SEQ ID NO: 81233 - DNA, 869 bp, Zea mays
  misc_feature: Ceres CLONE 1566669
  misc_feature: Encodes the peptide sequence at SEQ ID NO. 81234
acccgcggtggcggccgctctagaactagtggatcccccgggctgcaggaattcgtctcacccctagaaaaacctcccctcctccccatcgcgtcctctccgctacacctcgccgatcggatcgcgacgagacgccgcgcgatccgacctaggctgacgccaacgaccactctcgccgccggcggtcatggcgtacggcgaccgcgttaccaccttcgaggactcagagaaggagagcgagtacggctatgtccgcaaggtctctggacctgtggttgttgctgatggaatgggtggtgctgccatgtatgaacttgtccgcgtcgggcatgataacctcatcggggaaattatccgtcttgagggcgattcagctacaatccaagtttatcacgaaacagctggactgatggttaatgaccctgttttgagaacgagaaagcctctatcagttgaattgggacctggaattcttggaaatatttttgatggtatccagcgccctctaaaaaccattgccattaagtcaggagatgtgtatattcctcgtggtgtttcagttcctgcccctgacaaagatgcataatggggatttccagccaagaaactaggtgttgggagatgtcatcccaggtgggagatcttatccccttctgttctttgaaaacccttggatccgcaccctggtttgtccttcccccgggttttatgggggaaaaaaaattttaatttggcccccgctgggtccagaacaacctttaggagaacccggggcttaaaatttgggaattttcgggggcttaaaaaaaggaaatttttcccttgtgtttttaaaaattggggccgtgtgggcgttttccacaaggggc

SEQ ID NO: 81234 - protein, 132 aa, Zea mays
  misc_feature: Ceres CLONE 1566669
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLIGEIIRLEGDSATIQVYHETAGLMVNDPVLRTRKPLSVELGPGILGNIFDGIQRPLKTIAIKSGDVYIPRGVSVPAPDKDA

SEQ ID NO: 81235 - DNA, 856 bp, Zea mays
  misc_feature: Ceres CLONE 1566670
caccgcggtggcggccgctctagaactagtggatcccccgggctgcaggaattcgtctcacccctagaaaaagtgttgccttctcgtcatatacctgccgcacccgaatgggcgcagcggaccacacactatacatcaggacaggtgcgtgtgcatctccgcctcgacggcgtcgtctgcctgcacaaccttcttctatcatgtatgacgaatggtcggctgacaccctacgagcaccaagggaaggcaagcccagccaggaatctccgtccggttcccggccgccgtaccttctcataaacgcatcggatctgtatggggttttcagtaagaagtagaaaacgcctgagagaatgcagaaagatgtgcttgcacgtcaaagagctactttgtgagggacttggcaggaaagcacgccatactcttacattctctggcacctcttgatgacttcgaagctgaaaagtacacatatctccacgtcgtgcttgctcacaatggggttcgacatggaggatcaaccgtcttgttagatcaccatctcggtggagacggtggagtacttgcagcatctcgacctctttgctgtatcaattatttatttactgacacggataagccagtgacctctgtgtgcatacaagcacgacccatacgtaggcatacacaggtacagatgggcacagcattaagggaagcgttctcttggctcaggagggacaatgggggacattgcttgggccaagggaacctttgcccaaggtttaacgatggttcgggagaaccgcgtacctttgaaaaagttgttccggtatccaaggtaattgtgaaaacgagtaagggttttttaaaagga

SEQ ID NO: 81236 - DNA, 1006 bp, Zea mays
  misc_feature: Ceres CLONE 1566671
  misc_feature (164)..(164): n is a, c, t, g, unknown, or other
  misc_feature (170)..(170): n is a, c, t, g, unknown, or other
  misc_feature (172)..(172): n is a, c, t, g, unknown, or other
  misc_feature (189)..(189): n is a, c, t, g, unknown, or other
  misc_feature (225)..(225): n is a, c, t, g, unknown, or other
  misc_feature (234)..(234): n is a, c, t, g, unknown, or other
  misc_feature (240)..(240): n is a, c, t, g, unknown, or other
  misc_feature (243)..(243): n is a, c, t, g, unknown, or other
  misc_feature (246)..(246): n is a, c, t, g, unknown, or other
  misc_feature (700)..(700): n is a, c, t, g, unknown, or other
  misc_feature (701)..(701): n is a, c, t, g, unknown, or other
  misc_feature (821)..(821): n is a, c, t, g, unknown, or other
  misc_feature (823)..(823): n is a, c, t, g, unknown, or other
  misc_feature (827)..(827): n is a, c, t, g, unknown, or other
  misc_feature (860)..(860): n is a, c, t, g, unknown, or other
  misc_feature (861)..(861): n is a, c, t, g, unknown, or other
  misc_feature (943)..(943): n is a, c, t, g, unknown, or other
ctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattnagatcngnaatcacgggctcggaanggatcgcaggctcgtggccagggtcgccctcagaanccagatgtnaagtcnttnccnttaaaaaaccctttttcccccggaataaatgacccaacgtgttcaagccaaacccccccccggccccttgggaacccgggccccccccccgggggccccaaaacccctttttttgggaaaaaggggcgcccctttttgggtatagaccccccgaaaaaaccccgggggggggggggcccccatattttttgggggaccccccccccctcttctaaaagaaaaagggggcgccccctccttcaggggggggggaaaaaaattttttttttccccccacaaaaaaaaaaaaaaatttttttttttgtgtgttggggaagaaaaaaccccccccccccttttttttttttttttttttgggggagaaaaaaaaaaaaatcacccacccccccgcggggagggctgttaaaaaaaaaaaaaaagggggggggggggggggggggagggagacgcaccnnccccccccccccccccccccaaaaaaataaataccccccccccacagggagggggggggggggggggggtggtggagttttttttttcttctcccccgccgccccgggggcggggggtgngnggangtaataaaaaaaaaaagataaaggttgtgtatnncttttttttttttttgttttctttttgttttgttgcgcccgccccccggccccccccagaaaaaaaaaaaaaaaaaaaaaanacacaactaccccgcgcgacaggtggtggggtgggtgtgtttgtgtccccccgccgccccccc

SEQ ID NO: 81237 - DNA, 847 bp, Zea mays
  misc_feature: Ceres CLONE 1566672
  misc_feature: Encodes the peptide sequence at SEQ ID NO. 81238
  misc_feature (732)..(732): n is a, c, t, g, unknown, or other
gcggtggcggccgctctagaactagtggatcccccgggctgcaggaattcgtctcacccctagaaaaaacgcatcaataaataggagcttgggaagttgccaaggcctccgattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcaccagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggcggccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatatttgagaggctgctgntcttagtacctgtaatagaatggaaatttatgtggggggcgctatcatggaaaccgtggtatcagaggaataattggacctggatgtctcaagaaaagggtattccccgcttccc

SEQ ID NO: 81238 - protein, 120 aa, Zea mays
  misc_feature: Ceres CLONE 1566672
  misc_feature: SWISSPROT Homolog: EC 1.2.1.70 Glutamyl-tRNA reductase
MATTTSATTAAAPAATTAKPRGSSSALCQRVAGGGRRRSGVVRCDAAGVEAQAQAVAKAASVAALEQFKISADRYMKERSTIAVIGLSVHTAPVEMREKLAVAEELWPRAIQELTSLNHI

SEQ ID NO: 81239 - DNA, 957 bp, Zea mays
  misc_feature: Ceres CLONE 1566676
  misc_feature: Encodes the peptide sequence at SEQ ID NO. 81240
  misc_feature (912)..(912): n is a, c, t, g, unknown, or other
ctggagctccccgcggtggcggccgctctagaactagtggatcccccgggctgcaggaattcgtctcacccctagaaaaaattccgcaccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgccccccgcgcacgcatcgctgctgaccgcgcacctggcgcgcatgaaggagtccggagagctcgtcttcctcaagaacaactacttccgcgcgggcgcccccgacgcgccgccgaagcgcgggcgcgggcgccctcccaaggcgcgggacccgaacgcgccggcgccggcgcccaagtcgccgtcgtcctcggggtcgcgggcgcgggcgcccgcccaaggccaagagcccgctggaagccgccgtgaagcaggccaccgcggggatgcccaagccccgcggccgcccgcccaagaaggccaagaccgagggcgccgcgtccccgtccccgtcccctgcccctgctgtcgactggtccacccccggcaagcgcggccgcggcatgccccccaaggtacgccccgccgtgcccagcgagacggccgcggcttgacggcgctttctggggataatagttcgtcccgccgcgagatgggattgttagggcgtagcaattcgtcccgctgcagccgatgctgcggctgcagctgccctggttatgttggtagggctggtctcatgcttcatctaattgttgtcgtcgccgtcgtcgttgctcatttattatgggagtatttngggagatttgatgtgctggtctcctgtgcggtgttgtgttcagtt

SEQ ID NO: 81240 - protein, 269 aa, Zea mays
  misc_feature: Ceres CLONE 1566676
  misc_feature (13)..(81): Pfam Name: Linker_histone Pfam Description: linker histone H1 and H5 family
  misc_feature (254)..(254): Xaa is any aa, unknown, or other
MATDEATKPSPIPPYPEMILAAIEGLDDKSGSNKSAISKYIEGKYGSLPPAHASLLTAHLARMKESGELVFLKNNYFRAGAPDAPPKRGRGRPPKARDPNAPAPAPKSPSSSGSRARAPAQGQEPAGSRREAGHRGDAQAPRPPAQEGQDRGRRVPVPVPCPCCRLVHPRQARPRHAPQGTPRRAQRDGRGLTALSGDNSSSRREMGLLGRSNSSRCSRCCGCSCPGYVGRAGLMLHLIVVVAVVVAHLLWEYXGRFDVLVSCAVLCSV

SEQ ID NO: 81241 - DNA, 925 bp, Zea mays
  misc_feature: Ceres CLONE 1566679
  misc_feature: Encodes the peptide sequence at SEQ ID NO. 81242
  misc_feature (837)..(837): n is a, c, t, g, unknown, or other
  misc_feature (891)..(891): n is a, c, t, g, unknown, or other
ctggagctccccgcggtggcggccgctctagaactagtggatcccccgggctgcaggaattcgtctcacccctagaaaaaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgccggaggcgctggggctgggcaactgggtgaaggcgcaggagtgggcggccgtccccggcgggcaggccacgtacctgggcgccccggtgccgtggggcacgctgccgaccatcctggcggtcgagttcgtggccatcgccttcgccgagcaccagcgcacaatggagaaggaccccgagaagaagaagtaccccggcggcgccttcgacccgctcggcttctccagggaccccgccaagctcgaggagtacaagctcaaggagatcaagaacggccgcctcgccatgctggccttcgtcggcttctgcgtccagcagtcggcgtacccgggcaccggcccgctcgatgaactcgccgcccacctcgncgacccctgggcacacacatcggcgactcatcatccctagatgatctcccctgnaagttatattggttgatattacgactagcactag

SEQ ID NO: 81242 - protein, 243 aa, Zea mays
  misc_feature: Ceres CLONE 1566679
  misc_feature (58)..(215): Pfam Name: Chloroa_b-bind Pfam Description: Chlorophyll A-B binding protein
  misc_feature (231)..(231): Xaa is any aa, unknown, or other
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLAVPGVLVPEALGLGNWVKAQEWAAVPGGQATYLGAPVPWGTLPTILAVEFVAIAFAEHQRTMEKDPEKKKYPGGAFDPLGFSRDPAKLEEYKLKEIKNGRLAMLAFVGFCVQQSAYPGTGPLDELAAHLXDPWAHTSATHHP

SEQ ID NO: 81243 - DNA, 1247 bp, Zea mays
  misc_feature: Ceres CLONE 1566680
  misc_feature: Encodes the peptide sequence at SEQ ID NO. 81244
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (64)..(64): n is a, c, t, g, unknown, or other
  misc_feature (845)..(845): n is a, c, t, g, unknown, or other
ggggggtggtgcctnnnctacacagaaaagagaagaatgtaccgctaaataaaaaaataaacgngggggggaaaagctgggactccccgcggtggcggccgctctagaactagtggatcccccgggctgcaggaattcgtctcacccctagaaaaagctcatcagaacgctagctaggactaggagaagcttaacttctgcaaccaccgataagagtgactactatttacataggagcggcagatgccaccgcgtgcgccggcgatggggtggtgggagaacgtcaagagcgtgttcggagacgccgggaacgtctgctgcttcccgaggatcgggaggaatcagtccaagaactcgtacactttcccgggagatcctgggagcgaaaaaccgagagggtcaggaggcccctcccccgccccggaggaagagatcacagcggaggtgccggaagtgcccccgctacaagctgaacgggatcgcccccggtggttcgcaggcctagaacctgaacgaggcaaagggtcccaaccaccaaggcgctacccaagcccaagtaaggcggaaaagggctgggcctagcttgtcgcatcaagttggttaggaaaaaaagtcccccccaagtcatacgccgtaccgaaacggagcgggcatttcccatcaaaacaacaactacgaggtggttggcacgttaacgatgacctttccacggtcggcgtgacaaaacatcttcgtccacacccgcaaggtggccctgttacggggggataaagtcaccagaattcctcaagtggagggggggagagagtctttgcctcgggatagttgggacccatgtgcatcancataacataaaagagtattatcaagtccccacgccccaattggggaggagagaatcaccacctccctaacatacaagaccgcgtagtccgatataccaaatgtgttagagagggaggtgtatttatcatactatcgacacctcaccagtccccccccgtgagagaagtataagatagcatgcacccccggtctgagcgagggagagagttgggccacgtgcaataaagaaagcttgttggatgaatgttgatgcagaggcggtagcatctccggacccgtctttgtggtgacacatacgacaggcaacgaaagatgaaaaaatgagatgcgatctaggtgggttccacgacgcggagggtatacacacgcgtatagtatttttctgacatacgtcacattcc

SEQ ID NO: 81244 - protein, 105 aa, Zea mays
  misc_feature: Ceres CLONE 1566680
  misc_feature: SWISSPROT Homolog: EC 2.8.2.2 Alcohol sulfotransferase
MGWWENVKSVFGDAGNVCCFPRIGRNQSKNSYTFPGDPGSEKPRGSGGPSPAPEEEITAEVPEVPPLQAERDRPRWFAGLEPERGKGSQPPRRYPSPSKAEKGWA

SEQ ID NO: 81245 - DNA, 969 bp, Zea mays
  misc_feature: Ceres CLONE 1566681
  misc_feature (362)..(362): n is a, c, t, g, unknown, or other
  misc_feature (754)..(754): n is a, c, t, g, unknown, or other
  misc_feature (756)..(756): n is a, c, t, g, unknown, or other
  misc_feature (942)..(942): n is a, c, t, g, unknown, or other
tggagctccccgcggtggcggccgctctagaactagtggatcccccgggctgcaggaattcgtctcacccctagaaaaattacatccttccggaatgattattcctctctgatagagatctcggatccatactatggtgccaagcgggcgaacaagttattccattgtcaaagatatttcgctggtgcgaacgctgatattgaatcgctacctgtgcccttggctgaaaacactgtgcagattatagctcggacctcttcttccataaatgactggcacatctcgccagttgaaatatgccaacatactcctacactatcgccgggccatacacttctattacagaacagaacccgcagtcnaggaaagttgcgagaaaagaaatttccccgaactctatatctctgctccaataaacaaattcagagcaagtgtccaatcgctcgtgtaccaccaactggtgtgtctgcaacatggtgccccgatgaagattggttttcaaaatttcgaaaccaatatacgctctaagaactttcctcctttgctccaagatccagaattcgctccaaattcgagtgtctcttcaccaggatctcttgatgacatattccataggttgaaaccgccgcctgcctatgtgcctgtggattaccctgacgatgacgatgatgtcaacgtaagagatacatatcttcttttccaagatcaatgaaatatgtgcgcgatactctattacgttcattacatgcatccncngactactagtacaattgctctcactagatcttctaggaagatacagcatgtatagatctgatgcatggattggtgtgcttcctggcaactcatgacaactgtccatcatgaagactgacttacgtacttgcgatatgatgtcagccctttactgatcgattagcactctcccctcccaaaatgttngaggactaatctactacgtaccgctat

SEQ ID NO: 81246 - DNA, 872 bp, Zea mays
  misc_feature: Ceres CLONE 1566684
  misc_feature: Encodes the peptide sequence at SEQ ID NO. 81247
ctccccgcggtggcggccgctctagaactagtggatcccccgggctgcaggaattcgtctcacccctagaaaaacggcgccccgcccctcgtactcggtgagatatatccccgccttccctcgcgaaagctctcgtagagacgacgacgacgacgacgacgacgacgacgcgagaagtcgaggcgccgctgcttgctaggaccgagcttcaggaagtctccaacggccccggcgccggcacggcctgccccgcgccgccacagggattgattgtgatcagatctattctgtagtggtcagcggctgagggtgaaccgaagatgagcgttgtgggattcgatctcggcaatgagagctgcattgtggcagtcgcgcggcagcgcggcatcgacgtggtcctcaacgatgagtccaaacgcgagacacccgccatcgtctgcttcggggacaagcagcggttcatcggtacggcgggcgccgcgtcctcaaccatgaacccaaaaactccatttctcagatcaagcgcctgctcgggcggcaagttctccggaccccgagctccagagtgatctcgcgtccttcccggttccggggcacgggaggggcccgaagggattcccttggtacatgtgggggttctggggcgagggaggggaggtttccccccacccgggtggcttgcccaggggggctggcccaatctggagggggattggttgagggggaacccttaagagacgggggggtggttgaattggcggcatttgggcactccccgggggggcctcccgggggaattttgccgcgcgcaagggggttggtccttgggagggggggcagacaagtgggcaggggcctcacgcgccgtgttg

SEQ ID NO: 81247 - protein, 82 aa, Zea mays
  misc_feature: Ceres CLONE 1566684
MSVVGFDLGNESCIVAVARQRGIDVVLNDESKRETPAIVCFGDKQRFIGTAGAASSTMNPKTPFLRSSACSGGKFSGPRAPE

SEQ ID NO: 81248 - DNA, 857 bp, Zea mays
  misc_feature: Ceres CLONE 1566686
  misc_feature: Encodes the peptide sequence at SEQ ID NO. 81249
ctccccgcggtggcggccgctctagaactagtggatcccccgggctgcaggaattcgtctcacccctagaaaaagtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccagcggcaacgccactgttcctgctatggagatgaccaagtggtttgacaccaactaccactttattgtctctgaattgggcccaaacagcaagttctcctatgcttctcacaaggctgttaacgaatataaggaggctaacgcgctcggtgttgataccgtgccagtacttgttggaccaatcctcgtacctgttgcttctaaagccctgccagggtgtttgaaaaaggattcccctcttccttccctttctttccagcttccttcccgtcttacaagagggacctttgctaaatttaaaggcacctggggccttcctgggattcccttttgaagaaaccccacttttttgtccccccaactttgattcttgaaccaaattggcctgtgcatttccccggggtggcagaaacccaggaaa

SEQ ID NO: 81249 - protein, 208 aa, Zea mays
  misc_feature: Ceres CLONE 1566686
  misc_feature (2)..(207): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMASGNATVPAMEMTKWFDTNYHFIVSELGPNSKFSYASHKAVNEYKEANALGVDTVPVLVGPILVPVASKALPGCLKKDSPLPSLSFQLPSRLTRGTFAKFKGTWGLPGIPF

SEQ ID NO: 81250 - DNA, 857 bp, Zea mays
  misc_feature: Ceres CLONE 1566690
  misc_feature: Encodes the peptide sequence at SEQ ID NO. 81251
  misc_feature (628)..(628): n is a, c, t, g, unknown, or other
  misc_feature (781)..(781): n is a, c, t, g, unknown, or other
ctccccgcggtggcggccgctctagaactagtggatcccccgggctgcaggaattcgtctcacccctagaaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattccagggttcagcatgcccggcagcggcagcagcctacccgggttcagcttgcccggcagcggcagcatgcccctcttcggcggcgccggctccgtccccgagcacgccaaacagccctgacgccaacaagcgtggtaagtagagtggtgctactgttactgtangtacgtcgtcgtcttcatgcatgcatgggttcgtggtttcccctagctccataccgaagcagtagtggggccttgcaccgtaccgaacgtctagctagctatatatataagcttggggttctacctgctttttaagtttaattacctgcctgncattgggaagaagttggatctgttttcaaatttgggggggggtttgctttaactattaaggtcaagaatctggttt

SEQ ID NO: 81251 - protein, 112 aa, Zea mays
  misc_feature: Ceres CLONE 1566690
MARSSKMMVAAALLALALAVSTAEARNIKTTTTEKKDDAVVQPQTFPPFDRLGGGASPAFGGLPGGSIPGSSIPGFSMPGSGSSLPGFSLPGSGSMPLFGGAGSVPEHAKQP

SEQ ID NO: 81252 - DNA, 849 bp, Zea mays
  misc_feature: Ceres CLONE 1566691
  misc_feature: Encodes the peptide sequence at SEQ ID NO. 81253
  misc_feature (802)..(802): n is a, c, t, g, unknown, or other
acccgcggtggcggccgctctagaactagtggatcccccgggctgcaggaattcgtctcacccctagaaaaaacccgactaccccgcaagtcgaggccttccgctggctctcgctcgctcgctcgccccgcgactggttgcctctccgccccgaccctgccctgagaccggagacgaccgcgccccgcggtggcgctgcgacccgcgatacggaaattccccgtttaattgcatattggacatgtcttgtggcgtttgattggagaatttaattcttcccaacgatttccgttcttcggaggcttccatcttggtttcagttctgcaggttgtgtgtttgtgatctgtgactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccaatggacaggctgggagcaccgcatttgagtacgggaccaaattctcacggtcacttggatggggcagtgatgatggttctgaagagtccatttttggaaccggggatgcagatgatgtcaagcctaagagctttcttgtgtgtgatgaccggcactctgagctgatcccctgcttggatcggaacttgatatatcaaatgaggctgaagctggattttaacctgatggagcactatgagaggcattgccctccaccctgaaggcngttttattgcttgattcctccacacatgcctataagggtcctataaa

SEQ ID NO: 81253 - protein, 119 aa, Zea mays
  misc_feature: Ceres CLONE 1566691
MRGRNDSGNSKPVVLCCVMIVCLCLLFLYFSGSNGQAGSTAFEYGTKFSRSLGWGSDDGSEESIFGTGDADDVKPKSFLVCDDRHSELIPCLDRNLIYQMRLKLDFNLMEHYERHCPPP

SEQ ID NO: 81254 - DNA, 991 bp, Zea mays
  misc_feature: Ceres CLONE 1566692
  misc_feature: Encodes the peptide sequence at SEQ ID NO. 81255
aagctggagctccccgcggtggcggccgctctagaactagtggatcccccgggctgcaggaattcgtctcacccctagaaaaagaacaaggaacaatagcctttcctctcactcgcccctctgcatttaccactttgccctcgtcggcggcgctgaccacccgccgccgagtccggcgaaacaaccgcctgtagttccagagtagtacctcatggcggccatatcgtcacttcccttcgcggcgctgcgcggagccgccgagtggaggccttcgtcgacggcggcggccgtctccggcgccgtcgtgctcagcgcgaggtctcgccggggctcgcgctcggtggtgcgatgtgtcgccacgacgggtgatgtcccacccactgtcgcagaaacaaaactgaacttccttaagtcatacaaacgcccaatcccaagcatttacagtgcagtcttacaagaacttttggtgcagcaacacctgatgagatacaaaaaaacctatcagtatgatgctgtgtttgctcttggcttcgtcactgtctatgatcagctcatggaagggtaccccagcaatgaggacagggattccatcttcaaggcatatataacagcattaaatgaagatcctgatcaatacagagctgatgcacttaagatggaagagtgggcacgttcccagaacggtagttccctagttgatttttcttccagagatggagaaatcgacgctattccgaaagatatatcagaaaagggccaagggttatgggaaacttcagcttcagccgaattcctttgcagttggcttggttccgtttgcctgaagctccccaaatgcaccggaggccacaatacttaaacaagcttttgcgcctgcactaaaccgtcagtataagaaagggggaatagggacccttgtatgtttaccgccaacatacctccaaaagtgggtgtcaggcaagaaaacttcccaaggaaaaaccgtggatag

SEQ ID NO: 81255 - protein, 215 aa, Zea mays
  misc_feature: Ceres CLONE 1566692
MAAISSLPFAALRGAAEWRPSSTAAAVSGAVVLSARSRRGSRSVVRCVATTGDVPPTVAETKLNFLKSYKRPIPSIYSAVLQELLVQQHLMRYKKTYQYDAVFALGFVTVYDQLMEGYPSNEDRDSIFKAYITALNEDPDQYRADALKMEEWARSQNGSSLVDFSSRDGEIDAIPKDISEKGQGLWETSASAEFLCSWLGSVCLKLPKCTGGHNT

SEQ ID NO: 81256 - DNA, 993 bp, Zea mays
  misc_feature: Ceres CLONE 1566696
  misc_feature: SWISSPROT Homolog: EC 2.4.1.12 Cellulose synthase (UDP-forming)
  misc_feature (68)..(68): n is a, c, t, g, unknown, or other
  misc_feature (74)..(74): n is a, c, t, g, unknown, or other
  misc_feature (75)..(75): n is a, c, t, g, unknown, or other
  misc_feature (79)..(79): n is a, c, t, g, unknown, or other
  misc_feature (80)..(80): n is a, c, t, g, unknown, or other
tggtggtgtgttttttttttttatttttctccctttcgtcccgccgcccccccccctatctcgctggngagggnntttnntaagctggagctcccctcggtggcggccgctctagaactagtggatcccccgggctgcaggaattcgtctcacccctagaaaaaacgacgcctgtctccgctggcacgcatgtcctgctcacgtctcctcttctccctcctcggtgcgacatggcgcggctcggacgcttcggtgagaaaccactcggggatgaggatctgctgctagaatgagaggagctactggcagtatcctctgccttcctcagcggccgaagtggaggggaggaaccgatggaggcaagcccctggctggtggccagctcccacaaccacaactagctcgtcgtcatccgcctcgacagcgatcccgggccgaatccgccgctggagcagaacgggcaggtgtgccacatttcccgcgacgacatctgtcttgcccccggcggggaccccttcaccgcgtgcaaccaatgcgccttccccgtctggccgggactgctacaaaaactaacgccgggagggaaacgcaaaactgcccccacctgaaaagacgtcgatacaatctaccctcaaggatcttgcctagccttgggacccggtggaagaaggacggaggtaccgtgcttccgaatgaccctgtggacaacccaagtttcacacttggaaaacgggcccatagatctcccacaattcttgatgggaccgaacataccagtgaataatacctgttccaccagggaggcttaacagctccgtgggcaaggtggaacctcctaattggtcgccggcccaccaaaaacatttttctaagactccaaatccccaaaaatgtttttcaacattccgtaggcaccaaaagggaggaacgggaaagggtgggcaattgaattaatcccccaacttgggaaaacccttaacaacgccatctctt

SEQ ID NO: 81257 - DNA, 887 bp, Zea mays
  misc_feature: Ceres CLONE 1566697
  misc_feature: Encodes the peptide sequence at SEQ ID NO. 81258
  misc_feature (448)..(448): n is a, c, t, g, unknown, or other
ctccccgcggtggcggccgctctagaactagtggatcccccgggctgcaggaattcgtctcacccctagaaaaactgtcagccgagccaagttccgaatgggggtggcttggcttggctggctacaagtcactcaaattgaaataagactgaaacggacaaaggcaaacacagcaagcaaagcaggaatcggaggtagacgacgaccaccacggggataacaaccaaacctcccaaataccatccacgaacgaaagggaaggtcgtttaggcggcgcgccgaggccgtggctatggaccccaacggcggcggcgacaccatcctcggcgatcccctccttcccctctcgcagtccagcaagcagcagcaggatcctctcgccggcgtctccgactaccttgggcggtccgtgcaccgcggaagctccgggggatggagatccgcgctnctcgtcgtgggcgtcgagatcgccggtaagctcgcctacttcggcatctctgccaacctaacacgtacctgactggtccgctgggacagtccaacgcctccgctgccgcctccgtcaaagcctgttccggaagggctgaattatgcccctggttgggcgcctccttgccgaagctaactgggccggttacgatccggaattatggccgggaccctttaaagtcctggccttccaaaaggcctggaaggggggaagggggttcctggccttcttatgcccaaacccggggggcgcccggggggctttttttataaggccccctggtaccgaaacccccacccgaagggggcccaaaaaaaccggggggggggggggttttccgggggaaccatttttaccggaaaaacccggggggggagcccccctcccccgggggttt

SEQ ID NO: 81258 - protein, 75 aa, Zea mays
  misc_feature: Ceres CLONE 1566697
MDPNGGGDTILGDPLLPLSQSSKQQQDPLAGVSDYLGRSVHRGSSGGWRSALLVVGVEIAGKLAYFGISANLTRT

SEQ ID NO: 81259 - DNA, 950 bp, Zea mays
  misc_feature: Ceres CLONE 1566698
  misc_feature: Encodes the peptide sequence at SEQ ID NO. 81260
  misc_feature (749)..(749): n is a, c, t, g, unknown, or other
  misc_feature (848)..(848): n is a, c, t, g, unknown, or other
  misc_feature (849)..(849): n is a, c, t, g, unknown, or other
  misc_feature (907)..(907): n is a, c, t, g, unknown, or other
ggagctccccgcggtggcggccgctctagaactagtggatcccccgggctgcaggaattcgtctcacccctagaaaaaagacctttccccttccgtccccggccggcgccaacgccactccagtgagccgagggcggagacggtcacggtgggcagagtgacacgccgcacgcctctccgccccgctccgctccagattgcgcgcacccacccatggcgctcgccgcttcccaccacggcctcctgcccttcgcccccgctgccacgcctaccccgtcacgggggcacctgcgcttccgcgccgcgcgccctctgccccgccccgcccggagaatttgttgccaatctatcaactcagctaatgtgttgggagcttcttcaacgacatctgatgaggcagtcccagtcccagttgtccagatagatcaggactcagaccgtgatgcgaccattgtgcagctaagttttggagatcgtttgggggcactacttgacacgatgaaagcactcaaggaccttggccttgatgtcacaaaaggaagtgtgacaactgactcagctgtcacacaaacaaagttccacatcatgcgatttgggcgcaaggttgaggaccctgacatgttagaaaggattcggctaaccatcatcaacaaccttctccagtaccatcctgaatcaagtgagaagttagccatgggtgaattttttgggataaaacctctgagaagaaggtagatgttgatattgcnacacatatagttgttgaagatgacggaccaaaaagagcatactttacatagagaccgccgaccggcctggcctacttcttgagataatcagatcttgcnngacacaatattgatgtggatcagctgagattgaacctgaaggttggttgcgaaggacnagttcatggttagtacagaggtggaaactaacagctcctatct

SEQ ID NO: 81260 - protein, 173 aa, Zea mays
  misc_feature: Ceres CLONE 1566698
MALAASHHGLLPFAPAATPTPSRGHLRFRAARPLPRPARRICCQSINSANVLGASSTTSDEAVPVPVVQIDQDSDRDATIVQLSFGDRLGALLDTMKALKDLGLDVTKGSVTTDSAVTQTKFHIMRFGRKVEDPDMLERIRLTIINNLLQYHPESSEKLAMGEFFGIKPLRRR

SEQ ID NO: 81261 - DNA, 817 bp, Zea mays
  misc_feature: Ceres CLONE 1566699
  misc_feature: Encodes the peptide sequence at SEQ ID NO. 81262
ggagctccccgcggtggcggccgctctagaactagtggatcccccgggctgcaggaattcgtctcacccctagaaaaaaaaaccaaaccaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgtcggccccgccagctccgccgcgggcaaccccgatgagatcgccaagctcttccccaacctgttcggccagccctcggcgtcgctggtgccgtcggccgagcccgcggcgaccaggccgctcaagatcggcgttgtgctctccggtggacaggcgccgggcggccacaatgtcatctgcggcatctttgactatctacaggagcgtgcaaaaggcagcaccttgtatggatttaagggaggcccagctgggatcatgaagtgcaagtatgtagaactcacttcagactttgtgtatccctacagaaatcagggtggatttgatatgatctgcagtggaagggactagattgaaacaccggagcagtttaagcaagctgaagacacgggccacaagcttgatttggatggacttgttgtcattggtggtgatgattcaacaccaatgcctgcctccttggtgaatactttaggttcaggacattgaaacccgctgttatggtttgcccaagactatccatga

SEQ ID NO: 81262 - protein, 167 aa, Zea mays
  misc_feature: Ceres CLONE 1566699
  misc_feature: SWISSPROT Homolog: EC 2.7.1.90 Diphosphate--fructose-6-phosphate 1-phosphotransferase
MAAAAVTSNGGAVAANGPAPGRLASVYSEVQTNRLLHALPLPSVLRSNFSVVVGPASSAAGNPDEIAKLFPNLFGQPSASLVPSAEPAATRPLKIGVVLSGGQAPGGHNVICGIFDYLQERAKGSTLYGFKGGPAGIMKCKYVELTSDFVYPYRNQGGFDMICSGRD

SEQ ID NO: 81263 - DNA, 815 bp, Zea mays
  misc_feature: Ceres CLONE 1566702
  misc_feature: Encodes the peptide sequence at SEQ ID NO. 81264
ctccccgcggtggcggccgctctagaactagtggatcccccgggctgcaggaattcgtctcacccctagaaaaatttagctcaactctgcagtctagctacacacaatagagcgcagccgcggcgtgatatggttctatgatggttctttgctgttggctagatatatatgctgctagctactaggtgcgtcatccccttgctatgcgcgggttaagtatatatacacagtatataaaaagtatataaagtcttgctgctggcttgagctccttggatacacctatctgcttctgctagctttctttacagagacgacaggatagctagagccgagggagagatcagggtcgacgatagatgggggtgcatggggctgttgccaaacgaccctgcagcaggcagcatctcctcctcctcgtcgtcgctattctcataggtagctacttcgccgccgccgccgccccgctgcggacgagcagaaaagcaggaatagaggagctggtcgtcgcagccgcaggaggcgggccgcggcggcagtgacgtcgccgcctgcgcccctcatggtgcccatcaccatcctcgagtccgccgtcgacttgggagccgtgtgcatggacggaacaccgcctgcttaccacctgcacccgggctccggagcagggaacaacagctggatcgtcaacctggagggaggcggctggtgcaacaccgtgagggcgtgccagttcccgcaggcgagccggcgcggctcgtcggacctgatgggagaaagagatccccttctccggcatcatgagcagcagtcctgtcgac

SEQ ID NO: 81264 - protein, 84 aa, Zea mays
  misc_feature: Ceres CLONE 1566702
  misc_feature (1)..(83): Pfam Name: PAE Pfam Description: Pectinacetylesterase
MVPITILESAVDLGAVCMDGTPPAYHLHPGSGAGNNSWIVNLEGGGWCNTVRACQFPQASRRGSSDLMGERDPLLRHHEQQSCR

SEQ ID NO: 81265 - DNA, 868 bp, Zea mays
  misc_feature: Ceres CLONE 1566705
  misc_feature: Encodes the peptide sequence at SEQ ID NO. 81266
ccccgcggtggcggccgctctagaactagtggatcccccgggctgcaggaattcgtctcacccctagaaaaagcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcggcgcacctcggcctcagcgacgccgccagcgccgtcgccgcatacgagaagggccttgcgctcgaccccagcaacgaaggtctcaaggcggggctcgaggacgccaagaaggccgccgccgccccgccgcgtcgcgggccgtccggccccgacgccatcggccagatgttccagggcccccaaactgtggagcaagatcgcgttcggacccccccaccacgctcctacctttacgagccccgacttttatgcaaatgccgcgcccaaatggataaggacccccaaccagcatccagcctggtcccctttccaaatcccccgcttatagcagggggccccgcccctcatgccttaaagggcaaaaatcccaaaaaccctctaggccttccgaggcccttcagaggtatttaccccctacgggcggccgcccgcgagaaatccagcatgcgtagcagaacatctctccttatttgaaacaaaaaagccg

SEQ ID NO: 81266 - protein, 235 aa, Zea mays
  misc_feature: Ceres CLONE 1566705
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFTDAIALAPGNHVLYSNRSAALASLHRYSDALADAQKTVELKPDWAKGYSRLGAAHLGLSDAASAVAAYEKGLALDPSNEGLKAGLEDAKKAAAAPPRRGPSGPDAIGQMFQGPQTVEQDRVRTPPPRSYLYEPRLLCKCRAQMDKDPQPASSLVPFPNPPLIAGGPAPHALKGKNPKNPLGLPRPFRGIYPLRAAAREKSSMRSRTSLLI

SEQ ID NO: 81267 - DNA, 872 bp, Zea mays
  misc_feature: Ceres CLONE 1566707
  misc_feature: Encodes the peptide sequence at SEQ ID NO. 81268
ctccccgcggtggcggccgctctagaactagtggatcccccgggctgcaggaattcgtctcacccctagaaaaaattcatggttcatctccatccccattaattcctcccctcactccatcactcccatgtcaagctccaggaaacccaagactcccatcctcctcttcttcctcttccttctcgccagcctcgccttctcccaagagttcacctacaagggcttcagcgccagtggccgcggcgggagcccgaacctgaacctgaacggcacgtcggcaaccgagatcttgcccagcggcatcctccgcctcaccaacgagacgtcccggctcttcggacacgccttctacccgaccccgctgcgcttcctggaccagaagaacggcaccgccgtgtccttctccacgcagttcgcctttaccgtggtgcccgagttcccgacgctcggcggccacggcttcgcgttcgtcgtcgcgcccgacccgcgcatgtccggtgcgctgcccagccagtacctgggcctactcagcgccgccgacgtcggcaacgccaccaaccacctcttcgccatcgagttcgacaccgtgcaggacttcgagttcgacgacgtcaacggcaaccacgtcggcgttcgacctcaaagccctcatctaccacgcggttcgccaagggccgacccttttgaaacctccaagtccgggggaacacccccgccctggggttgaactaacgaacggggaccccccacaggtttgctttaaacgtctccccattcccccaaaaggggaaccgtttgggggaaaaagcccaccccacgggcccggtttaaatgtttgcgtttgcggcgggttcgaaacccttttcttgagt

SEQ ID NO: 81268 - protein, 199 aa, Zea mays
  misc_feature: Ceres CLONE 1566707
  misc_feature (24)..(194): Pfam Name: Lectin_legB Pfam Description: Legume lectin domain
MSSSRKPKTPILLFFLFLLASLAFSQEFTYKGFSASGRGGSPNLNLNGTSATEILPSGILRLTNETSRLFGHAFYPTPLRFLDQKNGTAVSFSTQFAFTVVPEFPTLGGHGFAFVVAPDPRMSGALPSQYLGLLSAADVGNATNHLFAIEFDTVQDFEFDDVNGNHVGVRPQSPHLPRGSPRADPFETSKSGGTPPPWG

SEQ ID NO: 81269 - DNA, 965 bp, Zea mays
  misc_feature: Ceres CLONE 1566711
  misc_feature: Encodes the peptide sequence at SEQ ID NO. 81270
  misc_feature (768)..(768): n is a, c, t, g, unknown, or other
  misc_feature (772)..(772): n is a, c, t, g, unknown, or other
  misc_feature (773)..(773): n is a, c, t, g, unknown, or other
ctggagctccccgcggtggcggccgctctagaactagtggatcccccgggctgcaggaattcgtctcacccctagaaaaagctcgccctccacttccgccgccgccgcctcgctcctccctcgccgccgcttcctgccctcccgccgaagaagagcaagctcccgagccaccaccatcatgtcggcgttgggcgatgacccgatcagggaatggattcttacagaagggaaggccacgcagataaaagggatcaggtccattggtggtggctgcattaactccgctcagcgctatgataccgacgcgggccccttctttgtgaagaccaacagccgcattggtccagaaatgtttgaaggggaggctcttggtttgaaggcaatgtatgacacaaagtcgatccgtgttccgttgccatacaaggttggttctttacctacaggtggttcttttatcatcatggagtttattgaatttggtcgttcaaggggagaccagtcagatttgggaaggaagcttgctgaaatgcataaggctgctaaatctgataaaggatatggtttcccggttgacaatactattggaagcactccacaaattaacacttggactggatgactggattgagttttactccaagcatagattgggttaaccagttggagttggcatcgagacgatatggagattcggccatactcgaaaaaggtcagcggttgatcaagaatatccgcccactttttgatggagcggttattgagcatgcntgcnntcatggtgatctgtggagcggaacatagctctgatagcaatgggatcctggtatattgggatcctgctgctactgaagtaaaactgactgatttagtatccgaatcaggaatcctggggtagtggttgcaaaaggatgaatttacatgtccccttcagtaattttcaaccgagtattccgggtctaatattc

SEQ ID NO: 81270 - protein, 146 aa, Zea mays
  misc_feature: Ceres CLONE 1566711
  misc_feature (9)..(147): Pfam Name: Fructosamin_kin Pfam Description: Fructosamine kinase
MSALGDDPIREWILTEGKATQIKGIRSIGGGCINSAQRYDTDAGPFFVKTNSRIGPEMFEGEALGLKAMYDTKSIRVPLPYKVGSLPTGGSFIIMEFIEFGRSRGDQSDLGRKLAEMHKAAKSDKGYGFPVDNTIGSTPQINTWTG

SEQ ID NO: 81271 - DNA, 1333 bp, Zea mays
  misc_feature: Ceres CLONE 1566713
  misc_feature: Encodes the peptide sequence at SEQ ID NO. 81272
  misc_feature (328)..(328): n is a, c, t, g, unknown, or other
acacccccgctcccccaacacaaaaacaaacaaaccaaaaaaaaccccactaccacgcaaaccacccaaaaggagctccccgcggtggcggccgctcttaactagtggatcccccgggctgtatgaattcgtctcacccctagaaaaagacgcggtcgccccttcttttttcagctggctggttcacgtgctcaacgactgcgagcgtctgtctaggagcaagatggatgggaacaggatagctcggttttcggtcacctggaggggcagccaacttgatatgtatacagatccaagttgtaccgtgaaagagtttgggcaactgtcncaggacttgactagtgttaggtcagagacgttgaatctgattgttccactatctacaaacaaagggtccaagcttatcatgcccttttcggacgcaacacccctattgaaactgaatggagtgggtattagggaggggatgaccatacccaaaaaagaagtttatgatgatgaaagcgaggagggttttcgaggatggcaaatagacctgaccccaggcattagtagggactttaatgaaaaaataatcagccggtcttagttaaagaatcagtttaaggaggggccactagaattttcacttcaaaagatttcgccccagggaacaaataccgttgccttcctggcagttttcttactggaacatgcggttccgacggtaaacctttgtggataactgctgacacctggaaagttcgattccccgccctattgccattgtaagagacctcacattgacaatatccgagaagtatgtcttaccatggcgcctacttgggatccattttatgcgcagtcatcgcttacggagagccatgtgagacagattttgccgcgtcggtctttttgtatggcgataaagagatcatgtgccattttccgcgattcttggggatccaaaagaggtcctcgcggccaacagcagtcattatgacgcaactttgtgtctgtatatcgtgccaccctctccgcggtgtgtagggggcgctgtgtatattgtaagaggggctgtattacaggcgggcgcgcaaaggtgaaggtaggatctatatatctctaattgaaccttctactatacctaaaagaacactcccagcgtctgcatatcgatagacataaatgtctctctccgtctcttcccccgtctggtatatcactcactattaatatttcttccaagtgcggtatattcttctgggagttaatgtatatcacaccggattgctggggcacgagtacctctccgcgccccttatgtttttttttgtggcccagctagtcgctg

SEQ ID NO: 81272 - protein, 121 aa, Zea mays
  misc_feature: Ceres CLONE 1566713
MDGNRIARFSVTWRGSQLDMYTDPSCTVKEFGQLSQDLTSVRSETLNLIVPLSTNKGSKLIMPFSDATPLLKLNGVGIREGMTIPKKEVYDDESEEGFRGWQIDLTPGISRDFNEKIISRS

SEQ ID NO: 81273 - DNA, 942 bp, Zea mays
  misc_feature: Ceres CLONE 1566714
  misc_feature: Translation starting site: 174
  misc_feature: SWISSPROT Homolog: EC 1.1.1.37 Malate dehydrogenase
  misc_feature (832)..(832): n is a, c, t, g, unknown, or other
  misc_feature (840)..(840): n is a, c, t, g, unknown, or other
  misc_feature (850)..(850): n is a, c, t, g, unknown, or other
  misc_feature (938)..(938): n is a, c, t, g, unknown, or other
ggagctccccgcggtggcggccgctctagaactagtggatcccccgggctgcaggaattcgtctcacccctagaaaaagctatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgcccttgaagcccatgcagctcccaactgcaagggttctggtggttgccaacccagcaaacaccaatgctcttatcttgaaagaatttgctccatctattccagagaagaacgttacttgcctgacccgtctggaccacaacagggctcttggccagatttctgagagacttaatgtccaagttagtgatgtgaagaatgttatcatctggggtaaccactcgtcctctcagtaccctgatgttaacatgccacagtgaagacttccactggggagaaagctgttcgtgagcttgtctctgatgacgagtggcnttatggtngaatcatcancactgtccaacagcgtggtgctgcatcatttaagcgaagaagttctcagtgctctctcggctgctagctctgcttgtgacacacttcntgat

SEQ ID NO: 81274 - DNA, 802 bp, Zea mays
  misc_feature: Ceres CLONE 1566716
  misc_feature: Encodes the peptide sequence at SEQ ID NO. 81275
aaagctggagctccccgcggtggcggccgctctagaactagtggatcccccgggctgcaggaattcgtctcacccctagaaaaagatggtcatcacgccgctgggcgccggcagcgaagtcggccgttcgtgcgtccacatgaccttcaaggggcgtactgtcctcttcgactgcggcatccacccggcgtacaccggcatggcggcgctgccctacttcgacgagatcgatccgtccgccatagacgtcctcctcatcacccactttcacttggaccacgccgcatcgctgccgtacttcctggagaagactacgtttaagggccgtgtgtttatgactcacgccacaaaggctatttacaagctgctgctctcggattatgtcaaagtcagcaaggtgtccgtggaggatatgctgtttgatgagagtgatattgctcgatccatggagaaaatcgaggttatagatttccacccagacgtggaaagtaaatgggatacgcttctggtgctacactgctggccatgtaacttggtgccgctattgtcatggtgggatattggtggcgtggcgcatctttaaactggggactactcccgtgaagaagaccgtcacctacaaggtgctaacctccacaagttttccccaaaaatttgcattaatcgagccccttttagggggataagaaaaataaacccccggattgtacgttaaaaggcccttttcgggggggattttcaaaaacccttttccagggggggcccggtttttatatcccgggatttttccttggggaaaaaa

SEQ ID NO: 81275 - protein, 165 aa, Zea mays
  misc_feature: Ceres CLONE 1566716
  misc_feature (13)..(164): Pfam Name: Lactamase_B Pfam Description: Metallo-beta-lactamase superfamily
  misc_feature: SWISSPROT Homolog: EC 3.1.26.11 Ribonuclease Z
MVITPLGAGSEVGRSCVHMTFKGRTVLFDCGIHPAYTGMAALPYFDEIDPSAIDVLLITHFHLDHAASLPYFLEKTTFKGRVFMTHATKAIYKLLLSDYVKVSKVSVEDMLFDESDIARSMEKIEVIDFHPDVESKWDTLLVLHCWPCNLVPLLSWWDIGGVAHL

SEQ ID NO: 81276 - DNA, 972 bp, Zea mays
  misc_feature: Ceres CLONE 1566717
ctccccgcggtggcggccgctctagaactagtggatcccccgggctgcaggaattcgtctcacccctagaaaaaacggcacggcggacgcgctcgcctctcctctcctctcctctcctctcctcttcttccggctctccctctccgcatgccattccaacgcattaccggtatttttagccgccggaggagacgggtagctgcgtagccactagcgagagagagagggaggggagaaaccatagctcctggccgttctgcctgcccatccaccgcggcgccggccgtccgtctcccgtccacatccctcctcctctcctgcaaggttcctgtgcggtatggtatgctacctcggctccctgtggattcccccctcatccggaatgtgatggcgccccggatggtgttttgatctgtgttcgcttttggcggatctggtcgcgcgcagtagcgcagaggggtcggagtcggagtccgagtcggagaagatgatgggcgggttcctctccagggtcctcctgttggcttttgggctatgcctatcctgcctacgaatgctacaagactgttgaactgaacaaacccgagattgcgcagcccatattttgggtggcagtattgggattttagtttgcccggttgacagtttttggaaaaaattcggaaatttcctcaatatcatggctaccgtttctatccggaaagacaagccgaagtttctttgtaataattggggggccccctagaaaaaaggggactacctttggtttttggaaactttccttaaacccatatttttccctcgcctggagaaggaaatcgacgcgataccccctggagctggaagctctcagcccccaacccggtgttcttttatattctaaaaggtgccttcaccacgaccaagtacgtccttgtagagttataaaaagagtgctctcccccctcctgtccctagatttaagagaaccct

SEQ ID NO: 81277 - DNA, 819 bp, Zea mays
  misc_feature: Ceres CLONE 1566718
  misc_feature: Encodes the peptide sequence at SEQ ID NO. 81278
  misc_feature (430)..(430): n is a, c, t, g, unknown, or other
gcggtggcggccgctctagaactagtggatcccccgggctgcaggaattcgtctcacccctagaaaaaacgccaagcagaagcgaggacactacacagcgcgcgactgacatgtcgatgctcaccagcatactgggccgcaagcatcagccgccgccgccgcagcagcagcagaagggcggcggcgcgcgcactggcaccggcgccggcacggaggcggcggcagtggagccggtgagcatcgacatcgcggagcaggggccgctagtggacggcgccatcacgctggcggcgttcgcggcgccggcgctaggcctgccgccgttcgcgacggccagcatggactggaaggagacgccgacggcgcacgtgttcatggccgacctccccgggctgcgccgcgacgagggaaaggtggaggtggaaagaangaaaaggctgctccggatcagcgggcagcggcagcgcgccgccgaggagaagggcgaccgctggcaccgcgtcgagcgcagctccgaccgcttcgtgcgcaccgtgcgcctcccgcccaacgccaacaccgacggcgcgcaggccgcgctccaggacggcgtgctcaccgtcaccgtgcccaaggacaacgactgcaaggcctacggcaggctcatcaccatcaccaattaattagtattaatcatatatatattatgtgcatataatgtaagccgcatgtgtatcgttatcatcaccgaataaaaaatgattatggcaaaaaaaaaaaaataaaaaaaaaaaaaaagctcgaacacaaacccagttcgctcgtcccagctgatcaggt

SEQ ID NO: 81278 - protein, 183 aa, Zea mays
  misc_feature: Ceres CLONE 1566718
  misc_feature (78)..(182): Pfam Name: HSP20 Pfam Description: Hsp20/alpha crystallin family
  misc_feature (107)..(107): Xaa is any aa, unknown, or other
MSMLTSILGRKHQPPPPQQQQKGGGARTGTGAGTEAAAVEPVSIDIAEQGPLVDGAITLAAFAAPALGLPPFATASMDWKETPTAHVFMADLPGLRRDEGKVEVERXKRLLRISGQRQRAAEEKGDRWHRVERSSDRFVRTVRLPPNANTDGAQAALQDGVLTVTVPKDNDCKAYGRLITITN

SEQ ID NO: 81279 - DNA, 936 bp, Zea mays
  misc_feature: Ceres CLONE 1566720
  misc_feature: Encodes the peptide sequence at SEQ ID NO. 81280
ctggagctccccgcggtggcggccgctctagaactagtggatcccccgggctgcaggaattcgtctcacccctagaaaaaaagcgacgataagcgttcagaaagccatcgtccttacagacgagacacgagaggcagcgagccagcgaccggcaacagttttctcggaaggcagcctcttcctcgtcgccgccgacgtcacccgccgcggctgtcggggatgccggtcagggtggtcgataccgccacgccttcctcgcagccctccccagggcaagaagcaaatactggacacccatctcctcctagatgttcactcttaagtgctggaagatcttttgctggaactcagaatgtttcaagtctgcagaaggatgaagcatggaaagtgaatgtccgcatccatggttgtgatcttgaacagggttatctatgtggaacgatggaagcgcttaatgttccattagcagatacacctgtagtgacattctgggagggggagatagtggatgctaaaaattacacctttttcactggcaagtgggaggcatcgccagaggatgatataagacattggtccaagttcccatcatttatgcctcttctgagtcagattgagacagacggtggcaagtctctggactttagcaactatccttacatatatatgagatggaaagaacagtattttgtcaatgttggagttgactgtgggttaaccatcgctggtttctactacgtctgctttttctgtagtgatggctccattagtggattttattatgatccaaatagcagtccgtttcagaagctcgaaattgagtgtaccaatgagaaaaatctgggatcacccttttcatcttatgagctgcagtgacagggccaatgccctcgacagacaacttctgttcgcatatagtgtgtactgaactcatcc

SEQ ID NO: 81280 - protein, 218 aa, Zea mays
  misc_feature: Ceres CLONE 1566720
MPVRVVDTATPSSQPSPGQEANTGHPSPPRCSLLSAGRSFAGTQNVSSLQKDEAWKVNVRIHGCDLEQGYLCGTMEALNVPLADTPVVTFWEGEIVDAKNYTFFTGKWEASPEDDIRHWSKFPSFMPLLSQIETDGGKSLDFSNYPYIYMRWKEQYFVNVGVDCGLTIAGFYYVCFFCSDGSISGFYYDPNSSPFQKLEIECTNEKNLGSPFSSYELQ

SEQ ID NO: 81281 - DNA, 899 bp, Zea mays
  misc_feature: Ceres CLONE 1566721
  misc_feature: Encodes the peptide sequence at SEQ ID NO. 81282
  misc_feature (899)..(899): n is a, c, t, g, unknown, or other
ggagctccccgcggtggcggccgctctagaactagtggatcccccgggctgcaggaattcgtctcacccctagaaaaaaacttcaccctactcttctcggacctcctcatgcggcggaggtagaggtgcacgcgcccctcatcgctcgtcggaccgtcttggatccttccttgaccctactcatctcagattccggccagatggaacgccgcgagggatccggattcaatggggcacagatgacgaagcggcggaacagcggctcgacgcggcccaagccggagggcggccctgccgcggtggagcgggacaacggctcccctctgccgctgtcggtgacactccagaagaccccccaggagtctgctgttgacttcggacgagaacgccgctggacctcgacggaggcaaccgtaagcatgagttcctcctgaacgctccatctgcggagcgcgcgaccgaggggagcatccggctgcgttgccaggccgcagccggtggattcaggactagccaccgtagcagccatgtccctcagggggaaccctcagaagcttgtggaaggtgaacttcaaaatgcttaaagtgcgaccaaaaacccaaccctggaaaggcggcctgtgaaacccccctcggcctgtaaaatcggcggcaccaaacaaaaacatggcctctcctgaatgaagggcacaaaaagattccggaacgggccaacccctcttcccaaagaataacaaaacgcccgaaaagggaggttggtgcaatttaaaaaaaaaacatttgggcgccttttgtcaaaggcagggacaaatttttccaaagagaaaaaacccgaccttcttagaacccctggtaacctgaaaaaaacaaagggaggcccttccctctagaaaaacacn

SEQ ID NO: 81282 - protein, 77 aa, Zea mays
  misc_feature: Ceres CLONE 1566721
MERREGSGFNGAQMTKRRNSGSTRPKPEGGPAAVERDNGSPLPLSVTLQKTPQESAVDFGRERRWTSTEATVSMSSS

SEQ ID NO: 81283 - DNA, 859 bp, Zea mays
  misc_feature: Ceres CLONE 1566725
  misc_feature: Encodes the peptide sequence at SEQ ID NO. 81284
acccgcggtggcggccgctctagaactagtggatcccccgggctgcaggaattcgtctcacccctagaaaactcccatcgccagggcgtcggatcggagcgagctcattctcaactcgactcaagagctctgcctcctccatcttcccttctctgtaatatctctctctctctctctctctctctctctctctctctctctctctctctctctgtacgaatagctgtagctcaaattgatcctcttgcttggggctttatatgctacaaccaatggagcaactgaagtgaaccaaagagtaaaagcttctaagacgagctaacgtttccagttctggacgttgagggcctccggggccacgctgagagatggaggcgaatccgaacaacaccttcactatcaaagtggaggacgggaagcccgggaaggacggccggctggcggtcggaccggtggtccggagcgttctgggccaggatgggttcccgcagcttgagcctaaaatgaagaactcatgggacgtgttcagggtagcaaccagtaagtatgccgacaacccgatcctcggaaggcgtccgttcaaaaatggaagtgccggggcccttcttggggaaattcatccaggggaattttccaacagggtcttccaagaaggctttccttttaaaaagttgggaagtgccacccagtttcccgggggggggatttacgggaggaaactgtctcctcatgggaaagtgggaaatgcagctttgcaaagggctaaaagccaaaatctgggccccccgtggaagaaaaattttggggcggggaagagttgttaaatacaatctcggttatgtgccgaaataaaaatttg

SEQ ID NO: 81284 - protein, 151 aa, Zea mays
  misc_feature: Ceres CLONE 1566725
MEANPNNTFTIKVEDGKPGKDGRLAVGPVVRSVLGQDGFPQLEPKMKNSWDVFRVATSKYADNPILGRRPFKNGSAGALLGEIHPGEFSNRVFQEGFPFKKLGSATQFPGGGIYGRKLSPHGKVGNAALQRAKSQNLGPPWKKNFGAGKSC

SEQ ID NO: 81285 - DNA, 817 bp, Zea mays
  misc_feature: Ceres CLONE 1566727
  misc_feature: Encodes the peptide sequence at SEQ ID NO. 81286
  misc_feature (500)..(500): n is a, c, t, g, unknown, or other
ccccgcggtggcggccgctctagaactagtggatcccccgggctgcaggaattcgtctcacccctagaaaaaaccacccccatcctctctaacccacggaagcaaggcaaaaagcccgtgctggacgacatctcccctgtcgatccacgaccatgatgcagcagctccgtcacaaccagccgagcccgtgcctctgcggcctgcgggcggcacggcctatgctcgcgctcggcgcagcagcatcccgttcgcggcccgccggaaaactgcaaccgagcgcctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtggccgatcccgacgggcgcggggtgaaggcngaggcgtctgtgctagacgccgtcgtgggcagcgggaacagcgagctcgacgtggacctgatctgggacgaagcgctgggcgccccctgcgcggtggatgtgaaaaacactccgacttccccgtgtccctgaggctgctaaacgtgccggccggggtcggggggctcaaaaataagccggcgcccttcaattcgctggaaaggatggggtgacccccttaaaaagacccggtccgcccgtttttacaaaaaaccggggggttgggaaaaaacccgaagccccctcttaattacggggggacaaactcgggccccccc

SEQ ID NO: 81286 - protein, 159 aa, Zea mays
  misc_feature: Ceres CLONE 1566727
  misc_feature: SWISSPROT Homolog: EC 1.13.11.12 Lipoxygenase
MMQQLRHNQPSPCLCGLRAARPMLALGAAASRSRPAGKLQPSACLGLGHVAPAAARGQPRPRAVADSALGASPTSVHVGGKLLLQNFAADSQQRLKLSIQLVSATVADPDGRGVKAEASVLDAVVGSGNSELDVDLIWDEALGAPCAVDVKNTPTSPCP

SEQ ID NO: 81287 - DNA, 709 bp, Zea mays
  misc_feature: Ceres CLONE 1566729
  misc_feature (326)..(326): n is a, c, t, g, unknown, or other
  misc_feature (340)..(340): n is a, c, t, g, unknown, or other
  misc_feature (351)..(351): n is a, c, t, g, unknown, or other
  misc_feature (352)..(352): n is a, c, t, g, unknown, or other
tccccgcggtggcggccgctctagaactagtggatcccccgggctgcaggaattcgtctcaccccctagaaaaaagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagaagnccgccccttcaggnccggggcgtcnnagaaagctcgcccgccggcgggttcggcggtcaccctttcgggaaccccaaaaggaagaaatgtttccctgatgaatttggacccccaaggggccaagatggagtacattggcccgcctatggagcttgtgaaccctgggaaaagcgggggctcttgattccggaaattccttacaaaacaaaaaatctggtgggggagggaaaccaaatgcgccttgttttccccggggggaaaaccaaaatggggcggtggggggtttttttttgggggggaaatcccggtttttcttttaaaaaggggggtgtttaaaaaacctgtttttcaaaaaaatgtgggggggggggaacttctttgaa

SEQ ID NO: 81288 - DNA, 872 bp, Zea mays
  misc_feature: Ceres CLONE 1566735
  misc_feature (293)..(293): n is a, c, t, g, unknown, or other
  misc_feature (294)..(294): n is a, c, t, g, unknown, or other
  misc_feature (824)..(824): n is a, c, t, g, unknown, or other
  misc_feature (825)..(825): n is a, c, t, g, unknown, or other
  misc_feature (827)..(827): n is a, c, t, g, unknown, or other
ctggagctccccgcggtggcggccgctctagaactagtggatcccccgggctgcaggaattcgtctcacccctagaaaaagtcagtgccagcgccagcggagaaaagaaacagagttcgaccggccccgccccgccccccaccgcagcgcccgcgaagccgccaaacaccaccacctatccgccagaagcctcttcctccctcgctctccctcagcggcgcgctgccaatggccgcgtggtgaagcgcacccgacggaagaagcaggcaccaacacccaagccccctgtgccnnttcgccgtcgcctgccccgcgcaagaatgaagatccccggaattcagaacagggggctacccatttcgaatttgaatttgggccgggggaaaccactttttcccttaggggggcgccctttcaatttgggggggccctcttctccccttttttttttcaaggggggtaaaaccgggggggccccggggggggctcttcttctaaaaaaaaaaaacccccctttgtggtgggggaggaccccccccccaaaaaaaaaaaccccgggggaggattctcccccccgggggttttttttttgtgggggaaaaaaaacaagggggggggggggccccccccccccctcccccattataaattccccccccccgggggggggggggggggggagaaaaaaaaaaaaaaaaaacaccccccccccccccccccccgcggggggggtgtggggcgccccccccaaaaaaaaaaaaaaaaaaaaaagaagagggggggggggggaggaaaaaaagaacacccaccccccccccgcctgnntntttggggtggggggtgggggggagccagaaggaacacaccaccaa

SEQ ID NO: 81289 - DNA, 952 bp, Zea mays
  misc_feature: Ceres CLONE 1566737
  misc_feature: Encodes the peptide sequence at SEQ ID NO. 81290
  misc_feature (685)..(685): n is a, c, t, g, unknown, or other
  misc_feature (800)..(800): n is a, c, t, g, unknown, or other
  misc_feature (835)..(835): n is a, c, t, g, unknown, or other
  misc_feature (931)..(931): n is a, c, t, g, unknown, or other
  misc_feature (934)..(934): n is a, c, t, g, unknown, or other
ctccccgcggtggcggccgctctagaactagtggatcccccgggctgcaggaattcgtctcacccctagaaaaaagcccagcgttctccctctctcgtgggcgtggcgacgacttggaggccatcgctgccgccctacgccaggtgcccagatcatctgcggcccattcgccggcgacgaccaccatccatcagaaatagggtcaagcgcttgaacttacagcgagatggaaaatgatagaaggcaacttggtcagatcgatccaagaagagcccgctttccttgctgcgtagtatggactccaataccattcatcacttggttggtgccctttatcggtcacattggcatctgcagagaagacggtgtaattctggacttctctggtccacattttgtatcagttgacaattttgcattcggagctgttgcgcgctacattcaagtaaactgcgatgagtgctataagcttattgaacctgaaggagatgccacgtgggacggcgcgctgaagaaaggcacgcaggagttccaaaacaggaactacaacctgttcacctgcaactgccactcctttgtcgcaaacaatctgaacaggctgttttattccggccacgacgaatggaatgtggtcagcttggctgctgtgatgttcttacgaggccgctgggtgagcacggcatcngtggtgaagaccttatttgcatttgcagttgtgctttccatcggtaccttccttggcggcacgaccttccctgacggcctttctgctttcgccgctgcgatgactgtctggtccnttgtgggcacctactgcatcaagagtctcataagntgtggatagagtatgttagactcgtttgtagggggtcaagggtgggcatatttttaagagtcaagcgtggcacattttttatttgtattgcatccntgnataatgggaatcctgatg

SEQ ID NO: 81290 - protein, 205 aa, Zea mays
  misc_feature: Ceres CLONE 1566737
  misc_feature (10)..(177): Pfam Name: DUF778 Pfam Description: Protein of unknown function (DUF778)
  misc_feature (192)..(192): Xaa is any aa, unknown, or other
  misc_feature (203)..(203): Xaa is any aa, unknown, or other
MENDRRQLGQIDPRRARFPCCVVWTPIPFITWLVPFIGHIGICREDGVILDFSGPHFVSVDNFAFGAVARYIQVNCDECYKLIEPEGDATWDGALKKGTQEFQNRNYNLFTCNCHSFVANNLNRLFYSGHDEWNVVSLAAVMFLRGRWVSTASVVKTLFAFAVVLSIGTFLGGTTFPDGLSAFAAAMTVWSXVGTYCIKSLIXCG

SEQ ID NO: 81291 - DNA, 913 bp, Zea mays
  misc_feature: Ceres CLONE 1566740
  misc_feature: Encodes the peptide sequence at SEQ ID NO. 81292
ctccccgcggtggcggccgctctttactagtggatcccccgggctgcaggatttcgtctcacccctagaaaaaatcgtcaccccggagcctctccttcccggtctcctccgcccgttgccttcgtcccctccatctccggctgcgtcgccggcgagcccgacaccgcgaatcggatccgccgacaaggtaagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacgcagggtctcatctttgttgtggacagcaatgatagggaccgtgttgttgaagcaagggatgagctccaccgaatgctgaatgaggatgagttacgtgatgctgtgttgcttgtttttgctaacaagcaagatctttccaatgctatgattgccgctgagatcactgataagcttggactgcattcacttcggcaacgtcattggtacattcaagcacttgtgctaccacgggtgaggtattgtatgaaggcctggactggctgtcagcaaatggcaacaagtcctaaatgtcagcgagggttgatcacctagagcttttgatgatgagatgagatgtgcggaatttaggggtggggttggattccctatgaaaaatatgccctcaaccgggatttttgactcgcttagatcccccgtaaatggttttgaattggggcctaaaatttcgaacaaacga

SEQ ID NO: 81292 - protein, 188 aa, Zea mays
  misc_feature: Ceres CLONE 1566740
  misc_feature (5)..(166): Pfam Name: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLSNAMIAAEITDKLGLHSLRQRHWYIQALVLPRVRYCMKAWTGCQQMATSPKCQRGLIT

SEQ ID NO: 81293 - DNA, 876 bp, Zea mays
  misc_feature: Ceres CLONE 1566743
gcggtggcggccgctctagaactagtggatcccccgggctgcaggaattcgtctcacccctagaaaaaatctctcgcactccttccgtacaaatttaatccttagcttaccaggcctgtgtacacgacacacgcggatgcgtcacacgagactgagggtactgaccatccccgtcgcctgctgcaccgagaatggcggggatggacgtgcatatacccgcaccaccgccccatcgtcgtgggggctgcgccggcttcggctgtggcggtgccttcttgctgttgctctcccaattccgcctccgcgcatggcactccatcagttacctgctgctctcttccagttcctccacgagctcgtgccgcccagcgctgggctccagctcggacagcggcacccctgcgatccgcgcggtcgagacagaccggatcaagatgagaacagcactacctggagtcggctctcctcgtttctggatgtgcggataattctcttaccaactgcgtgatggtgctcccggtaagattttccgcaatcaaatttatccgcaaaagcagaagggcatttgtctgaatgatgggagttctgataaggtcccccaagcccaaccccaactaagagggtttttggggggcatttcctgggtccatttaaccggaccttggttcccaccttttttttttaaaaaggggaattttttacccctgtggaaaaaaagcccctccaatttttccccaggagatctttccctgaaaaaaaaggctaccccccttttgggaggtttacagtaacacacccttttttaagggttttttcgcgggaggggtttctcccctctcaaaaggggccaaaagggcttttttggccctcaaaaac

SEQ ID NO: 81294 - DNA, 836 bp, Zea mays
  misc_feature: Ceres CLONE 1566750
  misc_feature: Encodes the peptide sequence at SEQ ID NO. 81295
ccccgcggtggcggccgctctagaactagtggatcccccgggctgcaggaattcgtctcacccctagaaaaaatccacagcctctttctccactggacgagaactgtcccagcagaaaccagaagcaccaactgcaaacatcagagaagagaagagtaggggggaaattactactctacgactcgtgcgcccactcctccactgttcttgggaatctcgggggagaagaggaagagagcagtgggtctcagcgcaccactcattcctggctccatggcttcctgacgtcctctcctgtcgatccaaggacaccgggggtttcttggaaacaagttcttggattggtccgccaccagcccaccaccaggcaccatgtcggtctcgccctcgtccctgtgcggcggggacccggcgatgaggatcgtggtgtggttccggagggacctcagggtggaggacaacccggcgctcgcggcagcggcgcgtgccggtggggaggtggtgccggcgtacgtctggtcgccagaggaggagggcccttactaccccggccgcgtatcccggtggtggatcagccagagcctgaaccacctggacgcctcgctccgccgccttggggcgggaaagcttgtcacgcggaggtcggccgacgccgccgtcgcgctgctccagctggtccgcgacacacgggccacgcacgtctacttcaatcatctatacgacccgatctcactggtcagggaccgccagttgaaggagatgctagcggctgaaggcatcgttgtgcaatctttcatttcagatctgctgtacgagccatgcgcagctgtcgatga

SEQ ID NO: 81295 - protein, 154 aa, Zea mays
  misc_feature: Ceres CLONE 1566750
  misc_feature (15)..(154): Pfam Name: DNA_photolyase Pfam Description: DNA photolyase
  misc_feature: SWISSPROT Homolog: EC 4.1.99.3 Deoxyribodipyrimidine photo-lyase
MSVSPSSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTRATHVYFNHLYDPISLVRDRQLKEMLAAEGIVVQSFISDLLYEPCAAVD

SEQ ID NO: 81296 - DNA, 814 bp, Zea mays
  misc_feature: Ceres CLONE 1566751
  misc_feature: Translation starting site: 143
  misc_feature: Pfam Name: ResB Pfam Description: ResB-like family
  misc_feature (645)..(645): n is a, c, t, g, unknown, or other
gcggtggcggccgctctagaactagtggatcccccgggctgcaggaattcgtctcacccctagaaaaagccgctcgcgcgcgacgccgcatcactccctcgccactcgcgcgcccgggctccttcccgccacgctcacgacgatgccgtccccgacgtcctatcttctcctgaatccctccaaaccctcctccttccgccgactctcggccccgcgcctgagccggttccatgtctcctgcgacgcgccacggggcggcgggaggcgcgaggtcatccccgccggtgccagcaaggccaagaaacagatcgtattcttcgacgccgccccgccggtgtcccaggagggtggaggcgccgtgaagaaggcggggagcgagaagcttacccaggtgggcagcggcaacgcagcgctggcgttgttgaggagggcaaccaagaggacactctcggtgctgtccaacctcccgctcgctatctccgagatgttcgccattgccgccctcatggctctaggaacggtgattgaccagggagaggcacccagctactacttcgagaagttcccgaggacaacccggtcttcggcttcatcacgtggaaggtggatcctcacccccggggttcgaccacatgttctcctcgncagtcttcctcgggcctcttgcgctcctcgcgacgtccctcatggcttgcacctacacgacccagctcccatgggtcaaggtcgcaagaggatggtcgttccccccttccggaaaagaatacgggaagccggaatttgcggactcgcttccccaggattcatttagggg

SEQ ID NO: 81297 - DNA, 843 bp, Zea mays
  misc_feature: Ceres CLONE 1566752
  misc_feature: Translation starting site: 203
  misc_feature: SWISSPROT Homolog: EC 3.2.1.21 Beta-glucosidase
  misc_feature (694)..(694): n is a, c, t, g, unknown, or other
  misc_feature (843)..(843): n is a, c, t, g, unknown, or other
ctccccgcggtggcggccgctctagaactagtggatcccccgggctgcaggaattcgtctcacccctagaaaaagcaagactcaatacacaagcagagctcaaacaattcttgcttcccgctagctagctcgcaagaaataagggctccacttcttcttgcttctcgcacagcctgtcatcctggccttacaagcagccgccatgataatggccggcacggcctttcttcttcaccgggaagtagtagtaagcgaagccgtagccttaacttcataccacgagctgaaaagacaacgacaggcggtgagggtcatgttgtgagcgaaaagctgagcccctggcaaatccccaggagggagtggttcccccctagctttatctttggtgccgccacttcagcataccaaattgaatgcgcttgcaacgaatgtggcaaggggccaagcacttgggacgacttctgccacaaatatccggagtggatagcggacgggaacactggggatgttggagcgaactcctactacctgtatagagaggatgtcagattgctgaacgagatgggtatggacgcctacaggttctctatcgcttggtccagaatactgccgaatgcgacgctcgaaggaggcattaaccataaacgcgtcgagtactacaaaaggctcatcaacttgttgaaaagagactgcntaggaccatatgtgacacttttccactgggacacacctcaagcacttgtggacagctaacggtggcttcttagatgacaagcatggtaaaagattacacgacttttggcaaggtggtgctttgtgccccttcggggacatctatgaaan

SEQ ID NO: 81298 - DNA, 839 bp, Zea mays
  misc_feature: Ceres CLONE 1566753
  misc_feature: Encodes the peptide sequence at SEQ ID NO. 81299
  misc_feature (613)..(613): n is a, c, t, g, unknown, or other
ggagctccccgcggtggcggccgctctagaactagtggatcccccgggctgcaggaattcgtctcacccctagaaaaaacactacacagctcagctcagcccagcctccctttcccttgaagcctctccaccaacccaaagtcacagagacagagaggaccaaggcaggcagccgtcagcgagccagctagccagccatgggcaaggactgcggcaaccacggggacgatgacttccggcagtcatgccggcgcctgctggccatcctgctgaccatggcgctgctggtgggcgtcgtggcgctgatcgtgtacctggtgctccgccccacgcacccgcgcttctacctgcaggacgcggcgctgcggcagctggacctgagcaacggctcggccccgctgctgtccacggcggcgcaggtcaccgtggcgtcccgcaaccccaacggccgcgtcggcgtctactacgaccgcctcgacgtctacgccacgtacaagtaccagcaggtgacgctggcgtccaggctgcccgcggtgtaccagggccacggcgacgtcgacgtctggtcgcccgtgctggccggcccccgccgtcccttcgcgcccttcctcgncgacgcgctcgccaaggaccctcgcgcggggtacctcgtcctgcagctcaggatcgacgggagggtccgctggaaagtcggcaagctggttggtcggccaactacacatggttcgtcacctgcccgggcttacttcatcagctccgggggcgggttccggctaacccggggcctgtcggcgcgcaccgggctcaggttccagaaccccacgtactgccggggttct

SEQ ID NO: 81299 - protein, 214 aa, Zea mays
  misc_feature: Ceres CLONE 1566753
  misc_feature (39)..(179): Pfam Name: Hin1 Pfam Description: Harpin-induced protein 1 (Hin1)
  misc_feature (139)..(139): Xaa is any aa, unknown, or other
MGKDCGNHGDDDFRQSCRRLLAILLTMALLVGVVALIVYLVLRPTHPRFYLQDAALRQLDLSNGSAPLLSTAAQVTVASRNPNGRVGVYYDRLDVYATYKYQQVTLASRLPAVYQGHGDVDVWSPVLAGPRRPFAPFLXDALAKDPRAGYLVLQLRIDGRVRWKVGKLVGRPTTHGSSPARAYFISSGGGFRLTRGLSARTGLRFQNPTYCRGS

SEQ ID NO: 81300 - DNA, 788 bp, Zea mays
  misc_feature: Ceres CLONE 1566754
tccccgcggtggcggccgctctagaactagtggatcccccgggctgcaggaattcgtctcacccctagaaaaaaaattttttgatgcactattagtagtagtgccgctgcccgctggtgctgggagctcatcatcattcgtcggtagcaggaaggaggcggcgtggaaggggaggcagatgcgggaggcccaccgcagggtcgtcgcaccagatggacacgccggataggccccgcgccgccgccgccgccgggttcgaggattctcctgtcttcaatttcatcaacaatctctcgcctataccaccacctaaacctttagactcagcacataatgtgcagctattcaagtcatcagacttggcacctgtttcttcgatctttgcctcaccacatgttaatccagtgaaggaaactaaagttttgatcagggatgaatctgttcaccttcctcaagaattgcactcgcctagcagtgtcaggactcgaatagacacctcaggctcttttagaatgatcagatgcaaagacattgtgtcggacaattgcaatatcctttgtcaactaaaccaggcatccattgattctttccgagccaaccttaaaattttacggggccaattgaactccaatcccttaaccggaaagctttcctggcccttttttgggaaaaggccccatagggggttcaaaaggggggaattgccccaaaaaaaaaaaaaggaacctcttttccccgatttttccccccccggagaagttggcccccaggggggcccttaataaaag

SEQ ID NO: 81301 - DNA, 928 bp, Zea mays
  misc_feature: Ceres CLONE 1566756
  misc_feature: Encodes the peptide sequence at SEQ ID NO. 81302
  misc_feature (589)..(589): n is a, c, t, g, unknown, or other
  misc_feature (595)..(595): n is a, c, t, g, unknown, or other
ctggagctccccgcggtggcggccgctctagaactagtggatcccccgggctgcaggaattcgtctcacccctagaaaaagccgcggggctccagcttcaaccacaccgacttctactccatggtcggccgcagctccaacttcgccgccggggacgcgttcggcctgcgcacgggcgccacgcccaggccgtccaactacgaggaggacccgcagggcaaggcgaacaagtacggccagtacccggcgcccaacccggccatggcggcgcagcccgccaagggcctcaagaaggcggccaatgggcaggccaagggcgaggacggcaaggacctacacatgttcgtgtggagctccagcgcgtcgcccgtgtccgacgtgttcggcaatggcgccgccgagtacaacgacgcggccgccgtcaaggaggtccgcatggccgtcgcctccccgcgcaaagttgcggcggacgtggaggaaggagcggggcgaggacttcgcggagcgggacgacttcagcttcgggaacaggggcgcggcggagagggacgcggaagccggcgactagaaggcggcggcggcggctgcngctgcncatggggaatgcatgcgcctgtggcggcgcccgcggcgatgccaccgacgagcgtgatgacgcggctgatcctcatcatggtgtggcgcatactcatccgtaacccatacactactccagcctcatcggcctcatctggtcgctcgtctgcttcaagtggaaactcgagatgcggcgatcatcctcagtccatctcgatcctctccaacgcgggctcgggcatggccatgttcagcccccgcgtgtcatggcgctgagcaccggatataccgggcgggaaaaagtggcccgttcgccatggccgtgcggtccctgaccggcccggctcatggt

SEQ ID NO: 81302 - protein, 243 aa, Zea mays
  misc_feature: Ceres CLONE 1566756
  misc_feature (157)..(157): Xaa is any aa, unknown, or other
  misc_feature (159)..(159): Xaa is any aa, unknown, or other
MVGRSSNFAAGDAFGLRTGATPRPSNYEEDPQGKANKYGQYPAPNPAMAAQPAKGLKKAANGQAKGEDGKDLHMFVWSSSASPVSDVFGNGAAEYNDAAAVKEVRMAVASPRKVAADVEEGAGRGLRGAGRLQLREQGRGGEGRGSRRLEGGGGGCXCXWGMHAPVAAPAAMPPTSVMTRLILIMVWRILIRNPYTTPASSASSGRSSASSGNSRCGDHPQSISILSNAGSGMAMFSPRVSWR

SEQ ID NO: 81303 - DNA, 860 bp, Zea mays
  misc_feature: Ceres CLONE 1566757
  misc_feature: Encodes the peptide sequence at SEQ ID NO. 81304
  misc_feature (622)..(622): n is a, c, t, g, unknown, or other
ctcaccgcggtggcggccgctctagaactagtggatcccccgggctgcaggaattcgtctcacccctagaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagactcctcgagagtactggtggtgcaccgagcgctgcctcgactggggcgaggcggggcggcccgacctcatcgtcgacgacggcggcgacgccacgctgctcatccacgagggtgtcagggccgaggagtattacnagaaaaacggcaagatccccgacccggaattcaacgaacaacccttaagttcaagaatcggggttcaccatcatcccgggaaagggttcaagggttaacccaaaaaagtacccccaagatataaaggaaaaggctttgttccgccttttcttgaaggaaaacccccacggggggttcaagaaaggttctctccccaaatgcccgggaaaaccgggggccctcttctcttttttctctt

SEQ ID NO: 81304 - protein, 189 aa, Zea mays
  misc_feature: Ceres CLONE 1566757
  misc_feature (12)..(188): Pfam Name: AdoHcyase Pfam Description: S-adenosyl-L-homocysteine hydrolase
  misc_feature: SWISSPROT Homolog: EC 3.3.1.1 Adenosylhomocysteinase
  misc_feature (158)..(158): Xaa is any aa, unknown, or other
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETPREYWWCTERCLDWGEAGRPDLIVDDGGDATLLIHEGVRAEEYYXKNGKIPDPEFNEQPLSSRIGVHHHPGKGFKG

SEQ ID NO: 81305 - DNA, 983 bp, Zea mays
  misc_feature: Ceres CLONE 1566760
  misc_feature: Encodes the peptide sequence at SEQ ID NO. 81306
aaagctggagctccccgcggtggcggccgctttcgaactagtggatcccccgggctgcttgcaattcgtctcacccctagaaaaaatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaagtttgctggattcaagaaagatgacaagcagtttggatgctgatacccaccgcatgtacatcctatggtggccatgttgctgacctcatgaagaaccttgcttgaagagggagccgaaaaaattcccgaagccactttcagtggcgtactttaagaaagggagttgaaggcttaagaaaattgaaacccctgttacaaaaaggttcatggcttgccatccctgggctaatatcttctggttgttgaaagcaaacctaggcccgccccccaaaagtggcctttaataggtgaccaacgccacagaagtc

SEQ ID NO: 81306 - protein, 192 aa, Zea mays
  misc_feature: Ceres CLONE 1566760
  misc_feature (27)..(173): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKKFAGFKKDDKQFGC

SEQ ID NO: 81307 - DNA, 1030 bp, Zea mays
  misc_feature: Ceres CLONE 1566762
  misc_feature: Encodes the peptide sequence at SEQ ID NO. 81308
  misc_feature (1030)..(1030): n is a, c, t, g, unknown, or other
acccgcggtggcggccgctctagaactagtggatcccccgggctgcaggaattcgtctcacccctagaaaaactttacctccttgtcagctgctcgcacttgcagcgtcccgttcccgcacttctcttccttctcgtttcgtcctgcacagcgcacgcaactgccaccggccaccgcgcaaactccattgcgcgcagatcaagaccgccacacccaccaccagcgcttcagcgggagacgtgacgactgactagacgaaacctctccccacggcgcctccccctccacatgggctgggctcgccttgcctcccgctcccgtctgcgccccgcggcctccgccgcccgccgatcccgaggggggggacacctggctccggctccgccttcttttccccccccccacacccagggaccctgcgggcaccttgggggcaaacgtatcggggtttccttcttggtttcccgggaacccgtttttttcaaagcccccgccctcctggctggggaccggccggggatgcctctggggccccgctggtccccaaaggggcggagaaaaaaaagggtccctttgggggaaggcgggtctttacccgcggggcgagcgaagctctaaggggggggagaattgtgaaacgcgcggatggaagtgcacaccctccggcccaaaaaagttgggagaaggaggggaggcacgatacatttacgcggggtgtggcggcggggggtgcccgcggcggcgagggtggccgaatcttcgtataaagaatacagcgacgccccttcttcggaggacgatggctttgaggcggccgcccgcgtgtgcgggccgtgtcccggttgctggagaaggagggagaaagagcgggcggttttttctggtcgtctcgcacgccaagcacggatggcgggagagaacgtcacgcggggcttgcgcgcgaagccgccccctttatccccggcgccactggggatcgcccacttctcctgcggggcgtggaaaagtgccaccggggtaaggagtgagn

SEQ ID NO: 81308 - protein, 128 aa, Zea mays
  misc_feature: Ceres CLONE 1566762
MEVHTLRPKKVGRRRGGTIHLRGVWRRGVPAAARVAESSYKEYSDAPSSEDDGFEAAARVCGPCPGCWRRREKERAVFSGRLARQARMAGENVTRGLRAKPPPLSPAPLGIAHFSCGAWKSATGVRSE

SEQ ID NO: 81309 - DNA, 868 bp, Zea mays
  misc_feature: Ceres CLONE 1566765
  misc_feature: Encodes the peptide sequence at SEQ ID NO. 81310
  misc_feature (789)..(789): n is a, c, t, g, unknown, or other
  misc_feature (791)..(791): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (802)..(802): n is a, c, t, g, unknown, or other
  misc_feature (803)..(803): n is a, c, t, g, unknown, or other
ccccgcggtggcggccgctctagaactagtggatcccccgggctgcaggaattcgtctcacccctagaaaaaagcctccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgtggcagctgcccctgctgctggcggcgctcctgcagctgaggcgaagaaagaagagaaggtggaggagaaggaagaaagtgatgacgacatgggcttcagcctcttcgactaagcctgtgcaatagtcaagagtattgtttttgagtcgcggaagcagagggaagaaaatcgtagtcatggttggactttaactttgttttatgtgggaaagtactttgaagacttttccctgtggaattcctaggcctaggttgcctggcctggttgggggttaactggtgaacccaaatttttccattctccccccaatgattgggttacccccagttacctgggaggttccccatttttgttgggaacctggccaattttgccccaaaaaaaaaaaaaaaaaaananannnnnnnngnnggggggggccccggggctcccttttccaacccggaaaaaggggggaactccccccagggggcccc

SEQ ID NO: 81310 - protein, 111 aa, Zea mays; identical to SEQ ID NO: 60604
  misc_feature: Ceres CLONE 1566765
  misc_feature (17)..(110): Pfam Name: Ribosomal_60s Pfam Description: 60s Acidic ribosomal protein

SEQ ID NO: 81311 - DNA, 796 bp, Zea mays
  misc_feature: Ceres CLONE 1566769
  misc_feature: Encodes the peptide sequence at SEQ ID NO. 81312
ctccccgcggtggcggccgctctagaactagtggatcccccgggctgcaggaattcgtctcacccctagaaaaacctagaaaaaatgtgacccatccgaccgccctctcctctcttcctcttcctcgcaccacctccaccaccaccctcctctcttctcgcctccaccaccaaaaggggtgagaggcacggggaccgcccgcctcgctcgctggcctgcacactggattcggcgccgcggcggtagttgcagcggcggcctggcagggagatgtcttcacgctcggggtctacgagcggcgggagcaccggtggcggcagcagcgcagggggaggcgccgcggtgccgctggccttgctgctgaggcgggaggtggccagcgagcgcaccgcatcggagcgaccggagctgcactcgggcctcttcagccaggccaagaaaggcgaggacttcacattcctcaagctcgaatgcgagcgcgtccccggcgtcccgtcctcctccttctccgccttcggcctgtttgatgggcacaatgggaacggggccgcaatttacaccaaagagaatctcttgaacaacatcttgaacgcggtccctgctgatctcaacagggaagactggcttgctgcactcccaagagcgctggttgctgcattcgttaaaacggataaagatttccagactaaagcaccttcttcagggacaaccgtgacatttgtcataatagatggattgttcatcactggtgcatcagttgggcgatttcccgttgtgtactacaaggctgagggtt

SEQ ID NO: 81312 - protein, 175 aa, Zea mays
  misc_feature: Ceres CLONE 1566769
  misc_feature: SWISSPROT Homolog: EC 3.1.3.16 Phosphoprotein phosphatase
MSSRSGSTSGGSTGGGSSAGGGAAVPLALLLRREVASERTASERPELHSGLFSQAKKGEDFTFLKLECERVPGVPSSSFSAFGLFDGHNGNGAAIYTKENLLNNILNAVPADLNREDWLAALPRALVAAFVKTDKDFQTKAPSSGTTVTFVIIDGLFITGASVGRFPVVYYKAEG

SEQ ID NO: 81313 - DNA, 718 bp, Zea mays
  misc_feature: Ceres CLONE 1566772
  misc_feature (207)..(207): n is a, c, t, g, unknown, or other
  misc_feature (578)..(578): n is a, c, t, g, unknown, or other
acccgcggtggcggccgctctagaactagtggatcccccgggctgcaggaattcgtctcacccctagaaaatagaaaaaaacgagcgtatctgcttttttttttttggtaaaagaatttgtttttgcaaagctagctcctacgctgccgccgccatgcaccgcttcgccgccgacagggcgcgccgcgcggtggccgcgtccctgcngcggcgcagcttccagagcagcagcagcgccgtcgcgtcacgctccggcgccctcgccaattcaccttcccccaattcggggggcgccggcccccgtttgctgcccccccccccatgggggaagggggggccccccctggttccccgagggggggtccgggggggggccccacccacggggggggtgggttttaaaaaaacttaataccccccaaaggggggggccccccccaggggttgttttttttaaaaacccccttttaaaacccccccccagggggggtttttaggaaggggggcctatattttttcccccccccccccggggggggggaagaaaaatttttttctccccccgggtgtgggttttnaaaaaaaaaaatgccgcccacaaaaaaaaaaaaagtttgtggggaaaagaaaaaaaaacccccgcgggggggggggccccccctttttttttttttttttgttgggggggaaaagaaaaaaaacccccccccccttcttc

SEQ ID NO: 81314 - DNA, 969 bp, Zea mays
  misc_feature: Ceres CLONE 1566774
  misc_feature: Encodes the peptide sequence at SEQ ID NO. 81315
ctccccgcggtggcggccgctctagaactagtggatcccccgggctgcaggaattcgtctcacccctagaaaaatctgataatccatacagtggttgttcatgtggtgtctcttgtcacctaaactgtgctctaaagaataaaagggctggcattgtcaagaatgggtgcaacaagttagactgtagtttctactgcgttagttgtgggaaaatcaactggctaatgaggtgtttgcagaaacaacttgcaattgctagggaggcaagaagagttgatgtgctttgtgagcggttgtcattgagccataaaataatacatgggtctgaacgttacaaggaaatagcgagcataatcagctcagctgtgaaaacacttgaaatagaagttggtagtgcattggatcaagtctctgtgatcacggggcgtggcatcatgaaccggcttacttgtggcgctgaagttcagaagctttgttcaagtacattagaaattgtacactcctaaagtggataacatcttggagttcgagtccaattaatagttcataactcctaggtactcatccacaaatcctttttcatgagatcactccattttgctgaggctattgcgttgaactagcagcatgaactccgttacgagcggattgatggcttcaaaatttggcaccggatgtgcacgggtttgcactattgcattaaagcccaaatgccccataacgaagcccaaccctttgagcctggtttctggtctgagcccttccaaagaaatcttcttcaagggtttgccttttagcaaaaaaaattgggtttacatgatgggagacaaatgccccccccccgcctggaaccttgaaacctcccaggctcaaccaaaatctcgaaagaattgcccccaaaaaaattcattgcggcttcccaaaaggattttaattgtgcgaaatcccccaataacctttcatttgttt

SEQ ID NO: 81315 - protein, 167 aa, Zea mays
  misc_feature: Ceres CLONE 1566774
PRGGGRSRTSGSPGLQEFVSPLEKSDNPYSGCSCGVSCHLNCALKNKRAGIVKNGCNKLDCSFYCVSCGKINWLMRCLQKQLAIAREARRVDVLCERLSLSHKIIHGSERYKEIASIISSAVKTLEIEVGSALDQVSVITGRGIMNRLTCGAEVQKLCSSTLEIVHS

SEQ ID NO: 81316 - DNA, 763 bp, Zea mays
  misc_feature: Ceres CLONE 1566777
  misc_feature: Encodes the peptide sequence at SEQ ID NO. 81317
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (569)..(569): n is a, c, t, g, unknown, or other
  misc_feature (598)..(598): n is a, c, t, g, unknown, or other
  misc_feature (698)..(698): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (711)..(711): n is a, c, t, g, unknown, or other
  misc_feature (715)..(715): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (749)..(749): n is a, c, t, g, unknown, or other
  misc_feature (750)..(750): n is a, c, t, g, unknown, or other
ctggagctccccgcggtggcggccgctctagaactagtggatcccccgggctgcaggaattcgtctcacccctagaaaaactctccgcctctactgtagccacggcccttggttcccctccattattcgacctcacctcaccttgccaccagccatggctgccgtgaccgccgcggccatctctctgtcctcctcctccacctcctcccctgcggctgctgccaaggccaaggcggcgtccccgtcgtcgtcgccatgcaggcacctccagttcctgtcggcagcgagcccgcggcggcggtggcggtgccgtgcccccccgccccggtacgggccgcagggtggttccccccacacccaaaaacccgccggcgggggggggcccgggcaaaaacccccccaaaaaaaaacgggggggagannnnnnnnnaaggagggggggggggggggtcccccccacaaatttaaaccaccccccccggggggcccccccccccccggggggggggggcgcccgccccccccaaacccccggggtttttttttctcgggggagaaaaaaaaaacancccccccgggggggggaaaaaaaaaattnccacaacttttgtttttcctcccccccccccaagaaaaaggagaaaaggacaccccccccctataaaaaaggggggggggggggggggcggccccccccncccnnnaaacaanatcntgtttttagggggggagaagggggtnnnnnnttnnttacaacgaaaaa

SEQ ID NO: 81317 - protein, 70 aa, Zea mays
  misc_feature: Ceres CLONE 1566777
  misc_feature (56)..(56): Xaa is any aa, unknown, or other
  misc_feature (57)..(57): Xaa is any aa, unknown, or other
  misc_feature (58)..(58): Xaa is any aa, unknown, or other
  misc_feature (59)..(59): Xaa is any aa, unknown, or other
MQAPPVPVGSEPAAAVAVPCPPAPVRAAGWFPPHPKTRRRGGARAKTPPKKNGGEXXXXGGGGGGSPPQI

SEQ ID NO: 81318 - DNA, 783 bp, Zea mays
  misc_feature: Ceres CLONE 1566778
  misc_feature: Encodes the peptide sequence at SEQ ID NO. 81319
ctccccgcggtggcggccgctctagaactagtggatcccccgggctgcaggaattcgtctcacccctagaaaaaaaaacgcctctcggctctcgcgcccgcctgccctagccgctcgcccggtcctactcccgcataggcgccgccgccgctacccgctacccccggcagccggcactcggcaggttcttcccctggcatccggcactcggcttcttcttgcccaggttcccggcgcggcggcgcccgctcctcctccccccggtcgcccgctgcaggtcctccccccgcagcacgcgcccgctgctgcagcctgcagctcctccggtcctccccctgccggcgcccgctgcgagctgcacagttgcagctcctccccctggctggcacagctgcagcttcaactctcttgaaggcaaaagaattgaatcgcgctctgttgatgggcagcttgcatgctctgcgggcaccgacgccgctcgttgggagcactaggattggcttcagttcggggctccgcttttgctccgacagagtcctcagagggttaactcccattggcgcgatgaagtcgtataggctgtcggagctcagcgacaccgaagttagcggcctcaaagctcgtccccgcatcgatttctcatctatttttggcacggtgaatccaatcgttgaagatgtccgtgtgagaggtgatgcagcagttaagcactacacagaatagtttgacaaggtcatgcattgatgatgttgtcgtctgtgttagcgatcttccagatgcaga

SEQ ID NO: 81319 - protein, 93 aa, Zea mays
  misc_feature: Ceres CLONE 1566778
  misc_feature: SWISSPROT Homolog: EC 1.1.1.23 Histidinol dehydrogenase
MGSLHALRAPTPLVGSTRIGFSSGLRFCSDRVLRGLTPIGAMKSYRLSELSDTEVSGLKARPRIDFSSIFGTVNPIVEDVRVRGDAAVKHYTE

SEQ ID NO: 81320 - DNA, 953 bp, Zea mays
  misc_feature: Ceres CLONE 1566779
  misc_feature: Encodes the peptide sequence at SEQ ID NO. 81321
ctccccgcggtggcggccgctctagaactagtggatcccccgggctgcaggaattcgtctcacccctagaaaaactagaaaaaagcccggcacagacactactggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaggacgagctggaggagaccaacccgctggccatcgtccccgacagccaccccatcgccacgcccgccaggtccagggcgtccgggctggaggtcgtgcccgcgggcccggcgccgcagccgcccgcgcacctggaggccagccaggtcaagaaagaagaggtggagaccaaggtcacggcctggcagacagccgaagtcgccaagatcaacaaccgcttcaagagggaggatgtggtcattcacggctgggagaccgagcaggtggagaaggcctccgcgttggctcaagatgatcgagaggaagctttaccagcagcgcgccaggcgcttggaaagtaccagaacgacatcgccaaagcgcggcccaagcggaagaaaaacggccgtcggcggaggccaaacgggtgctctagctggcccaagggcctgaactcgccaactttct

SEQ ID NO: 81321 - protein, 250 aa, Zea mays
  misc_feature: Ceres CLONE 1566779
  misc_feature (151)..(239): Pfam Name: Remorin_C Pfam Description: Remorin, C-terminal region
MLHEQQAPPPAVAAPPPSINPDDDGGRDVEVTTFRDIHPLTPDAPPPASASWDTASHRSLSSSDDQQYMTMSREFTAMVAAGATMQPGGYDGAADQLTSIGEDELEETNPLAIVPDSHPIATPARSRASGLEVVPAGPAPQPPAHLEASQVKKEEVETKVTAWQTAEVAKINNRFKREDVVIHGWETEQVEKASALAQDDREEALPAARQALGKYQNDIAKARPKRKKNGRRRRPNGCSSWPKGLNSPTF

SEQ ID NO: 81322 - DNA, 845 bp, Zea mays
  misc_feature: Ceres CLONE 1566780
  misc_feature: Encodes the peptide sequence at SEQ ID NO. 81323
tacccgcggtggcggccgctctagaactagtggatcccccgggctgcaggaattcgtctcacccctagaaaaacgttcagaccgcccgattcccgttcccgcatcaccttcctccaccaccgcctcccacattcttcgcatccccttatacttttttgtccttctatcgtcgtcgatccgggctcctgttttgcccgcacgcaggctggttgccaagaaagacagggcgagtgcgcggcgcccagctccgaccgtgcttcatagctcatctggccggggacggggatattcgcgttgctcgcttgcccggcgggtagctgtagcctgtaggcgagaatcgggaacgggggtgtttacaggccatgaagtataacacgaggaaagacgcgagcggtggcggtggcggcgcgccgtttgccgtcccatgcgtcgacatcaagtcgttcgtgggctcgctcgccttcctcacgctgttcgtcgtgttctggcagctccagccctacggctccgtgctcaccgcggctcgcacctccgcctcgcccccttgcaccctcctccccacaaccgctgtcatcgacctcgcctctcctgataccaccagcagcactgccgcaaagacggaccaaccggcggcggcggcggcggcggctgtttcagctactgccgcaggcgcaaatgctgccccggtgtggttggcaaaggcagcgaggccggcgcggccggaagatccgaacaagcgcgtgttccgggcgtacggtagcgcggcggcgctgttcgtgcagatgggcgcgtaccggggcgggccgcggacgttcgccatcgtgggggctggcgtccaagcccaa

SEQ ID NO: 81323 - protein, 161 aa, Zea mays
  misc_feature: Ceres CLONE 1566780
MKYNTRKDASGGGGGAPFAVPCVDIKSFVGSLAFLTLFVVFWQLQPYGSVLTAARTSASPPCTLLPTTAVIDLASPDTTSSTAAKTDQPAAAAAAAVSATAAGANAAPVWLAKAARPARPEDPNKRVFRAYGSAAALFVQMGAYRGGPRTFAIVGAGVQAQ

SEQ ID NO: 81324 - DNA, 765 bp, Zea mays
  misc_feature: Ceres CLONE 1566786
  misc_feature: Encodes the peptide sequence at SEQ ID NO. 81325
gcggtggcggccgctctagaactagtggatcccccgggctgcaggaatgcgtctcacccctagaaaaagcaggaaaaacagctcgtggcagctgagactgagaggcgctgctgatataaaaacttgggaaggttgacgcctctatctctctctctctgtctcccaccacctatcttccctccccatgtgggcggcctcgagctctgcttaggtctcacagctgtgctctcgttggttgggtgatccgccccttgtcggctcctttcaactcgagagctccgggacagcgagatctgcgctgtcgccgccttacctttcttgcgagctcgcgtgcaggcaggcactgagcagtgagcccccccccgtcttcctcagcctcgtttcccctctcgttgctggatctggctcgcaagatccaatctttcgtgccccctttttccaaagatcctcgcttgggtggttcttcctggagattgctgggaggatgcagcacgaccagaagaagaagagatggattttttcacagagtatggcgaatgcagcaggtacaagatagaagaggtcataggcaaaggcagctacggcgtggtttgctctgccgtggacactcatactggcgaacaggtcgctataaagaagataaacgacatctttcgagcatgtgtctgatgcgacgcggatactccgggagatcaagctgcttaggctcctgcggcatcccgatattgtggaaataagcatatcttgctccctccgtcgaggaga

SEQ ID NO: 81325 - protein, 52 aa, Zea mays
  misc_feature: Ceres CLONE 1566786
  misc_feature: SWISSPROT Homolog: EC 2.7.11.24 Mitogen-activated protein kinase
MDFFTEYGECSRYKIEEVIGKGSYGVVCSAVDTHTGEQVAIKKINDIFRACV

SEQ ID NO: 81326 - DNA, 946 bp, Zea mays
  misc_feature: Ceres CLONE 1566792
  misc_feature: Encodes the peptide sequence at SEQ ID NO. 81327
  misc_feature (634)..(634): n is a, c, t, g, unknown, or other
ggagctccccgcggtggcggccgctctagaactagtggatcccccgggctgcaggaattcgtctcacccctagaaaaaagctcaccgccacctccacgctcgaagctcctcccgaaccggccgcatcgtcgccatggcagccgccgcttctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccagaaaacaaggtgccttctctagagcacgacaaccaggtgaaaggagagagcttggatttggttaagtacattgacagcaacttcaaaggtccatcgttgctccccgaggatcctgcaaagcagcagttcgctgaggagctgctcggatacactgatgcattcaacaaagcattttactcatgtttagtcgacagggaagatgtgtctgaggaagccgttgctgccttggacaaaatagtagacgccctggggaaatcaacgacngcccgttcttccttggtcagttcagtctggtggacggtgcgtatgtaccatcatcgagaggttcagatactctatccaacataaagcctatgacatcccaagggcagaacccacctcagaaatcatcgaggaatgaacagatcgatgcgtacacacgactaaacggacccgcatttttgcttgagcaacaagaacggcctgggattgcttaagcctgtgacaagggacaaacttcccagaacacaagctaataaatcggaaccgcctttatcggtggggcctggaattacaccgggccccaaaggggggcct

SEQ ID NO: 81327 - protein, 194 aa, Zea mays
  misc_feature: Ceres CLONE 1566792
  misc_feature: SWISSPROT Homolog: EC 2.5.1.18 Glutathione transferase
MAAAASASSVKEVLPSPLTSASEPPPLFDGTTRLYVAYLCPFAQRAWIARNYKGLQDKIKIVAIDLADRPAWYKEKVYPENKVPSLEHDNQVKGESLDLVKYIDSNFKGPSLLPEDPAKQQFAEELLGYTDAFNKAFYSCLVDREDVSEEAVAALDKIVDALGKSTTARSSLVSSVWWTVRMYHHREVQILYPT

SEQ ID NO: 81328 - DNA, 871 bp, Zea mays
  misc_feature: Ceres CLONE 1566794
  misc_feature: Encodes the peptide sequence at SEQ ID NO. 81329
  misc_feature (638)..(638): n is a, c, t, g, unknown, or other
ctccccgcggtggcggccgctctagaactagtggatcccccgggctgcaggaattcgtctcacccctagaaaaactccgggctccacagagtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggaggggtgaagaggacgtctcagaaggggagggatatgacaacccatagggcaatgagaccaagaagcaaagaggtgatcctgaggaaaatggtgaggaagatgaggaagaaccagaagatcaggagggtggcggcgacgacgatgatgacgacgatgacgatgatgagaacggggatgacgaggacgacgancatggggatgacgattgagagggttgtagatgaagaagaccattgaccgggacgaggattgagaggaaaatgatgattaaaaccccccccccaccccccaaagaaaaggaaaaaatgaaaatctttcggccgctttagtaaccgcggggccgaatttctccccgggtttttccccttatcccccgccatttcaattttcccctagagaggtttaaaaagggaccccccagttt

SEQ ID NO: 81329 - protein, 72 aa, Zea mays
  misc_feature: Ceres CLONE 1566794
MDTAAPLQLKACAGDAAEKLLLAVAAEGPICGVPDFKMRGKKSDELEPVDAGDEDDDGGDDGDEDGDFGEEG

SEQ ID NO: 81330 - DNA, 845 bp, Zea mays
  misc_feature: Ceres CLONE 1566795
  misc_feature: Encodes the peptide sequence at SEQ ID NO. 81331
  misc_feature (832)..(832): n is a, c, t, g, unknown, or other
ctccccgcggtggcggccgctctagaactagtggatcccccgggctgcaggaattcgtctcacccctagaaaaaaatattttgctgtctagccagtgtatcacaaagcaggttatctgcgagcagagccgcctatcccgtataagatactacgggaattttgatgtttccttaggacgctatttgcaagacattttgcagaagcagaatctcagctgttcctcatgtggagagcctccagaggctcacatgtattcctacactcaccgcaatgggaatctgactgttcttgtgaggcacttgctgcctaaatatcgtttacctggtgaatcagaaggaaagatttggatgtggactagatgcttaaggtgtgaacgtgaaagtgggatctccagatcatcacgaagggtgataatgtcagctgaagcacactacctttcatttgggaagttccttgaactcagtttttcaagccactcaaccgctagaaggctgtcaatatgcgggcattcactcaataccgattgtctgcgcttttttgggttgggctccaaagttgcaatgttccagtattcctcagtcgaaatttacaatgcctgcaaaccacagcctactcttgagtttcacaattccgatatgcacgagtggtacgggcaagaggtacgaaatgttcttgctacaggagttacacttttctcggaagtcacaagcgcactacagaagctcaaggatcagtttcctgttaaatacctttcccaacttgaagagatgttgattaaagagaaggctgagttcatggattctctagcaaagactgttgatcgaaatagggnaatcagctctgtg

SEQ ID NO: 81331 - protein, 281 aa, Zea mays
  misc_feature: Ceres CLONE 1566795
  misc_feature: SWISSPROT Homolog: EC 2.7.1.68 1-phosphatidylinositol-4-phosphate 5-kinase
  misc_feature (277)..(277): Xaa is any aa, unknown, or other
PRGGGRSRTSGSPGLQEFVSPLEKNILLSSQCITKQVICEQSRLSRIRYYGNFDVSLGRYLQDILQKQNLSCSSCGEPPEAHMYSYTHRNGNLTVLVRHLLPKYRLPGESEGKIWMWTRCLRCERESGISRSSRRVIMSAEAHYLSFGKFLELSFSSHSTARRLSICGHSLNTDCLRFFGLGSKVAMFQYSSVEIYNACKPQPTLEFHNSDMHEWYGQEVRNVLATGVTLFSEVTSALQKLKDQFPVKYLSQLEEMLIKEKAEFMDSLAKTVDRNRXISSV

SEQ ID NO: 81332 - DNA, 880 bp, Zea mays
  misc_feature: Ceres CLONE 1566796
  misc_feature: Encodes the peptide sequence at SEQ ID NO. 81333
  misc_feature (880)..(880): n is a, c, t, g, unknown, or other
ccgcggtggcggccgctctagaactagtggatcccccgggctgcaggaattcgtctcacccctagaaaaaccactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtggctcccttcctcgccgtcctcgccttccacatctccgtctacatcaggtccagggccagggcccgtggtaccccatcgactttctcaggctaccagcccggccaacaagcttcaaggggtccaagggcggagtttcttcgacccgggcgccgcaaagtcccggcaaagtttccaacaaaggaacagcctcggcggtttcccaggtccggtccggccggggccaagatccggggtttcggggaaacaaaatcggtaacaatgccccgcccctggcggggtttcaaagaccccaaagccctaggatgtgcgcctcctccttgtaaaagggaggggtcccccgcctccaagagcggtcacaaaagggcccaattggttttcgccggggatgcgn

SEQ ID NO: 81333 - protein, 231 aa, Zea mays
  misc_feature: Ceres CLONE 1566796
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVAPFLAVLAFHISVYIRSRARARGTPSTFSGYQPGQQASRGPRAEFLRPGRRKVPAKFPTKEQPRRFPRSGPAGAKIRGFGETKSVTMPRPWRGFKDPKALGCAPPPCKREGSPASKSGHKRAQLVFAGDA

SEQ ID NO: 81334 - DNA, 919 bp, Zea mays
  misc_feature: Ceres CLONE 1566797
  misc_feature (589)..(589): n is a, c, t, g, unknown, or other
ctccccgcggtggcggccgctctagaactagtggatcccccgggctgcaggaattcgtctcacccctagaaaaactagaaaaaagcccggcacagacactactggcacgcacgcaccagcaccagcaccacaccacatgaatggtggagcctagcacgggcagctagctcccggccggcgacgtgacgaccaccaccaccacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctccttgtcgtcgtccgacgaccagcagtacatgacgatgagccgcgagttcacggccatggtcgccgccggggcgaccatgcagccccgcggctacgacggcgccggcgaacagctcaccagcatcggggaaggacgacctggaggaaaacaaaaccgttgggcatcgtccccgaaagccaccccaatcccaagccccccaagtccaagggcntccgggctggaagttttgcccccgggcccggggccccatacccccccgccccctggagcccacccaggccaaaaaaggagagggggaaaccaagggtcccggcctggaaaaaaggcccaaggttcccaaaaaaaaaacccccctctaaaaagggaggagatggggtccacaaccgcgtgggaaacaccaaaagggggagaaaaggccccccggggggcctaaaaaaaaacaaaaaagaaaggggggaaaaaacgccccccagaggggcgtgaaaaaaaaacacaaaaaacaccccccaagaggcccgcctcaggggggaagaaaaaaaag

SEQ ID NO: 81335 - DNA, 794 bp, Zea mays
  misc_feature: Ceres CLONE 1566798
acccgcggtggcggccgctctagaactagtggatcccccgggctgcaggaattcgtctcacccctagaaaaaagggaaaagcgggtcgcgagtcgcgactcgcgagtgcccgcttttgctccaatccaatcggtgccgcctcgggcgagatccgctccgcgtgccccgccgctgccgagatagagggtgtcgtccccactccccagcatctggttccacggagagttgttgatcttggatacctgatccgcaatttggggctgattgagtcacttgaccttttcaacatctgccccgttcctgctgccttgctcactataagaggctggcctggttccagagatgattctattgtgagtggagatggattctgtgagaagttggttccagaagttccagccgagagacaaatcgaagagggcagtggtggctgccagacatggaaaagatccaggaaaagcccccggatgggacaatgccccctttctaggtgcgaacgaaaacaaaaggggttgccccttgcaaaaacattacctttgggaaccccttcccaggaccccaaatgaaagtccctggcaaaaatgggaaaaaaggagggaactttgggaacccttccccttaaaaaaaaaaaaaggggggttaaacctttttaagggcccctcggtaatttttggggaaaagaaaaaattccccggggaggggccccaaaaattttcctttttttaaaaaaggccgaaaaaaaacccctctttttttataaacctttttgggaaggaaaaaaaaaaagacgcgct

SEQ ID NO: 81336 - DNA, 867 bp, Zea mays
  misc_feature: Ceres CLONE 1566808
  misc_feature: Encodes the peptide sequence at SEQ ID NO. 81337
gcggtggcggccgctctagaactagtggatcccccgggctgcaggaattcgtctcacccctagaaaaatttcgccgtccgtgacgcgagagacctcttcgcatcccgaggcggcgcttttggggtcggaagcgacacgggcgcccggcgggtccgcgggtggtggtgctactgctagcaagcagcagcaggcgacgctaggcgagagccccagtcggagcaggccaccatgtgcggcatcctcgctgtcctcggcgtcgctgaggtctccctcgccaagcgctcccgcatcattgagctctcgcgcaggttacggcaccgagggcctgattggagtggtttgcactgtcatgaggattgttaccttgcacaccagcggttggctattatcgatcctacatctggagaccagcctttgtacaatgaggataaaacagttgtttgtacggtgaacggagagatctataaccatgaagaattgaaagctaagttgaaaactcatgagttccaaactggcagtgattgtgaagttatagcccatctttacgaagaatatggcggaagaattttgtggatatgttgggatggaatgttctccctttgttcttccttgatacccgtgataaaaagcttcatcgccagctccgtgatgcttattggcaatctgcccctttatacatggggatggggtcctttgaagggatccggtctgggttttccttccaaagaatgaaggggctttgaggtggtagaattggtgaaaccgcctttcttaaaatttccccccccgggggggagtctttttacttccagagaaaaaaaaagggggggtgtcttaagagggaaatagggtgacacaccccccccc

SEQ ID NO: 81337 - protein, 167 aa, Zea mays
  misc_feature: Ceres CLONE 1566808
  misc_feature (2)..(128): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGVAEVSLAKRSRIIELSRRLRHRGPDWSGLHCHEDCYLAHQRLAIIDPTSGDQPLYNEDKTVVCTVNGEIYNHEELKAKLKTHEFQTGSDCEVIAHLYEEYGGRILWICWDGMFSLCSSLIPVIKSFIASSVMLIGNLPLYTWGWGPLKGSGLGFPSKE

SEQ ID NO: 81338 - DNA, 952 bp, Zea mays
  misc_feature: Ceres CLONE 1566810
  misc_feature: Encodes the peptide sequence at SEQ ID NO. 81339
ctccccgcggtggcggccgctctagaactagtggatcccccgggctgcaggaattcgtctcacccctagaaaaaaccctcccaccaccgaacccgcagccgccgccgccaaaccacaccgcgctcctctctggcggatagcggacagcgattttgatcggcggtcctcagacctcagcccagcccggcccgcgatggagaagacaaagctgccgctgccgctaccgctacccctggtgcacggcgagcgtctgtgggcgcggccgtggcggtggctgaagacggccttcttcatcgtggcgatgctggcgtcgctgctgctcgtgtgcgcgccgccgctgctggtcgtgctgctggacctgctcctgccgcccgcgctgctctccagcttcctccgcgcgcagccgccctccttcgccgccgcgctcgccgcccaggccaggcccttccgcttcgcctcctcgctcgccgacctccccgcgctctccgccgcgcgctccctcctcatcctctgcgcgtacgccgcgggcggtggcggcggcgccgcatacaggtgggtcgccgtcgcctgcagcgccgcctccgtctgctacgtcctcgccaaggccgtcgccgtcttcggcgccgcgcccgtgtggcggggcaacggccagctcgtcgccgtcgaggccatgttcctcatgtcgctcgcgctcgccgtcgcccacctcgccatggcgtaccgcgcgtcatgccgcgagcgccgacgcctgcagctagtctacagaatcgacgtcgaagcggtaagactggaggggagccagacgcccaggcactgaaagcatgcatgatatgacacccatctgcttcgagtatcgccgtcaccgctggcgctgggtggaggtggaaattgggaggaaggacctccagagaatgacggggcggcggtcttccgggggcaaaacggcagtgca

SEQ ID NO: 81339 - protein, 207 aa, Zea mays
  misc_feature: Ceres CLONE 1566810
MEKTKLPLPLPLPLVHGERLWARPWRWLKTAFFIVAMLASLLLVCAPPLLVVLLDLLLPPALLSSFLRAQPPSFAAALAAQARPFRFASSLADLPALSAARSLLILCAYAAGGGGGAAYRWVAVACSAASVCYVLAKAVAVFGAAPVWRGNGQLVAVEAMFLMSLALAVAHLAMAYRASCRERRRLQLVYRIDVEAVRLEGSQTPRH

SEQ ID NO: 81340 - DNA, 1278 bp, Zea mays
  misc_feature: Ceres CLONE 1566814
  misc_feature (48)..(48): n is a, c, t, g, unknown, or other
  misc_feature (50)..(50): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (665)..(665): n is a, c, t, g, unknown, or other
  misc_feature (1124)..(1124): n is a, c, t, g, unknown, or other
  misc_feature (1269)..(1269): n is a, c, t, g, unknown, or other
gcggtgtcgtcgaaaaccctaaaacaactcaaaatacaaccagttgcncnccnntnnngggcnnnnntacaagctggagctccccgcggtggcggccgctctagactagtggatcccccgggctgcaggaattcgtctcacccctagaaaaaaccctcccaccacgaaacccgcggccgccgccgccaaaccacaccgccgctccactctggcggatagcggacagatattctgatcggcggtcctcggacctcaccccagcccggcccgcggatggagaacaccaagctgccgctgccgctaccgataccgctggggcacgggggagccctgtgggggcagccagtggcagtaattaaacaacggcccttcttcctagtggcgatgctggcgtcgctgtccgcccgggtgcacgccgccgcgtgcggtctggcctgccgccaactaattcgtgccggcggggggtgaaaatccagaatcccccccccgcccacaggaggttcttcgtcggcctccattggtacagcacaagagacagcgcttttccaggtttggcctcccttgtatggcccgaacctcgccgggggactttttatgcgcgggaaggctcccctccatgattatgacgtgtaaggtgaaccccctcaagggcgcctggggaacgngggctcccaggatacaaatggggggggagggcctgtcgccctagagcgatagggacgagctcgccaggtcgggactggagaggtgctctggagcggagagaaagggtcgtgtacgctattgtttctcttgcaggactgagccgccccatctgtgtgggtaggggggcatgaatcgatgcacaccaggtttcaggtcgcgccggccgagcgaggggagggcatggtacttttatgcggagttgtaccgggatacggtatcgcatttcttctgttctggtgctgcacaccgttgagcacatttaatggctgtcgctcagttggggtgtgagtgttgcgcgctgcgtgtagagtgtgaacaaccacctcccgcggggcgctgatgtatcgttcgtcctggatggggagcttctcgtatcaatactggttagacgagagggatattaacgggggggggctcgncatgtgaccactccggtgggtcttgtatgagacgtacgtgagccactatagttcgcagacgtctccatcatagcggttgctgcaaaagggtcctttacggatatgtgcacgctggggtttcacctttgtgctgtgcgtatggagncagggatct

SEQ ID NO: 81341 - DNA, 879 bp, Zea mays
  misc_feature: Ceres CLONE 1566815
  misc_feature: Encodes the peptide sequence at SEQ ID NO. 81342
  misc_feature (782)..(782): n is a, c, t, g, unknown, or other
gagctccccgcggtggcggccgctctagaactagtggatcccccgggctgcaggaattcgtctcacccctagaaaaagagaggtggaggaggagagagagaaaagcgcgggggcgcgaaggcaagctgtagttacacacatcacccaccccgtcgcactcgcaccgcaatctccccgatccccaattcccccattatccgccgagccccgccccgccccgccaatggaccaccacctcacgccgacgccgccgccgccgccgccgccgatggggaactccgcggcgggggcgtcctcgaagccgccgacgccggcgtccacgcccaactcgcgcctcgcctcggcgccgtcctcccaccacgccgccacgccgccgcacgcgtcggcggcggcgtcccccccggcgccggcctcgcgcaccgtctacagcgaccgcttcatccccagccgcaccggatccaacctcgcgctcttcgacctcgccccctcgccctcctccgccgcctcgtcctcgcactcgcacgacgccggccccgcggcctcgtccggatctgcgcagcccgccgcgtcgccctactgcacgctcctccgcgccgcgctcttcggccccgacacgcccgaccgcgtcgcgtcctcggccgccgcgtgctcctcgtcgtcgacctccttctccccggggccctcgtctgtcggcacccccgccaccgggaacatcttcagattcaagacggaggtgcgcccggaacgccaaagagggggcttttttttccgggagaccaaanagggaggaccccgctggttcccccggcaattttcaccaacaagggggcggcggggaaccaagggaggggggcccaggatccgctccttacaaagggg

SEQ ID NO: 81342 - protein, 203 aa, Zea mays
  misc_feature: Ceres CLONE 1566815
  misc_feature (172)..(172): Xaa is any aa, unknown, or other
MGNSAAGASSKPPTPASTPNSRLASAPSSHHAATPPHASAAASPPAPASRTVYSDRFIPSRTGSNLALFDLAPSPSSAASSSHSHDAGPAASSGSAQPAASPYCTLLRAALFGPDTPDRVASSAAACSSSSTSFSPGPSSVGTPATGNIFRFKTEVRPERQRGGFFFRETKXGGPRWFPRQFSPTRGRRGTKGGGPRIRSLQR

SEQ ID NO: 81343 - DNA, 825 bp, Zea mays
  misc_feature: Ceres CLONE 1566820
  misc_feature: Encodes the peptide sequence at SEQ ID NO. 81344
  misc_feature (494)..(494): n is a, c, t, g, unknown, or other
  misc_feature (545)..(545): n is a, c, t, g, unknown, or other
  misc_feature (554)..(554): n is a, c, t, g, unknown, or other
  misc_feature (557)..(557): n is a, c, t, g, unknown, or other
ccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcatcagcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatctagaacatgaacggcaaggagctcgacggccgtaacatcaccgttaaccaggcccagtcccgtggctgtggcggtggctgcagtcgctacagcggccgtaactgcggcagcggctatggtggccggacgcataacngccgttatagcggccgtagcggctacggaggtcgacccgaaggtagtggcngccgctacngangccagtggcgctaccgcggtctgctcaagggtggtggatggcggctacgacgtctgccgctgctggcttgagggactgatgttttggcccattctgggtttccgccaattaacttaactatccaaaggacccgggttcccgttcgcctcagccccccggttttcggccggtccaccctttggaataaggggttgggacccccggggggacccccttgttgggccccggcttttaaacagggggaataccccttaaaaatttttccccc

SEQ ID NO: 81344 - protein, 66 aa, Zea mays
  misc_feature: Ceres CLONE 1566820
  misc_feature (10)..(67): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFISGLAWATSNESLENAFASYGEILDSKVITDRETGRSRGFGFVTFSSENSMLDAI

SEQ ID NO: 81345 - DNA, 788 bp, Zea mays
  misc_feature: Ceres CLONE 1566821
  misc_feature: Encodes the peptide sequence at SEQ ID NO. 81346
ctccccgcggtggcggccgctctagaactagtggatcccccgggctgcaggaattcgtctcacccctagaaaaattcagatctcccttcccttccgttcctgttcctctctattaagcaggaagcaaagcgccactctcaatccacctcacgcctcgctcagatctctccgcccgggtccatcttcacaccccaaagcttctcccgcctctctcgtcaacggcgcccgactacagggatggcggacttgcgagctccggtcgcaacactcctcgtccacctcaccctagcggcgggcggcggcgtggcggccgacggctcccatcaccggtacaagattcgcgagcccgtcccgctctacggcaacaaagtcggcccatttcacagatcgcagtgaaacatatcgatatttcgacctggctttcagctctcctgacaaactgaaggagaagagcgaagcccttggggaggttctcaatgaggataggtcagttgatgcgccttacaagcttgatatcagtgacgaagttgaaaccgaggcagatagctccaagaaacttactacagaggatgtagagaagttccagaatgcactggctaaagactactacttccagatgtactatgatgatcgcacactgaggggcttcatcggtaaagttgacaatggcggcaacgatgatccgagcgagtgggaatactatcagaacaggcacggcatcgtcgacatcctatacacaacgatcggggtgatcgatatgcaagtacacactgatcagagtgcattgg

SEQ ID NO: 81346 - protein, 57 aa, Zea mays
  misc_feature: Ceres CLONE 1566821
MYYDDRTLRGFIGKVDNGGNDDPSEWEYYQNRHGIVDILYTTIGVIDMQVHTDQSAL

SEQ ID NO: 81347 - DNA, 938 bp, Zea mays
  misc_feature: Ceres CLONE 1566822
  misc_feature: Encodes the peptide sequence at SEQ ID NO. 81348
  misc_feature (744)..(744): n is a, c, t, g, unknown, or other
  misc_feature (762)..(762): n is a, c, t, g, unknown, or other
  misc_feature (767)..(767): n is a, c, t, g, unknown, or other
  misc_feature (768)..(768): n is a, c, t, g, unknown, or other
  misc_feature (798)..(798): n is a, c, t, g, unknown, or other
  misc_feature (870)..(870): n is a, c, t, g, unknown, or other
  misc_feature (893)..(893): n is a, c, t, g, unknown, or other
  misc_feature (895)..(895): n is a, c, t, g, unknown, or other
  misc_feature (938)..(938): n is a, c, t, g, unknown, or other
ctccccgcggtggcggccgctctagaactagtggatcccccgggctgcaggaattcgtctcacccctagaaaaagacccttcgtcccgcatcgtttcctcctcctttttccccgttcgtcccctggattggcgtctacccggcgcgacccggaccgaatcctaagtccgcctgccgccgccgccgccggctcccgttggaaacgagtttggagtaaagaaaccaaccttgcatctgtgttctgtctgtctatgctgctttgctttggattcacaaaaaaataagccttgcatctcactgacttgagataactatgcctaaggacaggagctcccgcgtttcctctcacgagagccgccgggctcgtgcctccccatacttgtcagcgtctcatggacagagcagttcttcacgccggtcacaagagtctcctgcggccgcggcagcgaagcaagctgcagagtgggaggatgttcggtgctcggtctgcatggaccacccgcacaacgctgtcctgctggtctgctcgtcgcacgagaagggctgccgccccttcatgtgcgacaccagctcgcggcactccaattgctatgaccagtaccggaatgcctccaaggactcctccaaggattcagggacagagtgcagcgagtgccagcagcatgtccagctctcgtgcccgctgtgccgtgggccagtcagcgactgcatcaaggactacgacgcacggatgtacatgaacacnataggtccggtcctgcancatgnnagtcgtgccagttcaggggtgccctaccangagctgaagaagcatgctagggtggagcacccatgcgcgatggccgatgggaggtgaccctgtaacgcatcnggtatttgcgccggatggagcancncggggacctggagaactgatgagcattgctgcgttcaggtttn

SEQ ID NO: 81348 - protein, 121 aa, Zea mays
  misc_feature: Ceres CLONE 1566822
  misc_feature (1)..(118): Pfam Name: DUF1644 Pfam Description: Protein of unknown function (DUF1644)
  misc_feature (91)..(91): Xaa is any aa, unknown, or other
  misc_feature (93)..(93): Xaa is any aa, unknown, or other
  misc_feature (103)..(103): Xaa is any aa, unknown, or other
MDHPHNAVLLVCSSHEKGCRPFMCDTSSRHSNCYDQYRNASKDSSKDSGTECSECQQHVQLSCPLCRGPVSDCIKDYDARMYMNTIGPVLXHXSRASSGVPYXELKKHARVEHPCAMADGR

SEQ ID NO: 81349 - DNA, 814 bp, Zea mays
  misc_feature: Ceres CLONE 1566825
  misc_feature (421)..(421): n is a, c, t, g, unknown, or other
  misc_feature (524)..(524): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (789)..(789): n is a, c, t, g, unknown, or other
acccgcggtggcggccgctctagaactagtggatcccccgggctgcaggaattcgtctcacccctagaaaaagagctcgctcgtatctcctctctggacgaacagatcctctctggacgaacagaaaggttaccagcagcaccacggcgagatctccccttggcgggccaaaaccgacggcgagcttcaccggcgttggtcggctccaatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggcctcttcggagcaggttggctcgcctgacatgcangagccctggtcaaactcggagccagggcatgattccgccactgagagcgccagttccaaagacacatggccagctgagccgaacagagcaatggtggggtggnctgccagtgatggtgtgagtaaaggcggcgaaaaaggaggtggcaaaatgggtgaatcccaaacccccagggttttcccattgggaccccctccccccccccccggggggagggggagggaacgcccttctcccccccgggggggggttcccccccccaaaaaaaaaaaattttttttttttttttctccccccccccccccacaaaaaaaaaaaaaaaaaaaaaaaaaaaaaaannntttttgtgttgttgtgtgtggcggggnaacccccccccccccccgggaagga

SEQ ID NO: 81350 - DNA, 944 bp, Zea mays
  misc_feature: Ceres CLONE 1566826
  misc_feature: Translation starting site: 166
  misc_feature: SWISSPROT Homolog: EC 1.1.1.82 Malate dehydrogenase (NADP(+))
ctggagctccccgcggtggcggccgctctagaactagtggatcccccgggctgcaggaattcgtctcacccctagaaaaactcctctcctctcccgtcctatccatccggcacgcccagcatccatccactcctcccctgctccggctccggctccggctccgccatgggcctttcaacagtttactccccggccggaccgcgcctcgtgccggcccctctcggccgctgccgctctgcccagcctcgccgcccgcgccgagccccgctcgccaccgtccggtgctccgtcgacgccaccaagcaggcgcaggatggcgtggcgacggcggtcgcgacggaggcgccggcgtcacggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccgatagcacttaagctactcggctcagaaagatcgtttcaagccctcgaaggtgtagctatggaactggaggactcgctgtatccactgctgagggaagtcagcattggcatagatccttacgtagtctttcaagatgtagattgggccccttcttattggcgctaagccccgaggtcccggcatggagcgagctgcgctactggatatcaatggcccaatcttggctgaccaggggaaagcacttaatgcgggcgcctcgcggaacgcgaaggtcttagtttgttggaatccctgtaccactatgcgctgatttgtttaaaaatggccaaacatacgggcaaaaacttcatgcattgacgaggttggagaaaatgagcaaaggccactggcactaaaacagggtatttatgaacaatttc

SEQ ID NO: 81351 - DNA, 811 bp, Zea mays
  misc_feature: Ceres CLONE 1566827
  misc_feature: Encodes the peptide sequence at SEQ ID NO. 81352
  misc_feature (712)..(712): n is a, c, t, g, unknown, or other
  misc_feature (714)..(714): n is a, c, t, g, unknown, or other
  misc_feature (717)..(717): n is a, c, t, g, unknown, or other
  misc_feature (782)..(782): n is a, c, t, g, unknown, or other
tggagctccccgcggtggcggccgctctagaactagtggatcccccgggctgcaggaattcgtctcacccctagaaaaaagtctagctagcacacccgcactgcgtctccgcagcacacactcgcacgcacgagaaggccggagaggcggcgcacccggagaggcaaaggtaagcgatccctctccccccctccctccctccctcgtatcgtatccaggacaacagcccgtgcaatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgttgtcgcgctcgtcgacgctgccacgggccaccgggtcacgttccaggaactctggcgcgcggtggaaggggcggccaccgcgctcgccgcgccgccgctgtcgctccgcaagggccaggtcgcgctcatcctctccccgaactccgtccacttccccgtcgccgccctcgcagccatgtccctcggcgccgtcctcaccaccgccaacccgctcaacacgcccgctgagatcgccaagcaaatcgccgacgcgcgccccgtcgtcgccttcaccacccgcgacctcctgcccaaagctccgcgcgtcgggcgcgggcgctgcatctncntcntcctcctcgagcccgaccgcctcccctcgaccctagccccgtcgtcgccacattcggggaaaatntcgccacggcggcccgacccagggggcgg

SEQ ID NO: 81352 - protein, 188 aa, Zea mays
  misc_feature: Ceres CLONE 1566827
  misc_feature: SWISSPROT Homolog: EC 6.2.1.12 4-coumarate--CoA ligase
  misc_feature (156)..(156): Xaa is any aa, unknown, or other
  misc_feature (157)..(157): Xaa is any aa, unknown, or other
  misc_feature (158)..(158): Xaa is any aa, unknown, or other
  misc_feature (179)..(179): Xaa is any aa, unknown, or other
MAARPDARSGYCAATRTFRSKRADVPLPADADLDVVRFLASRRHAGVVALVDAATGHRVTFQELWRAVEGAATALAAPPLSLRKGQVALILSPNSVHFPVAALAAMSLGAVLTTANPLNTPAEIAKQIADARPVVAFTTRDLLPKAPRVGRGRCIXXXLLEPDRLPSTLAPSSPHSGKXSPRRPDPGG

SEQ ID NO: 81353 - DNA, 831 bp, Zea mays
  misc_feature: Ceres CLONE 1566828
  misc_feature: Encodes the peptide sequence at SEQ ID NO. 81354
ctccccgcggtggcggccgctctagaactagtggatcccccgggctgcaggaattcgtctcacccctagaaaaactatccttaatagggggttggttacatctacaacccaaatggaagccaagcctttcgtggttcaaaaacgccgaatctcgtctgaatcatcatttgtcaggacttttcggagtaagttctttggcttggacaggacatttagttcatgttgctattcccggatccaggggggagtacgttcgatggaataatttcttagatgtattaccctatccccaggggttgggtccccttctgacgggtcagtggaatctttatgcccaaaatcctgattcgagtaatcatttatttggtaccactcaaggagcgggaactgccattctgacccttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattaggacgtgcgcataaaggcctttatgatacaatcaataattcgattcattttcaagtagggcgtgctctagcttccgtaggaggtagtacttccttaagagctcaacctatggactccttacctgcttatgcattcatagaacaaaactttacaacccaggcgggtttaataactcataacaaaaacattgcaggggttcatcctaaaaaggggcttttggttcttgaagctttttttttcattagggatacca

SEQ ID NO: 81354 - protein, 276 aa, Zea mays
  misc_feature: Ceres CLONE 1566828
  misc_feature (1)..(274): Pfam Name: PsaA_PsaB Pfam Description: Photosystem I psaA/psaB protein
PRGGGRSRTSGSPGLQEFVSPLEKLSLIGGWLHLQPKWKPSLSWFKNAESRLNHHLSGLFGVSSLAWTGHLVHVAIPGSRGEYVRWNNFLDVLPYPQGLGPLLTGQWNLYAQNPDSSNHLFGTTQGAGTAILTLLGGFHPQTQSLWLTDIAHHHLAIAFIFLIAGHMYRTNFGIGHSIKDLLEAHTPPGGRLGRAHKGLYDTINNSIHFQVGRALASVGGSTSLRAQPMDSLPAYAFIEQNFTTQAGLITHNKNIAGVHPKKGLLVLEAFFFIRDT

SEQ ID NO: 81355 - DNA, 779 bp, Zea mays
  misc_feature: Ceres CLONE 1566830
  misc_feature: Encodes the peptide sequence at SEQ ID NO. 81356
  misc_feature (403)..(403): n is a, c, t, g, unknown, or other
agctccccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgcgaggggtggngagggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgataactgattctgctcaagctgataactaccgagaaaattttctcgcacatgaaaccagacagtattcttgagtttggtccatgggatctcccatcgggaaatttgcaatt

SEQ ID NO: 81356 - protein, 120 aa, Zea mays
  misc_feature: Ceres CLONE 1566830
  misc_feature (19)..(121): Pfam Name: IlvN Pfam Description: Acetohydroxy acid isomeroreductase, catalytic domain
  misc_feature: SWISSPROT Homolog: EC 1.1.1.86 Ketol-acid reductoisomerase
  misc_feature (9)..(9): Xaa is any aa, unknown, or other
MRSILRGVXRDLFPLLPEAFKGIKQIGVIGWGSQGPAQAQNLRDSLVEAKSDIVVKIGLRKGSKSFEEARAAGFTEESGTLGDIWETVSNSDLVLLLITDSAQADNYRENFLAHETRQYS

SEQ ID NO: 81357 - DNA, 853 bp, Zea mays
  misc_feature: Ceres CLONE 1566831
  misc_feature: Encodes the peptide sequence at SEQ ID NO. 81358
  misc_feature (759)..(759): n is a, c, t, g, unknown, or other
  misc_feature (784)..(784): n is a, c, t, g, unknown, or other
  misc_feature (831)..(831): n is a, c, t, g, unknown, or other
ctccccgcggtggcggccgctctagaactagtggatcccccgggctgcaggaattcgtctcacccctagaaaaaacccgcgcccgcgcccacgcccacggccgcaccaaccaccagccccgatttcctcctaatcaatcacaccccccaaaccaaaacccaaacagcacttctcctgcaatcgccgacgtcgccggaggcttcgccagccgaagcagcgccgaaggttgttttgcccctccctcgtccggccaagcagcccaggcgagcatgccttcgattgcgccaccgtcttcctccgtcgctgccctcacccgtcaaccggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgccaaaaagcacaaccattcgtggccaggaccatccggttgctgaccccgtactcccaatggattccatgattacgccagaaatcctctctgctaatgtggaacgtgttatagacatgtttgcagatgatgacactgatactgaacttgatttggatagcccgacagagggcttcgcatcaattgcagaagccattgaggacatacaacaaggaaaacttgtgattgttgttgatgatgaaatcagggaaaatgaangagatctgataatggctgccctccntggtaccccagaagctatggcttttatagtaggcatgggacaggaanttgttgtgtcagcatgaaagaa

SEQ ID NO: 81358 - protein, 192 aa, Zea mays
  misc_feature: Ceres CLONE 1566831
  misc_feature: SWISSPROT Homolog: EC 4.1.99.12
  misc_feature (164)..(164): Xaa is any aa, unknown, or other
  misc_feature (172)..(172): Xaa is any aa, unknown, or other
  misc_feature (188)..(188): Xaa is any aa, unknown, or other
MPSIAPPSSSVAALTRQPVQFFKGCSVSKETKGPVRSFFTANSKSTKVKSAGLKVASSFKNDGGYPAGGVSWKDDTLLPKSTTIRGQDHPVADPVLPMDSMITPEILSANVERVIDMFADDDTDTELDLDSPTEGFASIAEAIEDIQQGKLVIVVDDEIRENEXDLIMAALXGTPEAMAFIVGMGQEXVVSA

SEQ ID NO: 81359 - DNA, 816 bp, Zea mays
  misc_feature: Ceres CLONE 1566833
  misc_feature: Encodes the peptide sequence at SEQ ID NO. 81360
tggagctccccgcggtggcggccgctctagaactagtggatcccccgggctgcaggaattcgtctcacccctagaaaaacccgataagtagcaggggcagggagaacgaagacgacgacgacgtacgccggccgtaagtgagccgagagcccccgatataccagctagctagataaccagccagcgcgagcatggaggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcgtcggcgacgtcgtcgccctgctcgacgcgatcggcatccacaacaaggtgttcgtggtgggtcacgactggggcgccatcatcgcgtggtacctctgcctgttccggccggaccgggtggcggcgcttgtcaacaccagcgtcgccttcatgcgccacatcttcgtccgcgccgccgccgccgccgtcacgcccatcgactacttccaccgcacctacgggcccacctactacatctgccgcttccagacaacaatttgtcgtcggccggccggcctccggcgacgaccgatcgatcggtcactgcacggcgcacaacccgttgggggttgtcgtcgtttgaacacaacagggccaggtt

SEQ ID NO: 81360 - protein, 208 aa, Zea mays
  misc_feature: Ceres CLONE 1566833
  misc_feature: SWISSPROT Homolog: EC 3.3.2.10 Soluble epoxide hydrolase
MEAAAAAVRHRTVEANGISMHVAESGPDGGDGAPAVVFLHGFPELWYSWRHQMAHLAARGYRCVAPDLRGYGGTAAPPDVASYSAFHVVGDVVALLDAIGIHNKVFVVGHDWGAIIAWYLCLFRPDRVAALVNTSVAFMRHIFVRAAAAAVTPIDYFHRTYGPTYYICRFQTTICRRPAGLRRRPIDRSLHGAQPVGGCRRLNTTGPG

SEQ ID NO: 81361 - DNA, 869 bp, Zea mays
  misc_feature: Ceres CLONE 1566834
  misc_feature: Encodes the peptide sequence at SEQ ID NO. 81362
  misc_feature (869)..(869): n is a, c, t, g, unknown, or other
acccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatcccccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcaaagaccacttcccggtcttcctcccgtggctggtctgtccatctggctcttgaaacgatgggcagtccctggcaagttgcgggctggtggccccctcccccgtttctcgggaattgggttcccaagggatttaaagaagcgcccttgaaatccacttttctctaaaggaccgggtttgtggttaacccccggggaaagggggacttgccggcccctcttcccggggcccaaaaaccaattctttttctttagaccctggctccggaggcaacccatgtggtgcccccgaatctctaaaaaan

SEQ ID NO: 81362 - protein, 51 aa, Zea mays
  misc_feature: Ceres CLONE 1566834
  misc_feature (1)..(51): Pfam Name: AdoMetDC_leader Pfam Description: S-adenosyl-l-methionine decarboxylase leader peptide
MESKGGKKKSSSSRSSLMYEAPLGYSIEDIPPAGGIKKFSAAYSNCARKPS

SEQ ID NO: 81363 - DNA, 860 bp, Zea mays
  misc_feature: Ceres CLONE 1566836
  misc_feature: Pfam Name: Glu_synthase Pfam Description: Conserved region in glutamate synthase
  misc_feature: SWISSPROT Homolog: EC 1.4.7.1 Glutamate synthase (ferredoxin)
  misc_feature (627)..(627): n is a, c, t, g, unknown, or other
  misc_feature (643)..(643): n is a, c, t, g, unknown, or other
  misc_feature (644)..(644): n is a, c, t, g, unknown, or other
ccgcggtggcggccgctctagaactagtggatcccccgggctgcaggaattcgtctcacccctagaaaaacagtgcatacattgctcgtctgaggaactccaaacctggagttcctctaatctccccgcctccacaccatgacatttattctatcgaggatcttgcacagttgatttatgacctccatcagataaatcctaaagctaaagtatctgtaaagcttgtgtctgaagctggaattggaactgtagcttctggagtttcaaaggcgaatgcagacataattcagatatcaggtcatgatggtggtactggagctagcccaatcagctccatcaaacatgctgggggtccgtgggaacttggtcttacagaaacaaatcagacacttatacaaaatggattgagagagagggtagtacttagggtggacggtggattcaggagtggtcaagatgttcttattgctgctgctatgggagctgatgaatatggctttggttctgtagccatgatagctactggatgtgtcatggcacggatttgtcacacaaataattgtccagttggagtggctagtcagagagaagagcttcgtgcaaggtttcctggtgttcctggtgatnctgttactacttcctnncttgtgccgaggaggttcgagctgcattagcccagttggggtatgagaaagtggatgacatcattgggcgaacagattttgctaaaccaagcacatctcattggtgaaaagcagcacattgatcttggatactcctatcaaatgctggattgcctgaatggagcagctcccaaatagggagcaggacgtcaccctaatggccttggtcttgatgag

SEQ ID NO: 81364 - DNA, 837 bp, Zea mays
  misc_feature: Ceres CLONE 1566839
  misc_feature: Encodes the peptide sequence at SEQ ID NO. 81365
  misc_feature (572)..(572): n is a, c, t, g, unknown, or other
  misc_feature (656)..(656): n is a, c, t, g, unknown, or other
  misc_feature (732)..(732): n is a, c, t, g, unknown, or other
ctccccgcggtggcggccgctctagaactagtggatcccccgggctgcaggaattcgtctcacccctagaaaaaacccacccccacaaagaagccgccccccgagttgacggccatggcgtcagcggcgaacaccatgccaggcaagtctgttgtcctcctctccctcgtcacgcttctcgtcgtcctcatctccgccgcggagagctacgacggccggtatgccgtctcgcactcggccatggcgcgccgctcccgcctggggacccggcacgcgcatcaccgccggacaacggtgccgcaccggtacgtgctcgcggagaagagcagcgcgcccggcggcggcggccccaagaacaacagttcgccggcgaaggccaacgccagctcgccggcgccggcgcctccggccgccgagcagactggccggcaccaccgcagccacaagaaccgggtgcgcaactggatcatcggcttcgtggtggggtccctcgccggcgtcatctccgggatggtgctgtcggtgctgttcaggctggcgctcaactgcatccgcgggcggtaccggacgcngtctggcgtgatgatcttcaccccgaagctgatcaggcggccggagcacctcgcgttcctggagaaggagacgggctggcgtcnctggccctgatccggcccggcgggtgcgggggaggtttacaaggcgcaactgccccttgaacccggaagggggaanacccccctttatcgccatcaagaagtcaagaagcaggggggaacccccccaacaaaaactgaggaacaagaaaagcccgcacctggaaaaaaggtcccggcaaaa

SEQ ID NO: 81365 - protein, 183 aa, Zea mays
  misc_feature: Ceres CLONE 1566839
  misc_feature (153)..(153): Xaa is any aa, unknown, or other
  misc_feature (181)..(181): Xaa is any aa, unknown, or other
MASAANTMPGKSVVLLSLVTLLVVLISAAESYDGRYAVSHSAMARRSRLGTRHAHHRRTTVPHRYVLAEKSSAPGGGGPKNNSSPAKANASSPAPAPPAAEQTGRHHRSHKNRVRNWIIGFVVGSLAGVISGMVLSVLFRLALNCIRGRYRTXSGVMIFTPKLIRRPEHLAFLEKETGWRXWP

SEQ ID NO: 81366 - DNA, 838 bp, Zea mays
  misc_feature: Ceres CLONE 1566840
  misc_feature: Translation starting site: 239
  misc_feature: SWISSPROT Homolog: EC 2.7.7.27 Glucose-1-phosphate adenylyltransferase
  misc_feature (662)..(662): n is a, c, t, g, unknown, or other
ggagctccccgcggtggcggccgctctagaactagtggatcccccgggctgcaggaattcgtctcacccctagaaaaaactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttggggtggtggtaccgggactcagcttttccctctcacaagcacaaaggccacccctgctgttcctattggaggatgttacaggcttattgatatcccccatgagcaactgtttcaacagtggcatacacaagatatttgttatgactcagtncaactcagcttctcttaaacgtcacattcatcgtacctatctgggagggggggatcaacttcactgatggaatctgtttgaggtgctggctgccacacaaatgcctgggaagggctgcttgtttggttccaaggcacatcagaacgccgttagaaaaattatcctgggtactggac

SEQ ID NO: 81367 - DNA, 816 bp, Zea mays
  misc_feature: Ceres CLONE 1566845
  misc_feature: Encodes the peptide sequence at SEQ ID NO. 81368
ccccgcggtggcggccgctctagaactagtggatcccccgggctgcaggaattcgtctcacccctagaaaaaccccccccccccccgtctccactctcctccaaccagatggaaccccacacgccgcataaatcccccgctgacacccaatcaagcaaatcctcgcttccctcccccacgtcgcgtccgatcggcgacggtgcgccatgtcgatgctggacaccttcttcagcaagggcggcggcggcggcttccgcggcgccaagtgcaagacgctgctgaagctgtcgatcccgcggataaagctgctgcggaaccggcgggagctgcagctgcgccagatgcgccgggacatcgccaagctcctaaaggccggccaggaggccactgcccggatcagggtggagcacatcatccgggaggagaacatgatggccgcgcaggagatcctcgagctcttctgcgagctcatcgcggttcgcctgcccatcatcgaggcccaaaaggagtgtcctattgatctcaaagaagcaatatcaagtgtctgttttgccgctccaagatgtgcagatctacctgaactgatgcaagttcaaatgatgtttgcaactaaatatgggaaggaatttgtcgctgcagcttcagagttgatgcctgattgtggggtcaatcgtcagataattgaattgctttctattcgtcctcctcctgctgatgcaaagttgaaactgctgaaggagatagctgacgaacatgaagttgattgggatcccatcgagacggagaacgaatttctcaacctcatgaagatctatg

SEQ ID NO: 81368 - protein, 203 aa, Zea mays
  misc_feature: Ceres CLONE 1566845
  misc_feature (27)..(148): Pfam Name: DUF292 Pfam Description: Eukaryotic protein of unknown function, DUF292
MSMLDTFFSKGGGGGFRGAKCKTLLKLSIPRIKLLRNRRELQLRQMRRDIAKLLKAGQEATARIRVEHIIREENMMAAQEILELFCELIAVRLPIIEAQKECPIDLKEAISSVCFAAPRCADLPELMQVQMMFATKYGKEFVAAASELMPDCGVNRQIIELLSIRPPPADAKLKLLKEIADEHEVDWDPIETENEFLNLMKIY

SEQ ID NO: 81369 - DNA, 836 bp, Zea mays
  misc_feature: Ceres CLONE 1566846
  misc_feature: Encodes the peptide sequence at SEQ ID NO. 81370
  misc_feature (836)..(836): n is a, c, t, g, unknown, or other
ggagctccccgcggtggcggccgctctagaactagtggatcccccgggctgcaggaattcgtctcacccctagaaaaaaaagaaaatccccgtccgcactgcgagcgcgcacccgctctcgtgccgctactggcgaccgccgccgccgccctaggccacgtgctcggcagctcatcgaagcttgttgcggcagtgaacccgtctcccccagacgcgcagcaccaaaaaccctaccaccaattctagaccctcccggctctagcttccccacactccgtcgcgggctcgtgggctccggcggtggctagattcagggtgcgggagtcggcgtcgtcgtccgagatgccatccttctctgccggcgcctcatcgcagaagcagcagttcgcgagagggaggcagctgattcgacaacagcgcaagtcgctccccattgcgtcagtggagaaaaggctagttgaggaggtgaggaataacgacacactgataattgttggtgagactgggagtggcaaaactactcagcttccacaatttttgtatgatggtgggctttgtcaggatgggaaaagtcattggcatcactcagcctcggagagttgcagctgtttcagtagcaaagcgtgtagcggagggatgcaatgaccctattgggcaaaaagggtgggatactccatccaaatttgaagaattccacgttgcaattgcaccaaggaatttaaatacctggacctgaaggggttggccttccgaaagggaaaccacctttttgggaatccacccccttaatctaaaagtaacgggggggttaataggttctgtattaaaaaaaagan

SEQ ID NO: 81370 - protein, 100 aa, Zea mays
  misc_feature: Ceres CLONE 1566846
MPSFSAGASSQKQQFARGRQLIRQQRKSLPIASVEKRLVEEVRNNDTLIIVGETGSGKTTQLPQFLYDGGLCQDGKSHWHHSASESCSCFSSKACSGGMQ

SEQ ID NO: 81371 - DNA, 863 bp, Zea mays
  misc_feature: Ceres CLONE 1566847
  misc_feature: Encodes the peptide sequence at SEQ ID NO. 81372
  misc_feature (592)..(592): n is a, c, t, g, unknown, or other
  misc_feature (593)..(593): n is a, c, t, g, unknown, or other
  misc_feature (675)..(675): n is a, c, t, g, unknown, or other
tccccgcggtggcggccgctctagaactagtggatcccccgggctgcaggaattcgtctcacccctagaaaaagtcaagtcatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctcccagccggcggcaacaccaacatcagcgacggccctcagacggggctcaaggtnnctcgcgaaacgcagctcagctccggtcgcgtcgttggcgtcatgctcatgtccgacggccagcaaaaccggggggagccagncgccaacgtcagaatcggaacgtggcggtgtgacactttcggggttggggcggaacaacaccccccgggcttaacccggggccaagaaaaaaatgggagggaaccttctccgttttaaaaaaggaaaattggggaagtgggcttttcccagggcctcccgggcgtttcacggggggttggcgagcccc

SEQ ID NO: 81372 - protein, 216 aa, Zea mays
  misc_feature: Ceres CLONE 1566847
  misc_feature (63)..(216): Pfam Name: VWA Pfam Description: von Willebrand factor type A domain
  misc_feature: SWISSPROT Homolog: EC 6.6.1.1 Magnesium chelatase
  misc_feature (151)..(151): Xaa is any aa, unknown, or other
  misc_feature (178)..(178): Xaa is any aa, unknown, or other
MSFSDDEPIIPSPNSGPRPTPIVPGRVQLVSKNNNMAPLEENTQKVLLELTGGDSTSDRSGLDLVAVLDVSGSMQGEKIEKMKTAMKFVVKKLSSIDRLSIVTFLDTANRICPLRQVTEDSQPQLLKLIDALPAGGNTNISDGPQTGLKVXRETQLSSGRVVGVMLMSDGQQNRGEPXANVRIGTWRCDTFGVGAEQHPPGLTRGQEKNGREPSPF

SEQ ID NO: 81373 - DNA, 753 bp, Zea mays
  misc_feature: Ceres CLONE 1566848
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (716)..(716): n is a, c, t, g, unknown, or other
  misc_feature (718)..(718): n is a, c, t, g, unknown, or other
  misc_feature (720)..(720): n is a, c, t, g, unknown, or other
  misc_feature (722)..(722): n is a, c, t, g, unknown, or other
  misc_feature (723)..(723): n is a, c, t, g, unknown, or other
nnnnnnnnnnnnnnnnnnnnnnnnnnnnnnnnnnnnnnnnnnnnnnnnnnnnaaaaaaaannnggtttacccccnnnnnnggnnnnnnnnaaaaacggaactcaccgcgtggcggccgctctagaactagtggatcccccgggctgcaggaaattcgtctcacccctagaaaaaaaccagctccaacccaaccagaaccagctcgccccggccgccgcgaccgtcccccctcatcgactcgaggcaacgaagcggccggatgggagcagcagcctgaccctgacgcgatgagccccgcccgccatgctgctgccccgtttgcttcggccgcgcccaagttggtttccccccttttgccccggggaaagggcccttcccaaaagttttttccccgccggggggttggggccccccccccaaaaagggggggggaaaaatttctgggggcgcccccggggttttaaaggggtccttaaaaacccccaaaaaaatttccctttttttttttcccccccaaaaaagaggggtttccccccaaaaaaaaaaagcccccccgggggggggtttttttttcccccaaaaaaaaaaaccccccccccaaaaaaaaaaaaaatttttttccccccccccccaaaaaaaaaaaaaaaggccccccccccctcttccctccgggagtgaaaaaaaaaaaaaaaaaaaacaannntttttttttcttntntncnnaaaaaaaaaaaaaacacttcttttttgggg

SEQ ID NO: 81374 - DNA, 869 bp, Zea mays
  misc_feature: Ceres CLONE 1566849
  misc_feature: Encodes the peptide sequence at SEQ ID NO. 81375
gagctccccgcggtggcggccgctctagaactagtggatcccccgggctgcaggaattcgtctcacccctagaaaaagcgcagcagcagacggacgccaggtttttttccttttagaccgcaacctcaaaaccctagcttgtccctcctgctcccagatctcttccactcggccactccctagcacatcaaaccctagctccgcccagcccccaaccatgtcggcgatgatgcaaccgcagatcatcctgctcaaggagggcacggacacgtcgcaggggcgcgctcaggtggtgagcaatatcaacgcgtgcacggcggtgggcgacaccgtgcggaccacgctggggcctcgggggatggacaggctcatccacgacgacaagggcggagtcaccatctccaacgacggcgccaccatcatgcgcctcctcgacatcgtgcaccccgccgccaagatccttgtcgacatcgccaagtcgcaggactccgaggtcggcgatgggacaactactgtggtgcttctagctgcagatttcttaaaggaagcaaaaccttatatcgaggacggggtgcacccccacagtctaattcgcagttatagaactgcagggcaaatggccattcaaaagggtaaaagagctggccgttagcatagaaggaaaaagcctttaaagaaaaaatcacggttagccaaggggcttgttaaaaaatttttttaaaacttaaaggggggaaaaaggaattcttgccttcaggggtggggaagcggcccctgcccttaaaaaggaaaaagggtttaaccttttggggaataaaaaagttcctggggggcccagaagaaaactttttttggggaaaaggggtgcc

SEQ ID NO: 81375 - protein, 144 aa, Zea mays
  misc_feature: Ceres CLONE 1566849
MSAMMQPQIILLKEGTDTSQGRAQVVSNINACTAVGDTVRTTLGPRGMDRLIHDDKGGVTISNDGATIMRLLDIVHPAAKILVDIAKSQDSEVGDGTTTVVLLAADFLKEAKPYIEDGVHPHSLIRSYRTAGQMAIQKGKRAGR

SEQ ID NO: 81376 - DNA, 879 bp, Zea mays
  misc_feature: Ceres CLONE 1566850
  misc_feature: Encodes the peptide sequence at SEQ ID NO. 81377
ctccccgcggtggcggccgctctagaactagtggatcccccgggctgcaggaattcgtctcacccctagaaaaagctgctctggtctttcccaccaccgcgaacacctggcaatggcggcccccgccccgtcggccacctcccagatgtcctcaagcggcctcctttcttactgagctcacccaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccgggatctaggccctgagcaatggcagcggcggtggcgccgccgctctgcacctggctcgtcgccgcctgtctctccgcggcctgcggcgatggcgagaaggagaatgaacgcaggcaccgcggtggcggcgtaggggggtttcttcggctcgcgccgccgcctcggctcagggcgccgcggcgtggggcgctctggaatggccatgtctgttgccttgcatcctgaaaggacagctgtggaaaataagaaacctgatatgaaacagagggagagtggtttgtcacttggcattgggtgtaagtgacgccactaggggcatgattcctgatgaaattcttacaataacttttttaagggggtaatcagtgggaattaaccgaagaatagaaggcatttggatttgttccccacctattcccaccgggaattttaagttccctttatccggggggtaaaaaaaaagggaggagggtttttttttgttaaaaaaataccgccgagagaaacctttgtcttttattta

SEQ ID NO: 81377 - protein, 68 aa, Zea mays
  misc_feature: Ceres CLONE 1566850
MAAAVAPPLCTWLVAACLSAACGDGEKENERRHRGGGVGGFLRLAPPPRLRAPRRGALWNGHVCCLAS

SEQ ID NO: 81378 - DNA, 883 bp, Zea mays
  misc_feature: Ceres CLONE 1566851
  misc_feature: Encodes the peptide sequence at SEQ ID NO. 81379
  misc_feature (843)..(843): n is a, c, t, g, unknown, or other
acccgcggtggcggccgctctagaactagtggatcccccgggctgcaggaattcgtctcacccctagaaaaaaggggcacacacgccacggcagccgacaccacacgacactccccgagcacacacgccgcaatagcaccacccccagacccaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatcttcaagaaggagttcggggaagatgccaagggtctgggaccgcgaagaaggtcgttcatcatccccgaacacctcatctttccccaagcgacgagcgccgccaaacggcaaacgtcgaaaatcctcaggggaccttctggtccgggagcacgaaacattcaaggaactttcttatgaaaagttaagggaacctttctgcgaatattttagggggcttaaatcgaggaacttaccagggggggtgtccggccacacngttttggcacccttgccctccagggaaaaggcgccaccgt

SEQ ID NO: 81379 - protein, 163 aa, Zea mays
  misc_feature: Ceres CLONE 1566851
  misc_feature: SWISSPROT Homolog: EC 4.2.1.33 3-isopropylmalate dehydratase
MASSISAAAKASAAFAQKKELAAPAPHRAGSSRRTKPCRVRAVASPARTPRAPSSTGSVKTAMTMTEKILARASERAALEPGENVWVDIDVLMTHDVCGPGTIGIFKKEFGEDAKGLGPRRRSFIIPEHLIFPQATSAAKRQTSKILRGPSGPGARNIQGTFL

SEQ ID NO: 81380 - DNA, 830 bp, Zea mays
  misc_feature: Ceres CLONE 1566853
  misc_feature: Encodes the peptide sequence at SEQ ID NO. 81381
aagctggagctcccgcggtggcggccgctctagaactagtggatcccccgggctgcaggaattcgtctcacccctagaaaaaaaaaaaaaaactgtcagccgagccaagttccgaatgggggtggcttggcttggctggctacaagtcactcaaattgaaataagactgaaacggacaaaggcaaacacagcaagcaaagcaggaatcggaggtagacgacgaccaccacggggataacaaccaaacctcccaaataccatccacgaacgaaagggaaggtcgtttaggcggcgcggcgaggccgtgggctatggaccccaacggcggcggcgacaacatcctcggcgatccccttcttcccctctcgcagtccagcaagcagcagcaggatccttttggcgggggtctcccaactactttgggcgggcccctggcccccggaaactcccgggggaatggaaaatccccccctcttcctcctgggcgtccaaaatcccccggaaatttccccatatttgggatttttttgccaacccaaaaaccgataccctaaagggggcccccggggaaaaattcaaaaaccccccccgggtgccccccccccttaaaaaccctgggtctcgggaacgcccctggaaaaaaaacccccccgtgttggggggctttttttttctggaaaaaaaccatatctggggggggcccctcccaaaaatcccgcatattatagggggggggggcccttctataaaaattttggggcgcgccaaaaaaaaaaaatccctttatgggagggggaggagaggggggcccctcccccccggaaaaaaaa

SEQ ID NO: 81381 - protein, 80 aa, Zea mays
  misc_feature: Ceres CLONE 1566853
MDPNGGGDNILGDPLLPLSQSSKQQQDPFGGGLPTTLGGPLAPGNSRGNGKSPPLPPGRPKSPGNFPIFGIFLPTQKPIP

SEQ ID NO: 81382 - DNA, 864 bp, Zea mays
  misc_feature: Ceres CLONE 1566856
  misc_feature: Encodes the peptide sequence at SEQ ID NO. 81383
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (457)..(457): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (490)..(490): n is a, c, t, g, unknown, or other
  misc_feature (492)..(492): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (500)..(500): n is a, c, t, g, unknown, or other
  misc_feature (501)..(501): n is a, c, t, g, unknown, or other
  misc_feature (503)..(503): n is a, c, t, g, unknown, or other
  misc_feature (507)..(507): n is a, c, t, g, unknown, or other
  misc_feature (508)..(508): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
ccccgcggtggcggccgctctagaactagtggatcccccgggctgcaggaattcgtctcacccctagaaaaatcatgataacttgacggatcgcacggccttcgtgccggcgacgcatcattcaaatttctgccctatcaactttcgatggtaggataggggcctaccatgaagctcggggtggaggtgaggagggacggcgagggcctggtgacggctcaagaggtcgaggcgaaggtgaggtgggtgatgcaggactccgacggcgcgcgggagctcaagggacgcgcggaggcggcgagggcgagagcggccgaggcgctggcggaagggggtccgtcgcgtgcagctttcctcgagttcgtcctagacctgttggcttccgaaggcatggttaacgtttgaagtttgacgagtgtatttacttgtaataaaaaacaataattttgtnnnnnanannnnnaaannnaaaaaaaaaaaaaaaaaaaananaannnnannanaaannannnnnnnnaannnnnnnaannnnnnaaaannnaaaaattttttttgaaatatttaaaaaaaacccggtggaccaaaaaaaaaatttttttgagttaggggagtggaaaaaaaaacggggggggtttttaaccggggggcggggggttggccattttccgccaaattcctcaaacttacaaaagggttttcccccccaccccgagaaaaccaggggaacccccccccccggggggtttaaaaaccccccctttaaacggggaaggtgtttccccccccccggtgcccgcccccccaagggccttaaaaccccttccttgcccttttcacgggggtacccccccgggggccttggaa

SEQ ID NO: 81383 - protein, 78 aa, Zea mays
  misc_feature: Ceres CLONE 1566856
MKLGVEVRRDGEGLVTAQEVEAKVRWVMQDSDGARELKGRAEAARARAAEALAEGGPSRAAFLEFVLDLLASEGMVNV

SEQ ID NO: 81384 - DNA, 848 bp, Zea mays
  misc_feature: Ceres CLONE 1566860
  misc_feature: Encodes the peptide sequence at SEQ ID NO. 81385
ccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgctgtctgataatcgaccagttccccagtcttgctccttgcactcgtccctcctccatctccagccattgtgttctgattcacctgctcccaatggctgtttctttctgctgctgatgcttccccggtctcagctttcggggtttgagggctattaagagccggctttgagatcaacattctcttgaggcaccctgtcttttgtggaccctcccggggtggggggttttggggggcctctccaggggcccagattggactttcgggttcttgggattttgccccgggt

SEQ ID NO: 81385 - protein, 50 aa, Zea mays; identical to SEQ ID NO: 64299
  misc_feature: Ceres CLONE 1566860
  misc_feature (1)..(50): Pfam Name: AdoMetDC_leader Pfam Description: S-adenosyl-l-methionine decarboxylase leader peptide

SEQ ID NO: 81386 - DNA, 767 bp, Zea mays
  misc_feature: Ceres CLONE 1566861
  misc_feature: Encodes the peptide sequence at SEQ ID NO. 81387
  misc_feature (371)..(371): n is a, c, t, g, unknown, or other
  misc_feature (399)..(399): n is a, c, t, g, unknown, or other
  misc_feature (400)..(400): n is a, c, t, g, unknown, or other
ctccccgcggtggcggccgctctagaactagtggatcccccgggctgcaggaattcgtctcacccctagaaaaacacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcngccgtcgcgatctccgaggaggagcgcnncacacgcaggcagatgcagtccatcagtgcgtcgttggcgtctctgacgcgtgaaaccgggccgaagtgggcaagggcgacccggcccgcaaaggaaaagcctccccccaaggcgcgccatctaccccaagggggacccagaaggcacggaaacccggcgcgcccgggaattggccggtaagggaaagttcccccaaaggttccccttgggggtaaaaaaacccttttgcccttggggaggcttgttaaaacgaggggcctttaaaattaaagaaaggggggggggttttatttaaaaaacaccccccgggggggctttgtgggggaacacttttttttggggggggccaaaaaaacaggggggggt

SEQ ID NO: 81387 - protein, 96 aa, Zea mays
  misc_feature: Ceres CLONE 1566861
  misc_feature: SWISSPROT Homolog: EC 4.1.1.49 Phosphoenolpyruvate carboxykinase (ATP)
  misc_feature (70)..(70): Xaa is any aa, unknown, or other
  misc_feature (79)..(79): Xaa is any aa, unknown, or other
MATPNGLARIETTGKKKQDNGVWYDDSSAPVRAQTIDELHSLQRKRSAPSTPKRSAPTTPIKGGAHSPFXRRDLRGGAXHTQADAVHQCVVGVSDA

SEQ ID NO: 81388 - DNA, 869 bp, Zea mays
  misc_feature: Ceres CLONE 1566862
  misc_feature: Encodes the peptide sequence at SEQ ID NO. 81389
ggagctccccgcggtggcggccgctctagaactagtggatcccccgggctgcaggaattcgtctcacccctagaaaaaggcactcccctcgcctgctccacgacgcttatgcgctcgcgccccgctctcgccgcccacctccggcgcctgctcctcctctctccctccgcccacctcatcatcatccgccgcgccatggcatccgccgccgccgcgcaggcgcagccaggtggcgccccgccggcgaccgcagagtacgaggaggtgctggggcggctctcctcgctcatcacgcagaaggtgcgcgcgaacagcgccaaccgcggcaaccagtgggacctcatggagcactacgtcaagattctggagctggaggagtcgatcgcgcggatgagagtgattcacgtcgcgcggaccaaggggaagggttccacatgcacattcaccgagtcaatcctgcgatcgtgtggcttccatactgggctgtttcactcagcacattttgatggatgttagagagcgatttcacctagaaggggtaaatatttctgaagaagaaattttggaaggaccttctggggggggcggaaccaacttgaaggagaaaacttgatgatgaaatccccatggccagcctaattttgggtccttccccttgcccccaatccaaaataatttccgccttaaaaaggaaaaatttgccttttcctaaaggttgggcccggggggggaaaattttgacccacaaaaaagggggttaaaagcaccccggaagttttttgggagaaacctccccccggggggaatgaaaaaaaatgggaaaatttctggggggaaaaaaccttgtggggaaaaaccccgcgaggaag

SEQ ID NO: 81389 - protein, 135 aa, Zea mays
  misc_feature: Ceres CLONE 1566862
  misc_feature: SWISSPROT Homolog: EC 6.3.2.17 Tetrahydrofolate synthase
MRSRPALAAHLRRLLLLSPSAHLIIIRRAMASAAAAQAQPGGAPPATAEYEEVLGRLSSLITQKVRANSANRGNQWDLMEHYVKILELEESIARMRVIHVARTKGKGSTCTFTESILRSCGFHTGLFHSAHFDGC

SEQ ID NO: 81390 - DNA, 819 bp, Zea mays
  misc_feature: Ceres CLONE 1566863
  misc_feature: Encodes the peptide sequence at SEQ ID NO. 81391
ctcaccgcggtggcggccgctctagaactagtggatcccccgggctgcaggaattcgtctcacccctagaaaaagcgctcgtccctgctcgcggacggcggcctcgatccgcgcgcagggacctatggaaggtgagccgctgccgcatacatggaaggccccgcggccgtttaccccgccgtctctctcgatccccaaatctctcgcgctctatggaagtcgctctataggatccccaaatcgacggaatcactgctcgcggacggcggcctcgatccgcgctcgcgctctacatggaaggcctcgatccgcgctcgcgctctacatggaaggaggtgacagcggcgtttttttctgattgcgcacggactcgcgctcgcccttactcctccgcctccactagctgacccggctctagatctggacctcaagttcgagtcctcgctcaaggccatggtgctactgcagcgctccgtcgcggcagtgggagctacccttcaaggacgacatctcctccatggaggacaaggtggatgagaggctcagcaaggccatggtggtggtggcgtggtcgacgtatcggcatgacagcatcggatgagtggcgccgacggggtgctaggcggaagagcgtcaccatcagctcgaagttgtcgtagagccagaactgcatctacctccacggcaccatcggtaaggacctcttcacacacaagtaggtcgtccagctctctatgaagatccggggccagagtcgacgatggagtccgagagggcgccatctctcctccctcgctcgttggccaatggaaccgcccc

SEQ ID NO: 81391 - protein, 41 aa, Zea mays
  misc_feature: Ceres CLONE 1566863
MRGSARPWWWWRGRRIGMTASDEWRRRGARRKSVTISSKLS

SEQ ID NO: 81392 - DNA, 885 bp, Zea mays
  misc_feature: Ceres CLONE 1566868
  misc_feature: Encodes the peptide sequence at SEQ ID NO. 81393
ctggagctccccgcggtggcggccgctctagaactagtggatcccccgggctgcaggaattcgtctcacccctagaaaaaacgacgcccgcgacaaatccctgcgcgacggcatcttcgcctcccatcccctcccagcttcccctcccactccggccctcacacaaattgcccctcttcttgtcctcctctttacacgctgccgaccacggctgccgccaaccacccgccccaccgctgccgagtgctagccatttggagctgccgcgccatggcgtccgtggccgccaccaccacgctggcaccggcactcgcgccccggcgccgggcgcggccagggagcgggctgctgccgccgcgccgggcctcggccgtccgctgctcgctcgacagtaacgtctccgacatgggcgtcaacgctcccaaagggttattcccacccgagccagagcactacaggggcccgaagctcaaggtggccatcataggggcaggccttgcgggcatgtccaccgctgttgagctcttggaccagggccatgaggttgatttgtacgagtcccgtccgtttatcggtggtaaagttggctcctttgttgacaggcaaggaaaccatatcgagatggggctgcatgtgttcttcgggtgctacagcaatctcttccgcctcatgaagaaagttggcgctgataataatctgctggtgaaagaacatacccctacttttgtaaataaaggggggcacgattggtgaaacttgatttttcggttcccgggagggaagctccctttacatgggcatttcaaggcattccttaagaaactaatcagccttcagggttttttgaataaaccaagaaaatggccggttgctccttggcctttt

SEQ ID NO: 81393 - protein, 160 aa, Zea mays
  misc_feature: Ceres CLONE 1566868
  misc_feature: SWISSPROT Homolog: EC 1.14.99.30 Carotene 7,8-desaturase
MASVAATTTLAPALAPRRRARPGSGLLPPRRASAVRCSLDSNVSDMGVNAPKGLFPPEPEHYRGPKLKVAIIGAGLAGMSTAVELLDQGHEVDLYESRPFIGGKVGSFVDRQGNHIEMGLHVFFGCYSNLFRLMKKVGADNNLLVKEHTPTFVNKGGHDW

SEQ ID NO: 81394 - DNA, 842 bp, Zea mays
  misc_feature: Ceres CLONE 1566870
  misc_feature: Encodes the peptide sequence at SEQ ID NO. 81395
tcaccgcggtggcggccgctctagaactagtggatcccccgggctgcaggaattcgtctcacccctagaaaaactctataaaaagcgacccacggtcagtcgggactacccgctgagttgaagcatataaataaacggatgagaagaaacttacgaggattcccctagtaacggcgagcgaaccgggagcagcccagcttgagaatccggcggcctcgccgcccgaattgtactctggagaggcgtcctcagagacggaccaggaccaagttctctggaaagggacgcctgggagggagagagccccgtccggcccggaccctggtcgcaccactaggcgccgacaacgagacgggttgtttgggaatgcagcccatatacgggcggtaaactccgtccaaagctagatactggcgagagaccgatagcggaacaatgaccgcgagggcaagatgaaaaggactttgaaaagagagtcaaagagtgcttgaaattgccaggagggaagctgatgggggctggcgaagcccaactctcgcttcgctcacttaatttatcaccattccctcagttattctaggagcttaggaccatagcacagtattatccgctctcccccgattacacgactacttcccgtgcctgcgaacatcatctggattgcttcgatcttccattgtcacaaataaacatttgagcgccgcgtttggaattccaccggaatccatcccaattgtttggccgcccccttgggttggcccgaccggccgaacttattggggcgggccggccaaatttcgggggaacctccccccgtggagaggggagggtcccccccggag

SEQ ID NO: 81395 - protein, 39 aa, Zea mays
  misc_feature: Ceres CLONE 1566870
HRGGGRSRTSGSPGLQEFVSPLEKLYKKRPTVSRDYPLS

SEQ ID NO: 81396 - DNA, 804 bp, Zea mays
  misc_feature: Ceres CLONE 1566876
  misc_feature: Encodes the peptide sequence at SEQ ID NO. 81397
ccgcggtggcggccgctctagaactagtggatcccccgggctgcaggaattcgtctcacccctagaaaaaagcccgcaatacaaaatccggaggaactcccaggaggcgaaaagcagatccgtctcccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatggagaagctccttaaattggctgacgctgcgaagctcaaggagaagattgagaagatgtttaaaggtgaaaagataaatagcacggagaacaggtcagtgcttcatgtagctctgagggctccaagagatgcagtcataaacagtgatggggtgaatgtggtccctgaggtttggagtgttaaagataaaatcaagcagttttcagagacttttaggagtggatcatgggttggagcaactggaaaaccgttgacaaatgttgtgtcagttggaataggtggtagctttcttggccctctatttgtgcatactgcactccagaccgatccagaagcagcagaatgtgccaaaggccggcaactgagattccttgcaaatgtttgatccgttgacgttgcccgaaccattaaggatttggatcagaaaacacctcgggtggtgggtggtatccaat

SEQ ID NO: 81397 - protein, 189 aa, Zea mays
  misc_feature: Ceres CLONE 1566876
  misc_feature: SWISSPROT Homolog: EC 5.3.1.9 Glucose-6-phosphate isomerase
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANV

SEQ ID NO: 81398 - DNA, 865 bp, Zea mays
  misc_feature: Ceres CLONE 1566877
  misc_feature: Encodes the peptide sequence at SEQ ID NO. 81399
  misc_feature (781)..(781): n is a, c, t, g, unknown, or other
  misc_feature (865)..(865): n is a, c, t, g, unknown, or other
tccccgcggtggcggccgctctagaactagtggatcccccgggctgcaggaattcgtctcacccctagaaaaaaagcgaaaggagcgcagagtttccacattgtaccatggaccgcggcatcaagaggagcgtcgcggcagcgggcggcggcccgccaccgcccaaggtgtaccgcgtggagcccagggacttccgggagctcgtgcagaggctcacgggcgccggtacgcccgccgccgccgccgctccggggccggcgcaccggagggcgacgctgaagccggccatggccgcggagagcaggcgcgcacaggccgctgcggccgtgcccgtggcggccggggcagagcagttcgactacgcggcgtcatggttctccgcgccgctgctgagccccgggtacggcgcgccgggcttcggcggcggcggcggcggcggccaccagcaccaggggaacactggctctctgttttagggccctaggtagaagcagagtccctgtatagctccgtcgtcacttgttcgtgcttctctggctctttttgtcttgcgtttcgggcatgactatacatacacaaccttcttgcgccgcgtataaaattcgaccaagaagttatacgggtagtgttcacttctgtactttctgatagaacgataaataaatctgttttttttaaaaaaaaaccactgctcgcactcactcacagtcgccgccgctgcccagtgcccactgctcgccctagaggaaaccctaaaagaaaaaaggggaaaagggcaaanggagcgcaggcaggcatgggctcccctttcttccctccccgccgcggggggggcttcgtgctcctggcccctgcttcgccggan

SEQ ID NO: 81399 - protein, 122 aa, Zea mays
  misc_feature: Ceres CLONE 1566877
  misc_feature (15)..(45): Pfam Name: VQ Pfam Description: VQ motif
MDRGIKRSVAAAGGGPPPPKVYRVEPRDFRELVQRLTGAGTPAAAAAPGPAHRRATLKPAMAAESRRAQAAAAVPVAAGAEQFDYAASWFSAPLLSPGYGAPGFGGGGGGGHQHQGNTGSLF

SEQ ID NO: 81400 - DNA, 819 bp, Zea mays
  misc_feature: Ceres CLONE 1566878
  misc_feature: Encodes the peptide sequence at SEQ ID NO. 81401
ctccccgcggtggcggccgctctagaactagtggatcccccgggctgcaggaattcgtctcacccctagaaaaaaccaactcacatcacacctcaccttccactccagaagaagaagccagaccggaatcccgagagccctgcccctgctccctcggttcctcctccgttgggcgtttggccgccgggggtggtgggccgagaccgagatgatatcgtggaacgatgtatacacggtgctgaccgcgatggtgcccctgtacgtggccatgttcctggcgtacgggtcggtgcggtggtggcgcatcttcacggcggaccagtgctccagcatcagccgcttcgtggccatcttcgccgtgccgctgctgtccttccacttcatctccaccagcgacccgtacgccatgaacctccggttcctggacgcggacacgctgcacaagctggtcgtcctcgcggggctggccgcgtgctcacacctgccctccaggctggcggcgccgcagctggactggtccatcacgctcttctccgtgtcgacgctgcgcaacacgctggtgatgggcatccctctgctgatcgacatgtacggtccctactccggatccctgatcgtgcaggaggatggtgctccagtgcatcacctggtacacgctgctgctgatccctcttcgagttccgcgccgcgcggatgctcataggggagcaattcccggaccctgcggaggtcatctcgtttctgcacgtgggacccgtacatgatgttcgctggaggaaccggccctccgagaacgtagtccaaagtggcttcacgacg

SEQ ID NO: 81401 - protein, 164 aa, Zea mays
  misc_feature: Ceres CLONE 1566878
  misc_feature (9)..(164): Pfam Name: Mem_trans Pfam Description: Membrane transport protein
MISWNDVYTVLTAMVPLYVAMFLAYGSVRWWRIFTADQCSSISRFVAIFAVPLLSFHFISTSDPYAMNLRFLDADTLHKLVVLAGLAACSHLPSRLAAPQLDWSITLFSVSTLRNTLVMGIPLLIDMYGPYSGSLIVQEDGAPVHHLVHAAADPSSSSAPRGCS

SEQ ID NO: 81402 - DNA, 762 bp, Zea mays
  misc_feature: Ceres CLONE 1566880
  misc_feature: Encodes the peptide sequence at SEQ ID NO. 81403
  misc_feature (408)..(408): n is a, c, t, g, unknown, or other
ctccccgcggtggcggccgctctagaactagtggatcccccgggctgcaggaattcgtctcacccctagaaaaaaatcctcccgccgcggcgacgccttcccctccctccttcctccgtcccatgctccgccgctgacacgttggcccgacttaaccttacgatggccgccgcctccgccatcaccgccgtctccggcgttgtgcttccccaaaccttcctatcccaccggtcgccgccgccgcaggtcctagccgtggcctcctcattccaccggctctccttgtgcgcttcccatcgccgaatcactcacataatcccccgcgctgatgcaagtgccgaagctggagaaccggagcctgtcactacttcagctgaatccgaagaggaggtggccgaagggtctgtncgctgtggcggaaggccgagggaaccgacgccccccgagcaagcccaaaagggttaagttccggcgaaaataaatttggggatttcttaaaaaaaaaaaccccttttttttttttttttgggggggcggtcttcaaaaaagggggggaaaacaaatttttcctccccccatattttttaggggggggggcggcgcgggggaaaaagaaaaatttattttttttttccccccaccaaagaagaaaagaagaaaagaaccccccccccccccccccacccccaaaaaaaaaaaaaaaaggggggggggggggggggggcccctccccccccctcctctctttttatagtggaaggt

SEQ ID NO: 81403 - protein, 50 aa, Zea mays
  misc_feature: Ceres CLONE 1566880
  misc_feature (27)..(27): Xaa is any aa, unknown, or other
MQVPKLENRSLSLLQLNPKRRWPKGLXAVAEGRGNRRPPSKPKRVKFRRK

SEQ ID NO: 81404 - DNA, 696 bp, Zea mays
  misc_feature: Ceres CLONE 1566881
  misc_feature (223)..(223): n is a, c, t, g, unknown, or other
  misc_feature (291)..(291): n is a, c, t, g, unknown, or other
ctccccgcggtggcggccgctctagaactagtggatcccccgggctgcaggaattcgtctcacccctagaaaaaaaaacccaactgtcttggttgcgcaagcaccaagcaggtggaagatgatggaggtggcgggggctcaggcccgcgcggttcccctcctgctccgcaacaccgcctccctgcggacctccgtactgccgtctcctgacacgggctcccgnccggagctggcgtaggcggcgagccacgggcgtgaagggagaactgaagaccccgcgggctttcgaanaagggtgcccccatgggaacacccccctgggcgccgtaacccgccttgggttagaaccggggaaaaccgaggcccgccaggcggtcatttcttggggggggggggggggaaaccccaaaagaaaaaggggaaacaaaaggcccccccaatttgccccggtccccccccggggggggggggctttttctcccccgggaaacaccccccgaaacccccccccccccccccaaaaacccaaaaaaaggggttttttttttgggggggggaaagggaggataacccggggggtttcttccgggggggaaaaaaattttttttttttgcggggagcgggggggttttttttttgggggggggggccccccccacaaaaaaaaaaaaaaaaaaaaaaaaaaaaccccccct

SEQ ID NO: 81405 - DNA, 894 bp, Zea mays
  misc_feature: Ceres CLONE 1566883
  misc_feature: Encodes the peptide sequence at SEQ ID NO. 81406
gcggtggcggccgctctagaactagtggatcccccgggctgcaggaattcgtctcacccctagaaaaaatgcggcaccacggcgcccgtggggcccaccacggcgccgccggcagcgtcaccaacccccacccccacctccgccctcccaccggcactcccctcgcctgctccacgacgcttatgcgctcgcgccccgctctcgccgcccacctccggcgcctgctcctcctctctccctccgcccacctcatcatcatccgccgcgccatggcatccgccgccgccgcgcaggcgcagccaggtggcgccccgccggcgaccgcggagtacgaggaggtgctggggcggctctcctcgctcatcacgcagaaggtgcgcgcgaacagcgccaaccgcggcaaccagtgggacctcatggagcactacgtcaagattctggagctggaggagtcgatcgcgcggatgaaagtgattcacgtcgcggggacccaggggaagggttccacatgcacattcaccgagtcaatcctgcgatcgtgtggcttccatactggggctgttcacctccccacatttggatggatgttagagaagcgatttcagctagatggggttaataatttctgaagagaaatttttggaagtaccttccgggggcggccggaaccaagttggaaggaaaagacctgatggatgaatttcccccttgcccggccctattttcagggttccctccccgtttggccccgcatttccaagaaatttttctcgccttaacccgggaaggaagttttgctgtttcctccgaagggttgggcccctagggggggggaaagattttgaaggccaacctcaaaagggggggttaacaggccaccccttggtgattttg

SEQ ID NO: 81406 - protein, 148 aa, Zea mays
  misc_feature: Ceres CLONE 1566883
  misc_feature: SWISSPROT Homolog: EC 6.3.2.17 Tetrahydrofolate synthase
MRSRPALAAHLRRLLLLSPSAHLIIIRRAMASAAAAQAQPGGAPPATAEYEEVLGRLSSLITQKVRANSANRGNQWDLMEHYVKILELEESIARMKVIHVAGTQGKGSTCTFTESILRSCGFHTGAVHLPTFGWMLEKRFQLDGVNNF

SEQ ID NO: 81407 - DNA, 814 bp, Zea mays
  misc_feature: Ceres CLONE 1566885
  misc_feature: Encodes the peptide sequence at SEQ ID NO. 81408
ccccgcggtggcggccgctctagaactagtggatcccccgggctgcaggaattcgtctcacccctagaaaaaaccctgcccacccgaacaataaccaacagcttcaccctcctcctccagtgcaggccgtcggcggctggcggcgtcatttctcctccttcctctggcctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaagtagccaagaagacatgagatgggggcgtccttgggctccgccgccagcaagaaccggcagcaggagcacggcggcgaggctccgcgaccagatccctgcaagaagacgcggctctcgacccttctctgcactatccacggccactcgaggctgatcccggggctcccggatgaggtctctctgcagatcctcgcgaggatgccgcggatggtgtacctcaaggccaagatggtctcgcggagctggaatgcggcagtgaccggcgcggagctgtaccggctgatgaatgagctcggcgtggccgaagagtggctgtacatactgaccaaggcggacggcaagtgggcagaagctggtctggcacgctctccatccgggtagcaaccaatggcagaagctgccgctcatgcctgggatcaagtgcaagaatggcgggcctgaacgggctgggcttgcgggacctggtgaacccccc

SEQ ID NO: 81408 - protein, 120 aa, Zea mays
  misc_feature: Ceres CLONE 1566885
  misc_feature (44)..(91): Pfam Name: F-box Pfam Description: F-box domain
MGASLGSAASKNRQQEHGGEAPRPDPCKKTRLSTLLCTIHGHSRLIPGLPDEVSLQILARMPRMVYLKAKMVSRSWNAAVTGAELYRLMNELGVAEEWLYILTKADGKWAEAGLARSPSG

SEQ ID NO: 81409 - DNA, 813 bp, Zea mays
  misc_feature: Ceres CLONE 1566886
  misc_feature: Encodes the peptide sequence at SEQ ID NO. 81410
gcggtggcggccgctctagaactagtggatcccccgggctgcaggaattcgtctcacccctagaaaaactcccaaatcaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcgggggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctcatctacctcctcagcttcttcgggatcgccttcgtgcagtccgtcgtctccaacagcgacgacgaggaggacttcatcatcgactcccgccacggacaggcgcgggcgccgccgccgcccgcgccggcggccccgtgtgcgctgctggggagccccgccgccgcggcggagaaaatgccggaggaggacgaggagatcgtggccgcggtcgtggcagggaaagaccccgtcctacgtgctgggagactaggctgggaagattgccgcccgggccgcccgggatccggccggggaggcgcttgcccaggaaccacccggaagggaaaatggacggggctccccccctcgaatgggtttcgaactaaccccgtcc

SEQ ID NO: 81410 - protein, 214 aa, Zea mays
  misc_feature: Ceres CLONE 1566886
  misc_feature: SWISSPROT Homolog: EC 1.1.1.34 Hydroxymethylglutaryl-CoA reductase (NADPH)
MEVRRRVPPPHGSAPRRQQATGGEGQRVRVQAGDALPLPIRHTNLIFSALFAASLVYLMRRWREKIRSSTPLHVVSLAEIFAICGLVASLIYLLSFFGIAFVQSVVSNSDDEEDFIIDSRHGQARAPPPPAPAAPCALLGSPAAAAEKMPEEDEEIVAAVVAGKDPVLRAGRLGWEDCRPGRPGSGRGGACPGTTRKGKWTGLPPSNGFRTNPV

SEQ ID NO: 81411 - DNA, 821 bp, Zea mays
  misc_feature: Ceres CLONE 1566887
  misc_feature: Encodes the peptide sequence at SEQ ID NO. 81412
  misc_feature (766)..(766): n is a, c, t, g, unknown, or other
ctccccgcggtggcggccgctctagaactagtggatcccccgggctgcaggaattcgtctcacccctagaaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaaacatcagaccacgacgacggagaagaaagacgacgtcgtggtgcagccgcagaccttcctgcccttcgacccgctcgggcggcggcgcgttccccggcgtttcggcgggcttcccgggcggcagcaatccctgggagcagcaatcccggggttcagcatgccccgggaagcggcaagcaaccctaccccggggttaagcttgcccggggaacgggaagaaattgccccttctttgggggggggcccgggttcctttcccccaagaacgcccaaaaaagccctggaaaccccaaaaaaggggtggaaataaaaaggggggccccccgggaaccggggaaaaaccccgccgccttttaaaaaaagcagggggttcgggggttttccccccaagcccccaaaaaaaaaaaaaatttggggccctttttaacaaaccccccaaantttttggggggggaatataaataaaagcgcggggggggtccccaccggtcttttt

SEQ ID NO: 81412 - protein, 129 aa, Zea mays
  misc_feature: Ceres CLONE 1566887
MARSSKMMVAAALLALALAVSTAEARKHQTTTTEKKDDVVVQPQTFLPFDPLGRRRVPRRFGGLPGRQQSLGAAIPGFSMPREAASNPTPGLSLPGEREEIAPSLGGGPGSFPPRTPKKALETPKKGWK

SEQ ID NO: 81413 - DNA, 846 bp, Zea mays
  misc_feature: Ceres CLONE 1566889
  misc_feature: Encodes the peptide sequence at SEQ ID NO. 81414
  misc_feature (605)..(605): n is a, c, t, g, unknown, or other
ctccccgcggtggcggccgctctagaactagtggatcccccgggctgcaggaattcgtctcacccctagaaaaatcccatctccttcaccaagcaggccagccggcaacattgttgccgactgccgtcctctgcttccaacaatctccttcagcatcgatccgcccgcccctccctccaccagcagcagcaatccgtttttcaccgtgcctttccactcaccaccagccgccggcccccaggccacaagcccaagccaagccgcgcggcgtcactcccaaaccctagctcgcccgcagtcgccggtgatgtcgtccccttcgtcgtcccctgcgcggaggcgggagatgggaggagggcggcgagctccacgaccccgtgcccgtgcccgcctccgtcgtcggcgacgacaaagacctggcggcggcgcagcacatcggcaagtcgctcgccacgtccaagaacgccgccgacgacatgatccgcatcctctccggattagaccaacgactatgcatgatcacctcagagctcttcgcgtccgagtgcgcgggcgccgcctgcgacgcggacccagcggagcctgtgggtgagcaggaacccccnttcgtcgaccatggagataatggctgacggagtacgaggagatcgtagcagctgatccagctacgggactccaccccggaacgcgctgcatactaggagggccagaatgacgaacggcgcgcacgaaatacggcggcgaggggactgcgccagtataccacgtaggcgagatgggacgggtctccggccgcgaccgggggtcgactaatggcagctattccatggtccaggccttggagga

SEQ ID NO: 81414 - protein, 51 aa, Zea mays
  misc_feature: Ceres CLONE 1566889
MIRILSGLDQRLCMITSELFASECAGAACDADPAEPVGEQEPPFVDHGDNG

SEQ ID NO: 81415 - DNA, 807 bp, Zea mays
  misc_feature: Ceres CLONE 1566893
  misc_feature: Encodes the peptide sequence at SEQ ID NO. 81416
ccccgcggtggcggccgctctagaactagtggatcccccgggctgcaggaattcgtctcacccctagaaaaaatcgcggtcgcagcttgccgtgcgcccgtgccgagcgaagcgaccacaaagcggccagcgaggctctccgacaccgagccgcgctccgtggcgcacgcaacgatgcccttcttgctcacgccgggcgctcgggcggtgccctcaccgtcaacgctctcgcgcctactgcttccgctccacctacaaattactaatggccggcataaccgtcacgtccccgcctcccccctcctataccctcgcctccgcaaccgccgcagacgattcttcgcgggctcctcctcctcctcccctcccatgggggcggctgccgacgtccccccggggttcctctggaaaccctttcgagggggatccgcggttcccccacggaaaaaacggggttcgctcttttttccccccctaaaaaaaaaaaacggaccccttttttggaaccccaaaatgttccacaagggggtgttttttggtacccccatttttctccggggaattatggcggggggttaaccccccccggggggttcaaagggggggggatttttttcccccggggaaaacacgggggggggtttaccccccctttttttttaacaccggggagggagagttttttaagacggttcccctttttaaaaaaaaaattcttctctttggggaaaaccccccaaaaaggggccccccctctctcttgtgtgtgccccaaaaaaaaatcttctctgggggggacaaaaaaat

SEQ ID NO: 81416 - protein, 134 aa, Zea mays
  misc_feature: Ceres CLONE 1566893
MPFLLTPGARAVPSPSTLSRLLLPLHLQITNGRHNRHVPASPLLYPRLRNRRRRFFAGSSSSSPPMGAAADVPPGFLWKPFRGGSAVPPRKKRGSLFFPPLKKKNGPLFWNPKMFHKGVFFGTPIFLRGIMAGG

SEQ ID NO: 81417 - DNA, 872 bp, Zea mays
  misc_feature: Ceres CLONE 1566894
  misc_feature: Encodes the peptide sequence at SEQ ID NO. 81418
  misc_feature (547)..(547): n is a, c, t, g, unknown, or other
tggcggccgctctagaactagtggatcccccgggctgcaggaattcgtctcacccctagaaaaaagctccacaacaattcgtgcctgcctgcttgcctgcctcggcctcctccctcgtcctcccctcctccgccgcctcaaacccggcccccacgcgcgcgtgcgcggcgctcgaggcgacgaatccagccacctcctccgcgcccgtccccgccgccggtcgccgatattggaaggagctcggaaggctgggacgctgacccgaattttatggggagaggatgccagagctgcgaagcaatactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctgggagaggagtgcctcccgcaccaaagcctagaagaaagggggttgatattgtcgtcttagaagctgatcctgcttgtgaaaccccacttaaagctttcaaggnactggaagttgctgctgctgcacccaagaacccttcctttgagcaggtagccgaaagttggtgttccgaaaatgaatggtgaaagtgggggaaaaagattgttgggggcttgaaaatgaaatcaaccgctaccacctgttcccagaaaagggttcaaggtaggtaaattctcccaaagttacctaacctgaaccggaaatttagggtaaaagggggggttttttggtcccagggtgtattttttgggtccaaagggggtttcctcgggggggtggcctgccctccccccggggtccctgggaatgccaaatagaaaggtttgcag

SEQ ID NO: 81418 - protein, 115 aa, Zea mays
  misc_feature: Ceres CLONE 1566894
  misc_feature (89)..(89): Xaa is any aa, unknown, or other
MPELRSNTRQARLRSKKLDDLQPGEPLAKPVSPALPSARKRAPTRAARGRKGAAGRGVPPAPKPRRKGVDIVVLEADPACETPLKAFKXLEVAAAAPKNPSFEQVAESWCSENEW

SEQ ID NO: 81419 - DNA, 830 bp, Zea mays
  misc_feature: Ceres CLONE 1566896
  misc_feature: Encodes the peptide sequence at SEQ ID NO. 81420
ccgcggtggcggccgctctagaactagtggatcccccgggctgcaggaattcgtctcacccctagaaaaaaacctcgtgttcgttcggagcgcacagacacacatgccagatctcccctaaatcgacccgtcggcacctccgcttcaagatgcagatctttgtgaaaaccgctgcaccggctagactatcacactcgaggtggagtctgtctgacaccattgcacaacgttgacgccaatatccaagagaacgagggcatccccccagaccagcagcagctcatcttcacaggataacagattgaggacgggcgcacgcttgctgactacaacagccagaaggagagcaccatccaccttgtgcacagcctcatgggaggcatgcatatctttgtgaaaacactgaccggaaagactatcaccctcgaggtggagtcctctgacaccattgacaacgtagaggacaacatccaggacaaggagggcatccatccggaccagaatcggctcatctttgctgggaacagcttgaggacgggcgcacgcttgctgactgcaatgtccagaacgagagcaccatccactaggcgctgcgcctcacgggaagcatacatatcttcttcgagactctgagctgaaaaactatcacaccactaggtggagtcgtcatacatcatcgactacgtctatgccaagaatcgaggacaaggaggggcatttccccagaacagacatcggcctcaattttgctggaaagccagcttggaggcaggggcgcactccggtcccaacttacactttccggaaagggaaacccccctgcacctggc

SEQ ID NO: 81420 - protein, 86 aa, Zea mays
  misc_feature: Ceres CLONE 1566896
  misc_feature (9)..(67): Pfam Name: ubiquitin Pfam Description: Ubiquitin family
MGGMHIFVKTLTGKTITLEVESSDTIDNVEDNIQDKEGIHPDQNRLIFAGNSLRTGARLLTAMSRTRAPSTRRCASREAYISSSRL

SEQ ID NO: 81421 - DNA, 792 bp, Zea mays
  misc_feature: Ceres CLONE 1566901
  misc_feature: Encodes the peptide sequence at SEQ ID NO. 81422
tccccgcggtggcggccgctctagaactagtggatcccccgggctgcaggaattcgtctcacccctagaaaaaaggacaccactcatcttccttcccccccgcctcgtttccatcgccgccactctcttgctcccccgtaccatccctcgccaccgccaccgccgtcgctatgcagagcctcctcgtgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggttggtctccgtgttcgggaacgacgtagacgcttactacgaccgcctgctagccggggagagcggcatcgggcccatcgaccgcttcgacgcctctaagttccccacccgcttcgccggccagatccggggcttctcgtccgagggctacatcgacggaaagaaagaccgccgcctcgacgactgccctcgatactgcatcgtcagtggcaagaaagctctcgaggctgccggtattgcccaaggctcccagcccatggaaaaaattgacaaaaccccggcctggggggcttgtggggactgggaataggtggggctccccggtggttttctgaatgggggtccaaaaactcatttgaaaaagggcgtacagaaaaaaaaaccccctttcttccccccccataaggctaaaaacaaaaaatgggggtttctgccccctgcttgggaaaaggaaaata

SEQ ID NO: 81422 - protein, 157 aa, Zea mays
  misc_feature: Ceres CLONE 1566901
  misc_feature: SWISSPROT Homolog: EC 2.3.1.41 Beta-ketoacyl-acyl-carrier-protein synthase I
MQSLLVPTAASAPVAAPRARRNLPMRLSVRASATAAAAPRRETDPKKRVVITGMGLVSVFGNDVDAYYDRLLAGESGIGPIDRFDASKFPTRFAGQIRGFSSEGYIDGKKDRRLDDCPRYCIVSGKKALEAAGIAQGSQPMEKIDKTPAWGACGDWE

SEQ ID NO: 81423 - DNA, 906 bp, Zea mays
  misc_feature: Ceres CLONE 1566903
  misc_feature: Encodes the peptide sequence at SEQ ID NO. 81424
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (264)..(264): n is a, c, t, g, unknown, or other
  misc_feature (282)..(282): n is a, c, t, g, unknown, or other
ttttttttttttttctcccacctaataaaataagtaaaaaagctcgtataggnnngaatnnntcaaactggactcccgcggggcggccgctctgaactagtggatcccccgggctgcaggattcgtctcacccctagaaaaaaggacaccactcatcttccttcccccccgcctcgtttccatcgccgccactctcttgctcccccgtaccatccctcgccaccgccaccggccgtcgctatgcagaagcctcctcgtgcccanctgctgcatctggccccnggtggcgagatccgcgtggctcggcgggaatctcccctatgcggcctcctccgttccgcgccctccgccgacggccgggcagccggcacccgccggcggggagaacgggattcccaagaaagccggggtgggtggaatcaccggggggaatggggggtttggggttcctcccgggggtttcccggggaaaaacaaaacgtttaaaaaccccccctttaaacttaaccgaaacccggggccctttgggccttaaacccccccggggggggaaaaaaaaaaccccccgggagcaatttctgggggggggccccccccccttttcctggaaaacaccgcggggcttttttttccggaaaaacgggccccccctttctttaataaaaaagttttttgcccccccccaaaaaacccccggcgggtttttttttttcgcccccccgggggggcaccaaaagaaaaatcccccggggggggggggggctcttttctcctctccacggtatctcccccaaaaaaagggggggctttctaaactattctcttccagaaaacgggggggaaaaaaaaagaaaaaaaccgctgtacccccgccgggcccccaggatatctattttttggtcaaat

SEQ ID NO: 81424 - protein, 81 aa, Zea mays
  misc_feature: Ceres CLONE 1566903
  misc_feature (8)..(8): Xaa is any aa, unknown, or other
MQKPPRAXLLHLAPGGEIRVARRESPLCGLLRSAPSADGRAAGTRRRGERDSQESRGGWNHRGEWGVWGSSRGFPGEKQNV

SEQ ID NO: 81425 - DNA, 900 bp, Zea mays
  misc_feature: Ceres CLONE 1566904
  misc_feature: Encodes the peptide sequence at SEQ ID NO. 81426
  misc_feature (406)..(406): n is a, c, t, g, unknown, or other
ctccccgcggtggcggccgctctagaactagtggatcccccgggctgcaggaattcgtctcacccctagaaaaactagcatcccaagctcctcactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccggtcgcggagatcccgcgacgaggaccgccggcggcggagaagacggggccaggagagaaagcggcacggtggggatggtggcaggtcctccgactcccaaccctcngaggaggatagggcggaggaggcgcgggagatcgtccgagatatactcatcgaattgccggccatagccgaagagcttcgccagcttctccaaattatagacagtggtgaaagcattgatatttctggaatttctgacaaactattggtgaagcgcttgaagaaacttttccgatctctgagattgaaagaaagtgcaagtgggggcttacttggttgcccttcaaaaatgttcctacgcttgatatttgttgggatcatactaattagcagtttctaaacttgcagaacaccaaaaaggggaaaagccaggtggtccccaaattggagaagcactttcaaacggggcttaactgtggaggtgccaaaattaaaggattaagggtttttgttgggttccccgaagagaccaaaaaattgttttgaattgtggaaaaaagaaacccctccctaaagaaagaggaaaaattggggctcctgcacaaagcgccatct

SEQ ID NO: 81426 - protein, 191 aa, Zea mays
  misc_feature: Ceres CLONE 1566904
MGRDGEQTRRRSRKRSRDASPSSSDSDSFDSPSSPSSSPERRSRSSKRNRSSSSHRHSRKKSDRSRRSRDEDRRRRRRRGQERKRHGGDGGRSSDSQPSEEDRAEEAREIVRDILIELPAIAEELRQLLQIIDSGESIDISGISDKLLVKRLKKLFRSLRLKESASGGLLGCPSKMFLRLIFVGIILISSF

SEQ ID NO: 81427 - DNA, 872 bp, Zea mays
  misc_feature: Ceres CLONE 1566905
  misc_feature: Encodes the peptide sequence at SEQ ID NO. 81428
ctccccgcggtggcggccgctctagaactagtggatcccccgggctgcaggaattcgtctcacccctagaaaaaaccgcagcatttcttcttcttcttgtcactagctgcaggctgcacacagcgccgccattgttttgttagcatggccccgagcaaggttgctgctgcagtgaacggacagaagccgatggtgcccaacatcgttcagagcagcagcactctgccgccggttgccggcagcgacgaggagttcgcgccgtctgtgtggggagatttcttcgtcacctatgcccctcccgtctcacaggcatcagagcagcggatgagggagagggcggagcggctcaaggcgcaagtacgtcagacgttcgatgctgccagcatggatgttgcaggtctggtcacgtacgtcgacaccctcgaacgcctcggcttagacaaccacttccgcgacctgatcggaggcgcactggatcgaatccgagcagaagagcttccggagcacggcggcggcctgcacgtcgtcgcgcttcggttccgcctgctcccgcagcatgggatatgggtatctaccgatgtgttccacccggtcaaagacgaccccagccggtttctgttcgaaccttctgcatggacaaccaccctagggggtctccctgaagcttataccaacgcaccttcacatgggccatccccagccgaaaattggtccttcaaacaacccccttcgccttttcggggagggggcccccctccatggcaacatccttgaaaggccaccaaggggccaaggtccccccgggtgttccgaacccgaattcaccgggggccctctggaaatacccccgctccccaccaaaataaaaaaaa

SEQ ID NO: 81428 - protein, 209 aa, Zea mays
  misc_feature: Ceres CLONE 1566905
  misc_feature (42)..(196): Pfam Name: Terpene_synth Pfam Description: Terpene synthase, N-terminal domain
  misc_feature: SWISSPROT Homolog: EC 4.2.3.13 (+)-delta-cadinene synthase
MAPSKVAAAVNGQKPMVPNIVQSSSTLPPVAGSDEEFAPSVWGDFFVTYAPPVSQASEQRMRERAERLKAQVRQTFDAASMDVAGLVTYVDTLERLGLDNHFRDLIGGALDRIRAEELPEHGGGLHVVALRFRLLPQHGIWVSTDVFHPVKDDPSRFLFEPSAWTTTLGGLPEAYTNAPSHGPSPAENWSFKQPPSPFRGGGPPPWQHP

SEQ ID NO: 81429 - DNA, 881 bp, Zea mays
  misc_feature: Ceres CLONE 1566906
  misc_feature: Encodes the peptide sequence at SEQ ID NO. 81430
tccccgcggtggcggccgctctttaatagtggatcccccgggctgcaggaattcgtctcacccctagaaaaagctcaggctgcccgccgtgatggcgcgtctcttcttcttcctcctcctcctctttccgctcctctactcctccgtcaccggcctcaaccgcagtgacttcccgccgtccttcctcttcggcgccagcacgtcgtcttaccaggtggaaggcgcatacctagacgacagcaagggcctaagcaattgggatgtcttctcccatgttccaggaaatattgacgatggaagcaatggcgacgtggctgctgaccattatcatcgatacaaggacgacatagaaatgatgcattccattgggctcggctcttacagattctcattgcccatggtcgagaattctttccaaagggtcgcttcggaggtgttaaaccagggggggggttaattctaacaaaagccctcattcaaaggaactggttgaaaaaaggggaaacaaccactttttgaaggattaacccccctttgaaatacccgggaaaaaatcccaaaaaaaaataaaattttttgggtttaaacccccaaaaatttcggggggggagttttccccacctttccgggagggtttggttttacaaaaatattttgggggacacaaaaaaaaaaaattgggggggccccttctcctgggggcccaaatcttttttgtttggaaagggtgtgggaatccccccgggggggggggggttttcttcccccccccccccgttttttttcgggacacatttgtgtggagaaaaagaggataatttgtgggggggtaattttgtaatacgcgggggggccctcctcctcttttgtgggggcgcaac

SEQ ID NO: 81430 - protein, 121 aa, Zea mays
  misc_feature: Ceres CLONE 1566906
  misc_feature: SWISSPROT Homolog: EC 3.2.1.21 Beta-glucosidase
MARLFFFLLLLFPLLYSSVTGLNRSDFPPSFLFGASTSSYQVEGAYLDDSKGLSNWDVFSHVPGNIDDGSNGDVAADHYHRYKDDIEMMHSIGLGSYRFSLPMVENSFQRVASEVLNQGGG

SEQ ID NO: 81431 - DNA, 876 bp, Zea mays
  misc_feature: Ceres CLONE 1566907
  misc_feature: Encodes the peptide sequence at SEQ ID NO. 81432
ccccgcggtggcggccgctctagaactagtggatcccccgggctgcaggaattcgtctcacccctagaaaaaaccgcagcatttcttcttcttcttgtcactagctgcaggctgcacacagcgccgccattgttttgttagcatggccccgagcaaggttgctgctgcagtgaacggacagaagccgatggtgcccaacatcgttcagagcagcagcactctgccgccggttgccggcagcgacgaggagttcgcgccgtctgtgtggggagatttcttcgtcacctatgcccctcccgtctcacaggcatcagagcagcggatgagggagagggcggagcggctcaaggcgcaagtacgtcagacgttcgatgctgccagcatggatgttgcaggtctggtcacgtacgtcgacaccctcgaacgcctcggcttagacaaccacttccgcgacctgatcggaggcgcactggatcgaatccgagcagaagagctgccggagcacggcggcggcctgcacgtcgtcgcgcttcggttccgcctgctccggcagcatgggatatgggtatctacagatgtgttcgacgcgttcagagacgacgcgagcggtttctgttcgagcctctgcagtgacgacgacccttaggggtctccctgagctttatacaaacccaacttcacatggccagtccccaggcggagatgggtccttcgaacgacgccatttcgcctttcgcgaaggggggccgccctccatggaaacattccttgaagagggcaaccaagggtccaggggtcccccctggtggttccggaagccaaaaattaacaccgaaagcccccttccaaaaatatcccccccctttcccacacaaa

SEQ ID NO: 81432 - protein, 167 aa, Zea mays
  misc_feature: Ceres CLONE 1566907
  misc_feature (42)..(166): Pfam Name: Terpene_synth Pfam Description: Terpene synthase, N-terminal domain
  misc_feature: SWISSPROT Homolog: EC 4.2.3.9 Aristolochene synthase
MAPSKVAAAVNGQKPMVPNIVQSSSTLPPVAGSDEEFAPSVWGDFFVTYAPPVSQASEQRMRERAERLKAQVRQTFDAASMDVAGLVTYVDTLERLGLDNHFRDLIGGALDRIRAEELPEHGGGLHVVALRFRLLRQHGIWVSTDVFDAFRDDASGFCSSLCSDDDP

SEQ ID NO: 81433 - DNA, 1070 bp, Zea mays
  misc_feature: Ceres CLONE 1566908
  misc_feature: Encodes the peptide sequence at SEQ ID NO. 81434
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (933)..(933): n is a, c, t, g, unknown, or other
attgttttggtgtgcttttcttttttttttcctttggggggggggggcgcgggtgtggcnnaaaacccnnnnnnnnnaaaactggagctccccgcggtggcggccgctctagaactagtggatcccccgggctgcaggaattcgtctcacccctagaaaaaccaccagtccaccattccagcatcgccaccacccgagacaaaaaaaaaaaaaaaacaacaacaacactgtaacgaaaatatacggcaaaaccctagatctctctctcctctcggcattgctggctggggtgtgcggcggcccgcagtggtgagggacgcacggcgatggcctccgccgccgccgtcatcgcctcgccggcccccggcgccgccgcggccgagcccgccgcctggctcgtcgacgagcgcgacggcttcatcacctggctgcgcggcgagttcgccgccgccaacgccatcgtcgaccacctcatcttccacctccgctccatcagcgagccgggcgagtacgaccacgtcttctctctcgtccagcagcgccgccaccacttggccgcacgtgatccacattgcgcaagttcttcccccggtcaggcgacatcggcccttcgccgctcccagcaaagccagcctgggggccgcccacggcgcccgcccgggccacaggcggcctccgggggcctggggggacgttccgaccggggccggcggattttccccgaccaggcacgaccattccctttgggcccgggggcccttttggtttttctcaccaaagttccccccattaatcttccccccaacccaaggcaaaccatatccggcccaccgggggcgccccaaatcataaaccgagcccccccaaaatcccaagcccgctgcggggagggccctcacccccctggggggggggatacggtgggaaactccncaagaaaaaaaaattgggaccttggtaaaatttctcataaatacaaaccacaggacaaagggggagaggggtgcctttaaaaaaaaaaacccgtgggggaaaatgttcccttcccaaaaacctaaaaaagatgttta

SEQ ID NO: 81434 - protein, 228 aa, Zea mays
  misc_feature: Ceres CLONE 1566908
  misc_feature (203)..(203): Xaa is any aa, unknown, or other
MASAAAVIASPAPGAAAAEPAAWLVDERDGFITWLRGEFAAANAIVDHLIFHLRSISEPGEYDHVFSLVQQRRHHLAARDPHCASSSPGQATSALRRSQQSQPGGRPRRPPGPQAASGGLGGRSDRGRRIFPDQARPFPLGPGALLVFLTKVPPINLPPNPRQTISGPPGAPQIINRAPPKSQARCGEGPHPPGGGDTVGNSXRKKNWDLGKISHKYKPQDKGGEGCL

SEQ ID NO: 81435 - DNA, 769 bp, Zea mays
  misc_feature: Ceres CLONE 1566912
  misc_feature: Encodes the peptide sequence at SEQ ID NO. 81436
  misc_feature (705)..(705): n is a, c, t, g, unknown, or other
tccccgcggtggcggccgctctagaactagtggatcccccgggctgcaggaattcgtctcacccccttgagggccaggtgcaggtcagccatagcgcttcttcctttcgctcaaggcgcggtccgccaagatgccggccagcttcattcgatcctcgccagtcgtgatgggtttgtctccgatggtccagctccggctggtgatgacgggcgccatcgaggccaggaaggcacgttcccagaaagcgcgctcagatgcctcggcgccgttgtcggcgacgagcacccgctagttacctctgtgcggtttccaagatggctcgccgtggattgatggaacaggacttaagcaaattggatgtgacaaagcttgacccactgtcacctgaagttatctcacgccaagcaacaatcaatattggtaccattggccatgtggctcatggaaagtctactgttgtgaaggctatatccggagttcagactgttcggttcaagaatgagctggaacgtaacattactataaagctgggctatgctaatgcaaaaatctacaaatgtgaggatgacagatgtccacgaccaatgtgctacaaggcctatggaagcggaaaagagatagccctctatgtgatgtgccctggatttgaaacactagaaatgagctcctgagacatgtttctttttgttgattgcccgggacacnacattctcatggctaccatgctttaatggagctgctatcatgggatggagctccttctttttgt

SEQ ID NO: 81436 - protein, 118 aa, Zea mays
  misc_feature: Ceres CLONE 1566912
  misc_feature: SWISSPROT Homolog: EC 2.1.1.43 Histone-lysine N-methyltransferase
MARRGLMEQDLSKLDVTKLDPLSPEVISRQATINIGTIGHVAHGKSTVVKAISGVQTVRFKNELERNITIKLGYANAKIYKCEDDRCPRPMCYKAYGSGKEIALYVMCPGFETLEMSS

SEQ ID NO: 81437 - DNA, 831 bp, Zea mays
  misc_feature: Ceres CLONE 1566915
  misc_feature: Encodes the peptide sequence at SEQ ID NO. 81438
ccctgcggtggcggccgcatcagactagtggatcccccgggctgcatgcattcgtcgcgcccctagaaaaaaaaaaactgactgattgtctgattgtgattgcggcagcaccgccgaccacgagcccgccgaaaggctcctccgcctgccgttccagggtgcagtgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagttcccatctacagatatacctctagaaagtgaatggtttgctattccaaagggatacaatgctccacagcaggttcatatcactcaaggtgattatgatggaaaggcagttatagtatcttgggttactccagaagaacctgggccaagtgaagtattttatggcaaggagaagctatatgaccagaaagcagaaggaacaacaacaaactatacgttttatgattacaaattctggatacatacacccattgccttgtccatgggccttggagtataacgctaaaatattatttacaagatttgggaagcggaaaattcaggcctcgaggaatttctgggttttacaaaccgccttccaggcaaatttgaatcccagaatggccatccataaacccctttttgggcaaatcccttaaggggggaaattttggggggggcaaaaacaattttttaaacgtttctcctct

SEQ ID NO: 81438 - protein, 125 aa, Zea mays
  misc_feature: Ceres CLONE 1566915
  misc_feature: SWISSPROT Homolog: EC 3.1.3.2 Acid phosphatase
MRGWGLLVLSLHVLSCLVSGVASGRTSSYVRTEFPSTDIPLESEWFAIPKGYNAPQQVHITQGDYDGKAVIVSWVTPEEPGPSEVFYGKEKLYDQKAEGTTTNYTFYDYKFWIHTPIALSMGLGV

SEQ ID NO: 81439 - DNA, 826 bp, Zea mays
  misc_feature: Ceres CLONE 1566916
  misc_feature: Encodes the peptide sequence at SEQ ID NO. 81440
ctccccgcggtggcggccgctctagaactagtggatcccccgggctgcaggaattcgtctcaccccctagaaaaaacacacacggtcgctccctttctctcgcctcctgtcccccccgcgtgcgcgcagcgctctctctctccctcactctcttttgaggagtgaggacgactggggcgaacgtcgccgccgccgctctacatcaggtgcccaggtcgttgttcggcccttcgccagctctttttcgggcacttcgccggcgacgaacacccaccagttgctggtgcaaggctttcaaaagattaacagtctcacttgatgcaaaagcaacacaatcacactaaaggtttggattagacatttcagagcatgggttcgcggtttccatcccaccagctaagcaatggcttgtatgtctcgggccgacctgagcaacctaaagagaagtccccagtcatttgctcctcggctatgccgtacactggtgggggacataaagaaatctggggagcttggaaagatgtttgatctccatagaaaatcttgttcattgggtaatcaaactttcagggatacttcccttgggtggtgctgccctccaactctggaccagttttctaatgctggcgggtcgctccaactaccccggggttcaatttccgccggggaattcctaaaacccgggagggatctttcagggacaaaaaaataatttctgggaccttctccaataagcgcggggggaaccccccaaaaggggggctttttgggccccccaattttggggggggaaaaaacccccccgaggggccccccccaaaaaaca

SEQ ID NO: 81440 - protein, 102 aa, Zea mays
  misc_feature: Ceres CLONE 1566916
MACMSRADLSNLKRSPQSFAPRLCRTLVGDIKKSGELGKMFDLHRKSCSLGNQTFRDTSLGWCCPPTLDQFSNAGGSLQLPRGSISAGEFLKPGRDLSGTKK

SEQ ID NO: 81441 - DNA, 852 bp, Zea mays
  misc_feature: Ceres CLONE 1566917
  misc_feature: Encodes the peptide sequence at SEQ ID NO. 81442
  misc_feature (703)..(703): n is a, c, t, g, unknown, or other
  misc_feature (704)..(704): n is a, c, t, g, unknown, or other
  misc_feature (792)..(792): n is a, c, t, g, unknown, or other
  misc_feature (825)..(825): n is a, c, t, g, unknown, or other
ccccgcggtggcggccgctctagaactagtggatcccccgggctgcaggaattcgtctcacccctagaaaaagcgccctactccccaccacttccctcccttccccgcctacaagcaagccgccccagccattcatggccatcaccaccaccatgtgtcgccgccactccccctccacctcccacccactcctctcaccgcaccactaaacccgcctccctcgctcctcacccgctccctcagctccctgtccatccatcgccgctctgctgccgtttgctccagctgcggccgaccggggccatggcgggcatcgacctcaacaccgtggaggaggaggacgaggaggaggcggaggcgctgcctttgcccggacccggtggccgtggcgccgtgtgcctggagctgtggcacgcgtgcgcgggccccgtcccgccgctgccgcggaagggcagcgccgttgtgtacctgccgcagggccacctcgagcacatcggcggcgacgcggcgcgaggagcagccgctgcggcggtgcctccacacgtgctctgccgcgtcgtcgacgtcaccctccacgcggacggcgcgacagacgaggtgtacgcgcgggtgtcgctgctgcccgaggacgaggacgcggagaagcgtgcgcaggcgcgggtccgggacgacgaagacgcggaccgccgcgaacgcgaagacnngcgcgccatgaggccgctcgcacggaacgcgcacatgttctgcaagacgctcacgggcatccgatacagccgcacgggggtttctcantgccgcgccgcgccgccaaagaatgcttcccgnccgctggactacagccagcagaggcgc

SEQ ID NO: 81442 - protein, 183 aa, Zea mays
  misc_feature: Ceres CLONE 1566917
  misc_feature (134)..(134): Xaa is any aa, unknown, or other
  misc_feature (163)..(163): Xaa is any aa, unknown, or other
MAGIDLNTVEEEDEEEAEALPLPGPGGRGAVCLELWHACAGPVPPLPRKGSAVVYLPQGHLEHIGGDAARGAAAAAVPPHVLCRVVDVTLHADGATDEVYARVSLLPEDEDAEKRAQARVRDDEDADRREREDXRAMRPLARNAHMFCKTLTGIRYSRTGVSXCRAAPPKNASRPLDYSQQRR

SEQ ID NO: 81443 - DNA, 815 bp, Zea mays
  misc_feature: Ceres CLONE 1566918
  misc_feature: Encodes the peptide sequence at SEQ ID NO. 81444
ccccgcggtggcggccgctctagaactagtggatcccccgggctgcaggaattcgtctcacccctagaaaaaagcccggcgcgcttcccttcaaagccactgcttcgcctcctccttctacttaagcgcagccggccccggccggcattcgcatccggtagctcgatcacttcttcctctggattttgggaaggaggcatcggacgtcggatgcatgacacactcattgcattagcgcctacgcctaccgcaagtggaagcctatggatctcaagcaagccttctctggtacaatcttctgccttctgcttctattctgcgtgggctgcagatgtcggactttggaaatagaggccacccagacagcagccctcaaggttgatgcctcgccacagcttgcccggaagatccctgaaacactgtttgggatattttttgaggagatcaaccatgcaggagctggtggcatatgggcagagcttgtcagtaacagaggtttcgaagctggaggctctcatactccatcaaacatcgacccgtggtccatcattggagatgactcctccgtgttcgtggcgactgatcgtacatcatgtttcagtcgaaacattgttgctctgaggatggaggtcctctgtgatgactgtccagctggtggtgtttgtgtttaatacccaggtttttgggggcatgaacatagaaggatgggaaggcctacaatctcgttatgtatgttcagtccccagaaaccaaaggatctaaccgttttcttaaacaagctctgaaggggttgcaaaaacttggctttcccctat

SEQ ID NO: 81444 - protein, 135 aa, Zea mays
  misc_feature: Ceres CLONE 1566918
  misc_feature: SWISSPROT Homolog: EC 3.2.1.55 Alpha-N-arabinofuranosidase
MDLKQAFSGTIFCLLLLFCVGCRCRTLEIEATQTAALKVDASPQLARKIPETLFGIFFEEINHAGAGGIWAELVSNRGFEAGGSHTPSNIDPWSIIGDDSSVFVATDRTSCFSRNIVALRMEVLCDDCPAGGVCV

SEQ ID NO: 81445 - DNA, 790 bp, Zea mays
  misc_feature: Ceres CLONE 1566920
  misc_feature: Encodes the peptide sequence at SEQ ID NO. 81446
  misc_feature (638)..(638): n is a, c, t, g, unknown, or other
  misc_feature (710)..(710): n is a, c, t, g, unknown, or other
tccccgcggtggcggccgctctagaactagtggatcccccgggctgcaggaattcgtctcacccctagaaaaaagccctcacacaagagacgcagctgcgagtccgccagccttatcctcctccccgtctccggctccaacccgcaagcgcggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaaacagcgaaagcactangtgaagaaactaccgaagttgtctaaaggagtcgaagatagtgagcttgcagatgttgcctgctgttagtgncggccaccactaccgaaattggtaaatttgatagcagaaggcattgaaccaagtcggttcgaaaaagggggtgggttacc

SEQ ID NO: 81446 - protein, 169 aa, Zea mays
  misc_feature: Ceres CLONE 1566920
  misc_feature (162)..(162): Xaa is any aa, unknown, or other
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALXEETTEVV

SEQ ID NO: 81447 - DNA, 844 bp, Zea mays
  misc_feature: Ceres CLONE 1566924
  misc_feature: Encodes the peptide sequence at SEQ ID NO. 81448
tggagctcaccgcggtggcggccgctctagaactagtggatcccccgggctgcaggaattcgtctcacccctagaaaaagccctcctacttgcagaatctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaggacgatgacgaggacgaggaggggatggaagtggacggggaggcggaagatgagccggggtggccgtgtggggcgccggaggcggggcccggcgaaacgaggccggcagcgatcctcgtggcggacgcggcggaggtcgacttccccgtcatctacctccaccccgccttcgaggccgccacggggtaccgcgcgcacgaggtgctcgggcggaactgccgattcctacaattccgggatccacatgcccaaaggcgacaccccctcgttgatcccatggtcgtttcagagattcggcgatgtctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcttatccggtgtacaagcaaaagtccagcagcaggcccagcatttcagatctgaactcatctccccacgagcacgctccgaaaaaccagagcgcagaccactgcggcatgcttcagttgtcagagc

SEQ ID NO: 81448 - protein, 206 aa, Zea mays
  misc_feature: Ceres CLONE 1566924
  misc_feature: SWISSPROT Homolog: EC 2.7.11.1 Non-specific serine/threonine protein kinase
MRLWEEEDDDEDEEGMEVDGEAEDEPGWPCGAPEAGPGETRPAAILVADAAEVDFPVIYLHPAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSISDLNSSPHEHAPKNQSADHCGMLQLSE

SEQ ID NO: 81449 - DNA, 791 bp, Zea mays
  misc_feature: Ceres CLONE 1566925
  misc_feature (499)..(499): n is a, c, t, g, unknown, or other
  misc_feature (500)..(500): n is a, c, t, g, unknown, or other
  misc_feature (503)..(503): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (735)..(735): n is a, c, t, g, unknown, or other
ccgcggtggcggccgctctagaactagtggatcccccgggctgcaggaattcgtctacacccctagaaaaatgcggccgtgccaaggcaaagtgcgcacctcagctctgccgaggttggcattggtggtggtgacccggcgatggcggcggagcgggacatcgacgacctgccgcggaacgacgccaactacatcggcgctcacggccgactctgggttttccctctgaggcggcgcccccccccttaaacccccccccgggccaggggcctcccttttggggaaggggccccgggcccctaaccccggggggccaaaccccctagagggctgtgggggggggggctttttttttcccccttttgggggaaaaaactctttggcccccaaaaaaaccggggggttttttaaaaaaccccccaaaaaacccccccccgaaaattaaaaaagaaacccttttttttgggggggggccccccccccccctgggggggggggnnggnagggggggaccccccccacaagtgtggtgtaaacaaaaacacctttttgcaaaaagaaaaaaaaaacaccccctccccccccccccccggggggaaaattttttttttttcttttttttggggggggggggcgacccccccccccccccccccgcccacaaaaaaaaaaaataattttgttgtgtttgttttnnnttgggtttcctcgccccccaccacaccaaaaaaacanaaatcatccctcttttctctttatctcccccccccccccccgctcaggaaggaaaa

SEQ ID NO: 81450 - DNA, 849 bp, Zea mays
  misc_feature: Ceres CLONE 1566927
  misc_feature: Encodes the peptide sequence at SEQ ID NO. 81451
  misc_feature (696)..(696): n is a, c, t, g, unknown, or other
tccccgcggtggcggccgctctagaactagtggatcccccgggctgcaggaattcgtctcacccctagaaaaagcctttgttccgtctgtgtctgtctatgatgggaccgggacacctagggttcggataccggcaccggctcaactgacgacggactatcgccagtggcgatcaccctccctgtcccctgaccgcggcgtcccctgctcgcgccgcaccggtggcgacaaggcaccccttgcctgctcccctagacgcgagtgagcgagccaacacctgtcggcacaagaatggatgggaatgctgagacgatccaattctcatggggcaagcgtcgagggaaaggtggtgctaagatggatacacagttctttgggtccttcacattggacaatgtgaagtattcactgtttgactgtgtctatctatttaagcatggtgatcctgaaccgtacattggaaaaatagtgaagatctgggagaaagataatgataaaaaagtaaaaattctttggtttttccaccctgatgagattcagaaatatttaagtggccctgtgatgggaaaggagatttttcttgcctgtggtgaaggtgctgggcttgcagatatcaacccgctggaagctgtcgctggaaaatgcactgttatatgtacttcaaaggatgagaagaatcgtcaaccatcccctcangaactagaaattgctgaatatatcttctataggggtctttggatgtaaaagtttacactttctgatcagttaccagataaaatgctgcatttacagttgatcttcttctgaatcaaaaagatgagctagtcatacctgcaaaatgtctggtga

SEQ ID NO: 81451 - protein, 150 aa, Zea mays
  misc_feature: Ceres CLONE 1566927
  misc_feature (36)..(140): Pfam Name: BAH Pfam Description: BAH domain
  misc_feature (135)..(135): Xaa is any aa, unknown, or other
MDGNAETIQFSWGKRRGKGGAKMDTQFFGSFTLDNVKYSLFDCVYLFKHGDPEPYIGKIVKIWEKDNDKKVKILWFFHPDEIQKYLSGPVMGKEIFLACGEGAGLADINPLEAVAGKCTVICTSKDEKNRQPSPXELEIAEYIFYRGLWM

SEQ ID NO: 81452 - DNA, 682 bp, Zea mays
  misc_feature: Ceres CLONE 1566930
  misc_feature (279)..(279): n is a, c, t, g, unknown, or other
  misc_feature (280)..(280): n is a, c, t, g, unknown, or other
  misc_feature (529)..(529): n is a, c, t, g, unknown, or other
  misc_feature (632)..(632): n is a, c, t, g, unknown, or other
tccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacnngcactatacgaagctgctgcacgaaaagcagcaagccagccgcaaaccaaagcttcttggctggtccgggggaattccccccttttccccccccggggtgggccccggggcggccccccctgggttccccccaaaaacccctaaaaaaaaatttttggggggtttggggggccctcccggggaaaaaaaaaaaaaaaaaaaaccccgggggggggggggggggggcgcccctccccccccccccttttnctcccccccccccccccccccccaaaaaaaaaaaaaaacttttttttttttttttttaaaaaaaaaaacaatttttttggtgtttggtgtcggtcgggataangggacacccccccccccccccccaccgtaaaaaaaaaaaaaaaaaaaaag

SEQ ID NO: 81453 - DNA, 1043 bp, Zea mays
  misc_feature: Ceres CLONE 1566932
  misc_feature (237)..(237): n is a, c, t, g, unknown, or other
  misc_feature (246)..(246): n is a, c, t, g, unknown, or other
  misc_feature (529)..(529): n is a, c, t, g, unknown, or other
  misc_feature (648)..(648): n is a, c, t, g, unknown, or other
  misc_feature (649)..(649): n is a, c, t, g, unknown, or other
  misc_feature (1043)..(1043): n is a, c, t, g, unknown, or other
ctcccggcggtggcggcgctctagactagtggattcttgggctgcaggaattcgtctcacccctagaaaaaatcaccaagccgaaccacagagctcccccacacccacagcggggtgaagcgaatcgcatcaaattcgaccgaagaatcgcgccgctcggcccggccaccatgagcttctcgtccatgagcaagcagcaggtgctggacgccggtgacggggagggggaggaggtcntggaggtcnacccgggcctggcggaggaggaggtcgacaagtgccgcctccgcctggcccttcctctgccacggcgatatgccgcacagatcacctcccgcctatgaatcgcgtttgcgcacgggacgcccggggggtgagggagataggcgcttcgcaccctacccgagtggtggtcccccccgagggctgaaagccacgcagcgcaccggcggctgattacacgttccttcacgacgattgttgatccgtcggggtgtgaaaaagggagttggagaatgataaaatatantctacggatcaaaagacagaatatcgaccgcaccgaccccagcgaccgtaaggcggatacccgctgtatagaagtggagtagggcttctgcggtactcaaggctccgtcctcgcccgtnntgggcggtggcctcagcgagactgagacagcggaatcgagacgagatggagggggtaggatttatgaagaaatagagcgatataatgtgacggtgtcttataccagagaccgcggtccggcgggatggaatggggcgcgcgtaggggccaacgggacgggtggaggtagggttagtgcgaagaattggggttctagctgtccggcatgtgtggtgtgcgtagatttcgtatgcagggtgtgattatgacctgccgccggggagtgacgtgccgccggtcgttcttgttcgacgatccatcatggacgcagcccaggcacgatataagcggcgcgcggtcacatcgagagatatgaaccggaggggaggtcccagaaccgcacgcagcagatagn

SEQ ID NO: 81454 - DNA, 854 bp, Zea mays
  misc_feature: Ceres CLONE 1566933
  misc_feature: Encodes the peptide sequence at SEQ ID NO. 81455
  misc_feature (619)..(619): n is a, c, t, g, unknown, or other
  misc_feature (676)..(676): n is a, c, t, g, unknown, or other
ctccccgcggtggcggccgctctagaactagtggatcccccgggctgcaggaattcgtctcacccctagaaaaaacacggcaagccccaatcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagttcacggtgcagacggacctgggcgccacggtgggcgcgttcaaggaggtcttatccggtagctgcggcgtgccagcaccgcagcagcgcctgatctacaagggccgcatcctcaaggacgagcaaaccctagacagctatggcgttgagacggatcacacaattcacttggtgcgaggtgtcgccacaccagctgcatccagtgcacctgctgctgccaacccccttgcttcatttactcctagtagtggccctgcaggtggcctgggaggcctatttccaggtgttgatgctccaggaaatgacaggccatcaggtatatttaggccaggatttccagaattagagcaagttgagcaacatttaagccagaatcccnacttgatgagggagataatgaatatgcgggcaatgcaaaatctcatgaataaccccntgattatacgtaatatgatcatgaaacacccacaaatgcgcgagatcatgggatcgaatcctgatcttgcccatgtgctccatgacccaagcgtccttcggcaaaccctcgaagctgctaggacccctggaatcctgagaaaagagatgcgggaccccaaccgacctttgaccaactt

SEQ ID NO: 81455 - protein, 241 aa, Zea mays
  misc_feature: Ceres CLONE 1566933
  misc_feature (31)..(99): Pfam Name: ubiquitin Pfam Description: Ubiquitin family
  misc_feature (164)..(164): Xaa is any aa, unknown, or other
  misc_feature (183)..(183): Xaa is any aa, unknown, or other
MASGGEGAGSGESPPAASVEAAAVEATLHIRCANGSKFTVQTDLGATVGAFKEVLSGSCGVPAPQQRLIYKGRILKDEQTLDSYGVETDHTIHLVRGVATPAASSAPAAANPLASFTPSSGPAGGLGGLFPGVDAPGNDRPSGIFRPGFPELEQVEQHLSQNPXLMREIMNMRAMQNLMNNPXIIRNMIMKHPQMREIMGSNPDLAHVLHDPSVLRQTLEAARTPGILRKEMRDPNRPLTN

SEQ ID NO: 81456 - DNA, 807 bp, Zea mays
  misc_feature: Ceres CLONE 1566934
  misc_feature: Encodes the peptide sequence at SEQ ID NO. 81457
ctccccgcggtggcggccgctctagaactagtggatcccccgggctgcaggaattcgtctcacccctagaaaaacactgcatcacaactgaatcgcaaatgggttttcatgcaataaacaaacttatagcgcaagtcgttcttgaaggttgaaaattaaccaggccaacggcttgagtcggaccctgtcaacacagggtggtcgatgttagagacatggcacaatctcgatcgtgacgtatgagaacccatctacacagggttgtgcttggcgtccatggaatgtttgtttgacttcaccgatagaattgctgatatgtaccatgatttcccagttcataggtcatacattttctaagaacatgcatcaggtttgtgtaagcagggctagctgttcgttttggtaatgacatttttacttttttcacatcagaatcaactatcaaagaggacaaacaggttggttgatgagagcaaaggagccctccaagaagttgatcgatctgggcgtttgtttccttccgtttgatgtgaccatcagggagaccgtcgattgcttcagaagcaaagggctcatctagccatgtgaacatttccagatgtaccagggttactattgcttactagaatgaggcgagagctgcttagctcctttgacattccttctacttagtggcaaatgggtttggttacttaaacctatgctccatatgatccacgctgattgaattttgggttgttaatatgttttgggcaagcagtgctatgagatggagatgatgggttaggcatgatcttttctataggg

SEQ ID NO: 81457 - protein, 37 aa, Zea mays
  misc_feature: Ceres CLONE 1566934
MRAKEPSKKLIDLGVCFLPFDVTIRETVDCFRSKGLI

SEQ ID NO: 81458 - DNA, 836 bp, Zea mays
  misc_feature: Ceres CLONE 1566937
  misc_feature: Encodes the peptide sequence at SEQ ID NO. 81459
  misc_feature (758)..(758): n is a, c, t, g, unknown, or other
ctccccgcggtggcggccgctctagaactagtggatcccccgggctgcaggaattcgtctcacccctagaaaaaggcggtcgtgaaccgaacaaacctttccccaaaatttcccctcccccgcaccgaacgaactctcgatccgatcccgatccctgcagggagccgcctcggctcaccgatccggccccggatccgctcgttgctcgacgggatctctcgatcgcggtctggacaagcatgctgcatcaggagaacagtgaggctttcgggaggcaccactctgagcagcttgcatgtgtcaacatgaggggagcagataatggtcatccgaatttccttcctgagaaatgccagattgcaggtgataacttagcagcatcctcttagctgcgctagacatttgtcttgactctaatacatgtttagtttgtcctgaagttcaccgaaggggtgaaaaagttggactatttgatgaagagctggtacatggtgttcatctaaccagtccttgtgttcagtcaccattggtgccaagtggtgtcaaagaaacacctatagtggatcataacaagagacctgcatccagtgacatactggacatagttgaatgcaaacggctgaagcaggaagatcaaatcgttactaaggaagacaaccatacatctgctgaggaggattttcatgactaccccacatacacgacttgcgaaagaagctttgactcaccactatatgagagtgaggaaagtgaagatngagggtgtagattcacctctccattgttcacatgctcgccccctatgtgaagatggtctatggcctgccagctttcat

SEQ ID NO: 81459 - protein, 49 aa, Zea mays
  misc_feature: Ceres CLONE 1566937
MLHQENSEAFGRHHSEQLACVNMRGADNGHPNFLPEKCQIAGDNLAASS

SEQ ID NO: 81460 - DNA, 811 bp, Zea mays
  misc_feature: Ceres CLONE 1566939
  misc_feature: Encodes the peptide sequence at SEQ ID NO. 81461
  misc_feature (726)..(726): n is a, c, t, g, unknown, or other
ccccgcggtggcggccgctctagaactagtggatcccccgggctgcaggaattcgtctcacccctagaaaaaacggctcccaccagcgtgagtgcgtgaccagccccaatgccctccaaaccctagtccacagctcctgtaccctggcggccatgccggatctgagcaccagctacctccctcccttccctgaactgtccctcgatgcgggggccctcgctgtcgaccacgcggggaatgctgcagccgccgcctcggccgatgcggcgtccgcgtacgcgtcttcgtctgcctctgtgggcagcggcgtagacgacctcgttattccagcggaatgccggtggaagggccatgtccgcaccttcgacatggcgggcgcgggcgctgtcaccacttgccccgccgcgcggcgtggcggcgggaagaagctgtcactgattccgtcactcgagccggcacggacgcaggcttcagcatcggctccgacgctcgaggaacgcgtgagcgagtgggcggctaagaaggcagcggccggcgttccgactcatcactgcgtgctgcctttcctcaccggggcgccaatggcggtcgaatgtcgtttgtgctcaagattatttatgttggagaaagaataaaatgttcagttaaaaagtgtccacaaatgttccatctcaaatgtgttgcgggagatactcaaacttttacgttgaaagcctcaggtgcccntcacatgggtgtatgggttgtaagcaaaagatgttcttttggcgctgcggacgttgtacaggtgcagcacatacgaaatggcact

SEQ ID NO: 81461 - protein, 160 aa, Zea mays
  misc_feature: Ceres CLONE 1566939
  misc_feature: SWISSPROT Homolog: EC 2.1.1.43 Histone-lysine N-methyltransferase
MPDLSTSYLPPFPELSLDAGALAVDHAGNAAAAASADAASAYASSSASVGSGVDDLVIPAECRWKGHVRTFDMAGAGAVTTCPAARRGGGKKLSLIPSLEPARTQASASAPTLEERVSEWAAKKAAAGVPTHHCVLPFLTGAPMAVECRLCSRLFMLEKE

SEQ ID NO: 81462 - DNA, 924 bp, Zea mays
  misc_feature: Ceres CLONE 1566941
  misc_feature: Encodes the peptide sequence at SEQ ID NO. 81463
  misc_feature (348)..(348): n is a, c, t, g, unknown, or other
ctccccgcggtggcggccgctctagaactagtggatcccccgggctgcaggaattcgtctcacccctagaaaaaaaagaatgtaaatctggtggtcaaaactggacagaaggttgcaatatgcggcgaggtaggatcaggaaagtctacactgctggctgcagttcttggagaggttccgaaaactgaaggcacgatccaagtttgcgggaaaacagcatatgtttctcagaacgcatggatccaaacaggaaccgtgcaggacaacattctctttgggtcttcgatggacagggcaaggtaccaggaaacactcgagcggtgttctttagtgaaggatcttgagatngtgccgtatgaagacggtactcagatcggcgagcggggcataaatcttaacggcggtcaaaaaccaccttgttcaccttgctcgtgccttgtaccaaaaagcaaaattttttttccctggagaacccttttccccgcgtttgatgccccccccgacaccaagttttgttaaaaggaattttccggggagaccttttttcaaaaaaaaatttttttttttttgggccccccccaaagtgatttttttccccccgggtttccaaattttttcttttttaaatttcccaaaggggcaaaattttcttccgccccgcccccctacaaagggatttgtgggggggtgttgtgaaaaatattttcacacccctctttttgtccccccacaaaaacacccttttgggggttttttaattaaataaggggggggcccccccccccaaaaaaaaaaaaaatatttttttttctcacaacaattttttttttttttttgggggaaaaaaaaaaaaaatatttttttctcctcccccccccccccccctctctttttttaaaaaaaaaaaaaaaaagagagtgtttt

SEQ ID NO: 81463 - protein, 77 aa, Zea mays
  misc_feature: Ceres CLONE 1566941
  misc_feature: SWISSPROT Homolog: EC 3.6.3.44 Xenobiotic-transporting ATPase
  misc_feature (21)..(21): Xaa is any aa, unknown, or other
MDRARYQETLERCSLVKDLEXVPYEDGTQIGERGINLNGGQKPPCSPCSCLVPKSKIFFPWRTLFPAFDAPPDTKFC

SEQ ID NO: 81464 - DNA, 814 bp, Zea mays
  misc_feature: Ceres CLONE 1566946
  misc_feature: Encodes the peptide sequence at SEQ ID NO. 81465
ccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtggtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctgggccaagtcggcatcggcgacgagtcgtacatgcccgcgctgcgtgttcgaggcccacgccagctgccccaccatgaaggagggcgccgccgagcgtcaccgtcatgttcgcggcgctgggacagctgtcgacaagtg

SEQ ID NO: 81465 - protein, 96 aa, Zea mays
  misc_feature: Ceres CLONE 1566946
  misc_feature (1)..(96): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSRPRPVYLIDFACYKPADELKVSKAEFIDLARKSGKFDEDSLAFQSRLLGQVGIGDESYMPALRVRGPRQLPHHEGGRRRASPSCSRRWDSCRQV

SEQ ID NO: 81466 - DNA, 819 bp, Zea mays
  misc_feature: Ceres CLONE 1566948
  misc_feature: Encodes the peptide sequence at SEQ ID NO. 81467
  misc_feature (392)..(392): n is a, c, t, g, unknown, or other
  misc_feature (394)..(394): n is a, c, t, g, unknown, or other
tccccgcggtggcggccgctctagaactagtggatcccccgggctgcaggaattcgtctcacccctagaaaaaattcaccccgacgcccctcctccgttcgctttccccctcctcgcctcgggggtgcgtgaatttcgactagggtttcgcggaccgagagggaggggagaggagagggcgggtagggtttccgcggacgggccccgcatggcctcggcggcggcggcgccggccgcgggggagaagaagggcgcgggcgggccggtcacgggggacatggtcagcgcgggcttcgcggagctggagcggcagcagcggctgctcgccacctgcacgcgcctctaccagcacctgtctgaccacttcggctcgctcgagcgcgggctcgccncncgctccgacgcgctccgcgtccgccgcagggcattcgacgcgcgcacccaccgcgcgctcgactcgctccaccgccgcgaggcctccatcgacgcctccgtctcgcgcgcgctcgaccacctccactccatctccgccaaggggtcaccgccggctccggatccggcacacgccgccggcgccggcgcggccgagggcctgcgcgccctctgcgcgcggatggactccaccgcgttcctgggcttcgtggtggcccgtcgcaaggaggcggacgcgctgcgggcggagatgccggcggcgctcaagctctgcgtggaacccggcaaagttctcatgggagcccgtcgcgaaggtcttcccctccaccgcccgcagggcccggaaccccgcccaacctgccctgggcctgcgggctcctccccgga

SEQ ID NO: 81467 - protein, 203 aa, Zea mays
  misc_feature: Ceres CLONE 1566948
  misc_feature (62)..(62): Xaa is any aa, unknown, or other
MASAAAAPAAGEKKGAGGPVTGDMVSAGFAELERQQRLLATCTRLYQHLSDHFGSLERGLAXRSDALRVRRRAFDARTHRALDSLHRREASIDASVSRALDHLHSISAKGSPPAPDPAHAAGAGAAEGLRALCARMDSTAFLGFVVARRKEADALRAEMPAALKLCVEPGKVLMGARREGLPLHRPQGPEPRPTCPGPAGSSP

SEQ ID NO: 81468 - DNA, 814 bp, Zea mays
  misc_feature: Ceres CLONE 1566949
  misc_feature: Encodes the peptide sequence at SEQ ID NO. 81469
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (814)..(814): n is a, c, t, g, unknown, or other
ccccgcggtggcggccgctctagaactagtggatcccccgggctgcaggaattcgtctcacccctagaaaaatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttcacccccccccacctgctctacgggcgaggattgatactgcctttaagtttggtcctgacgttgactttgttctgacttacaccgatgaggatggggatgctgcaaagatgagcctccaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttn

SEQ ID NO: 81469 - protein, 87 aa, Zea mays
  misc_feature: Ceres CLONE 1566949
MSDWSSPAAPTFFPFGPQAEGWDVTFKVKYGDTLKRFYGCANGSHFHPPPPALRARIDTAFKFGPDVDFVLTYTDEDGDAAKMSLQG

SEQ ID NO: 81470 - DNA, 1098 bp, Zea mays
  misc_feature: Ceres CLONE 1566950
  misc_feature (1)..(1): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (83)..(83): n is a, c, t, g, unknown, or other
  misc_feature (84)..(84): n is a, c, t, g, unknown, or other
  misc_feature (86)..(86): n is a, c, t, g, unknown, or other
  misc_feature (87)..(87): n is a, c, t, g, unknown, or other
  misc_feature (97)..(97): n is a, c, t, g, unknown, or other
  misc_feature (99)..(99): n is a, c, t, g, unknown, or other
  misc_feature (101)..(101): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (114)..(114): n is a, c, t, g, unknown, or other
  misc_feature (116)..(116): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (124)..(124): n is a, c, t, g, unknown, or other
  misc_feature (126)..(126): n is a, c, t, g, unknown, or other
  misc_feature (127)..(127): n is a, c, t, g, unknown, or other
  misc_feature (135)..(135): n is a, c, t, g, unknown, or other
  misc_feature (137)..(137): n is a, c, t, g, unknown, or other
  misc_feature (141)..(141): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (158)..(158): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (182)..(182): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (188)..(188): n is a, c, t, g, unknown, or other
  misc_feature (189)..(189): n is a, c, t, g, unknown, or other
  misc_feature (209)..(209): n is a, c, t, g, unknown, or other
  misc_feature (244)..(244): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (809)..(809): n is a, c, t, g, unknown, or other
  misc_feature (992)..(992): n is a, c, t, g, unknown, or other
ntggtgtggtgggngggnngnnnnggngngtnnggtnnggggnnnggnnnnnnnnggtnnnnnnnnnnngngnngcnnncgcnncnnctcctctcgngntnggnnntnnnntgntnttnnnttngnnccctgggncntctnctcccctctnnnnnngngnnnnnnnnnnnnnnncctctttntnnntnnttcaaagctggaactcaccncggtggcgggccgctctagaactagtggatccccncgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgacggcgtcgacaactaccgcagcaccaagcagctgatggcgggccaccgtatcttccctgcctgagcctcgtccccacccgtgcaccaccggggccggggggtttccccaaccatgggggcacttgaaaaaaaaaccctttaaacgccggttcattgttttttcccgcccccaatttttgggggggctccccccccgggggaaaaacaaaaaggccccaaaaaaaggaggggggccccccccccccctgggggaaaaaaaaatttccgaagggggaacaggggggaaaaacccctcaagaacttttttttaaaaaaagaggggccccccccgggggccacaaaaaaaaaaaaaagggggggggagaaaaccttttttctccccccccnnnncnccggtgggcgcccccccgaaaaaaatttgccccccacggggggggaaaaaaaaaaaaaaaaaaatgggggggagaggaggggttttttttttttgttgaaaaccccccctcttttttaaggggggggggggtggggccccccccctcccccgggggagaaaaaatttttttcccccccccccngggggggaggaaagatatttccccccccgggggggcccccctttataaaaaaaaagaaatttttttaaaaaaaaaaaaaaaagagaattttttccccccccccccg

SEQ ID NO: 81471 - DNA, 723 bp, Zea mays
  misc_feature: Ceres CLONE 1566956
  misc_feature: Translation starting site: 159
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttgcaggtcatttctggggcctggtgagaaagcaatgattgttgtccagcacaatggtgaaggagagcagtttgcagcttgaagagatctcctctatgggtctttatcaaaatgcggggaaattggctgaccctttccccttgggtaacccccatccaaaaatgtcctgggggtccccaggtccctgggccttcctttcaaaggaaaccccccccaaaggggcggggccccccaaaaaaggaactccctgggggggggggaaattttgccccgggcccccttc

SEQ ID NO: 81472 - DNA, 799 bp, Zea mays
  misc_feature: Ceres CLONE 1566958
  misc_feature: Encodes the peptide sequence at SEQ ID NO. 81473
ccccgcggtggcggccgctctagaactagtggatcccccgggctgcaggaattcgtctcacccctagaaaaaagctggtgcatgcgcggtcagacaacaattgcctctgatacgacgacgtggcttcctcggttgccgctgttcatctagccgcagtggcgactcggcatacactttctttcccagctcgaacataccaaatctggattcaaatcctgaggtatgctacaaccgaagccgatgcgcgcaagacattattaattggctagactaggcctgtaggtccgaaatcatgaagcgcgagtaccaagacgccggcgggagtggcagcgacttgggctcctccaacgacaagatgatggcagcggcggcgggagcatgccaacatgatgaggatgacctggatgagctgctggacgagctcggatacgacgtgcgttcgtcagatatggcggacgtcgcgtacaagctggagcagctcaagatggccatggatatcggctgcgtgcgtcgctctagcactacaggagatgattggtgactgtcgcacttcgacacggacaccctgccctgcaatttcccccgaacatggaatcacttgggccaagagtaggctgttgcaaggctaacgtcgcccccagtgccaggtttccggctatgaaccccggtccccaaagggggggggttccaattttgggtcacccgggggaaaaacggggggcccccacccaaggggggggggggggaaaggtttaataaaaaacccccccccccgggggggaaaacacttttcccaggg

SEQ ID NO: 81473 - protein, 82 aa, Zea mays
  misc_feature: Ceres CLONE 1566958
MKREYQDAGGSGSDLGSSNDKMMAAAAGACQHDEDDLDELLDELGYDVRSSDMADVAYKLEQLKMAMDIGCVRRSSTTGDDW

SEQ ID NO: 81474 - DNA, 848 bp, Zea mays
  misc_feature: Ceres CLONE 1566962
  misc_feature: Translation starting site: 228
tggagctccccgcggtggcggccgctctagaactagtggatcccccgggctgcaggaattcgtctcacccctagaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgatcaacattgcatcaggcacatcagagaacactaaggtggtggtttgagagtggtgctgtgcccatctttgtcaagctactcaactccctcagcgaggatgtccgtgaacaagctgtatgggctttaaggtaatgttgctggggactccccaaagtggcctgatctggtacctgggtcatgggggggctaaaccctttgctgcaccagccttaaaggaacatcctaagcctttcaatgctttaggaatgccccaagtgactctcctcaaactttctgttggt

SEQ ID NO: 81475 - DNA, 822 bp, Zea mays
  misc_feature: Ceres CLONE 1566964
  misc_feature: Encodes the peptide sequence at SEQ ID NO. 81476
tccccgcggtggcggccgctctagaactagtggatcccccgggctgcaggaattcgtctcacccctagaaaaagttccgcttcggcccagcctctagttcttcctttcctccagagtgatggccaaatgctactcagattggccaacgattccgcctttcctccatcgcgaagaacgccgccggaatcccacgcctccgcgatcacgatcaggcggcagctcgtgtccttcgtgctacagagctccagatcatgcgctcgcctcctccagcccaacaacctgacccgatgagatagaggccgtgccggcaacgacaaatccgccactgccggacggcgccccgaaactggggatttctaaacagttcatccgaggcctcttgcggcgacccgcataccgagcagctggacttccagggctacaggatggcgctgatgcaccccgagttcccgctggagaagaagaccgtcaacgcgctgaccctgcagctgatcatggagaagcactggggctcgctgagagctgctggtctaggacttcagggcccactgcgtgatcccagagacactgacttgcgcgcggctcatcacctgctgcatcagggcgagactggttcggactcccctacgcggtgctcggggtcgtccagtcgaagaagggagcccccactgccatggatcttcatcgcggccatgcaggcggtacacaccgctgcacatgtagcatcagaaccgttgctcctgtacgggctagaccagggttggtccggcctgcctaatgaacgacccaaagaccttaccgtgggcctcaaatggaaggccc

SEQ ID NO: 81476 - protein, 132 aa, Zea mays
  misc_feature: Ceres CLONE 1566964
MALMHPEFPLEKKTVNALTLQLIMEKHWGSLRAAGLGLQGPLRDPRDTDLRAAHHLLHQGETGSDSPTRCSGSSSRRREPPLPWIFIAAMQAVHTAAHVASEPLLLYGLDQGWSGLPNERPKDLTVGLKWKA

SEQ ID NO: 81477 - DNA, 1298 bp, Zea mays
  misc_feature: Ceres CLONE 1566965
  misc_feature: Encodes the peptide sequence at SEQ ID NO. 81478
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (766)..(766): n is a, c, t, g, unknown, or other
  misc_feature (1298)..(1298): n is a, c, t, g, unknown, or other
aaagaaaaaataacgcgggaagctctctatatcatccctcctcttcttccccccccacacccatttataaaaaannnnnnnnaaaaactgggagctccccacggtggcggccgctctagaactagtggatcccccgggctgcaggaattcgtctcacccctaggaaaaccatgagcatatccacactctcatgactcccacttggatgtctactactactactgaataaaaaaacctcttcgcgcaaaataacccatgtgcgtttagcatcaattcatcagctagaagttcgaaatgggggtcaagtttttagtccttcacggtgttgtcctggcctctcttgtcttccaggacgtggcatttgctacacagctcactgaggccaataatgaagatgaggcaaacaacctgccacaaggtagactgactgaattcaacgatgagaaaaccgccacgtggatataacggacgaacatcccccaccccctcttttgacccagacaatatagtggccccacgtaaaatactgcccacctctcgtgcatacccatccatcacccaccatcccttctactcccccttcccccttgtctcccctactatatacccttcgaaaaactaagctactttcccacttccaatctcactttcaacccttaaactggatcgggccacatctccacgcataaacgcctcatacaatccaggtggctgtctctactctgtgtgaagaccatcccacacacaactcaaataccgcctatcnctaatacctgagactactacggccgacactagcataaattatgaactgcaagacataattttttctctcccccactcactccactatgtctcctccccctatttgtacgccccagcgccggaaaaaggtaacacatgtacatcacggtgttttgatctctccacccgatcaaagcactaccttctatccctccttctgaatgcgcgcagccactttccgtccgcgccctcgtaatatgtgaccgtgtgtgtagtaactcgtaataattttcctatcgagcggatgtctcttaagtttaacctgcgcaggcatagctatgtgcccctcgaataatcccacgcacccgccacgcctagccccatcggcatcgccacttagttgaatgtatacttctcctcacctattccattgcgagttaccaacatctcaaattttattcctccttcaaactactcaaaatatgaactgtgaatagcgggcttttcctccacctgttgagatggtgtttcctctcctttctcaagtccccttn

SEQ ID NO: 81478 - protein, 56 aa, Zea mays
  misc_feature: Ceres CLONE 1566965
MGVKFLVLHGVVLASLVFQDVAFATQLTEANNEDEANNLPQGRLTEFNDEKTATWI

SEQ ID NO: 81479 - DNA, 876 bp, Zea mays
  misc_feature: Ceres CLONE 1566970
  misc_feature: Translation starting site: 133
  misc_feature (384)..(384): n is a, c, t, g, unknown, or other
  misc_feature (457)..(457): n is a, c, t, g, unknown, or other
  misc_feature (481)..(481): n is a, c, t, g, unknown, or other
  misc_feature (493)..(493): n is a, c, t, g, unknown, or other
  misc_feature (502)..(502): n is a, c, t, g, unknown, or other
ctccccgcggtggcggccgctctagaactagtggatcccccgggctgcaggaattcgtctcacccctagaaaaaacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttnaatgatgggacagtggtcctgcagtttgaagtgagacttcagaatggccttgaatgtggaggtgcctacattnagtacatccgccctcaggatgctngatgggatgccnaggagtttngatatgagactccatacactatttatgtttggtccagataaatggtgggtcacccaccaagtttcatttcatctttagccccagaatccttaaactggaaaagtatgttgagcatcaccctaaattcccccctttcgtgtccaatcagacaagttctttcttgtcttcccggtttttttaaacccaaacaagggggtcaaaatttttgtcccctgggggaaaaaaaaagaaaagggaaacttcctttcgcgcgggaactttgggcccgccttttttcctctccagaaactttttcttcccctttttaaaaaaaacccgggagaagtggggtggaaaggggaaaaacccccgtttcccaaagagggggggccggg

SEQ ID NO: 81480 - DNA, 817 bp, Zea mays
  misc_feature: Ceres CLONE 1566974
  misc_feature: Encodes the peptide sequence at SEQ ID NO. 81481
ctccccgcggtggcggccgctctagaactagtggatcccccgggctgcaggaattcgtctcacccctagaaaaagtcctccctttcgtcgtcgcttccctccccttcccgttcgaatcctctgaccaccgcagagcctcccccctgaggaaaccctagcgcagccgccgaccgccgccgacccgtagcatggcgtccccggcccggcccgtcgccgcgtccgtctccggcgccttcggcctctcgcccgaccccaagcgctgctccttcgaccaggcgctccggcgcaaggatttccaggagaacaggctgttgatgtcatttgttaatttggatgagcaagagaagatctctaaagaaatcgtaacacacgctatacaaagctgcatgaagaaacaagcacatgacctgttgaattcactggacgttctcagctgtaggttgtcacaattggagttatactgctatagactggaaaggtccattggagaattacgaactgacttgatggattatcataacgaagcaaatctgaacttccggtgcgttgaaaaggaagtgaaagaggttcagaaatctgtgcatgctgtacacgaaaagcatgagcttgctgaaactcataaagatatgaccaaacttcagatagtacatgaggattctgcacaacagagtgcaggtactgctccatcagttttcatgactacgggaaaatgaggttgccccttgtggcatttcacctaagtaaatgctgctccaggcaccttgctgtgccatttcccaagttgggggggggacgttttttctacagcagcctgata

SEQ ID NO: 81481 - protein, 174 aa, Zea mays
  misc_feature: Ceres CLONE 1566974
MASPARPVAASVSGAFGLSPDPKRCSFDQALRRKDFQENRLLMSFVNLDEQEKISKEIVTHAIQSCMKKQAHDLLNSLDVLSCRLSQLELYCYRLERSIGELRTDLMDYHNEANLNFRCVEKEVKEVQKSVHAVHEKHELAETHKDMTKLQIVHEDSAQQSAGTAPSVFMTTGK

SEQ ID NO: 81482 - DNA, 834 bp, Zea mays
  misc_feature: Ceres CLONE 1566976
  misc_feature: Encodes the peptide sequence at SEQ ID NO. 81483
gcggtggcggccgctctagaactagtggatcccccgggctgcaggaattcgtctcacccctagaaaaaggacgtgataagacccccaccccgcagccgaatgaagatacatgtcagatcggacgagggggaactgtgagcagctctgtccgatgaccacttggttggcggatgactcaggccaacaggtgctttgctaaggccgatcatagtgccctcaactgcaccaccggcttcggcacctgtggggggatcccaccccgaggtagcgtccgcacccacgcggaccggatctggtcccagccgatgctacgaagccagtgtctggatgacccccactgacatacctacgaagaggacggcggacttgatgcaccacacgcaatggattaacccccacaccctccacaagcctgataaaagatgctaaaggtcgcggcaagtggctctactgctactccactgcgcggcggtgctagcgttgatgaccacctctcggcatactgctacttcttacgaaccatgggtctgatacatgtcgcgatacggggtttggacattttgggctaggttgtacagcatgggtatggagaaatgagggcctcgacatggagggaggtaaactaccagatcggcatagacattcttttggctgacgattaggtattggtttattaaacaggggctaaagtctggaactaccctcaatcaaatcctttaaaaactgggtaaaaaaaataggccgctttgaaccataaacccgtgtgcgaaggaaaattttaggaaaagggttttcgccgatattcttggggaaagtagaccgacctttccctct

SEQ ID NO: 81483 - protein, 56 aa, Zea mays
  misc_feature: Ceres CLONE 1566976
MTQANRCFAKADHSALNCTTGFGTCGGIPPRGSVRTHADRIWSQPMLRSQCLDDPH

SEQ ID NO: 81484 - DNA, 843 bp, Zea mays
  misc_feature: Ceres CLONE 1566978
  misc_feature (798)..(798): n is a, c, t, g, unknown, or other
tacccgcggtggcggccgctctagaactagtggatcccccgggctgcaggaattcgtctcacccctagaaaaaggggggcgcgcgcgcgcgagcgagctgtgagcatcgcgttcctctcgcgctctcggctctctcgctccttcccgcggtcgcctccgcccgtgcccgtgccccgtcccaactcccacccaacatttcccaacccctccgggctccggcaccgcgagatgtttcgttagccattcccacgacacaatcagcaccaccggtgccctcgctgccaaggcgcccgctcgtgtgacgaggggcgctccaccaccgccccatgcggcgcttaagctccgaagccctcccggtttcgccggggggaataaattttccggggtttccttccccccccccgggggaattaatctagggggggggttctttccccccccccccccctgggggggggggcccccttttgaaaaaaaagaaaaaaccccgggaaaaatttttgggtttttttagaaaaaattgtccgccgccttcctcctggtggggagaacacccccccctttatatataaaaaaaagaggggggggggaaaaaaccctcccccccccccggggttttttttccccccccaggatgggtgggggcccgccccccccacacaaaaaaaaaaaaaccccccatgtgggcgcggggccctccctcttggttgcgggggaaataatttaatactcccatcgttgtgttaaaaaatttttttttttttaaaaaaaaagggggggggggggcgcgacaacaanaaaaactcctccccgccacaaaaaaaaaaaagaacaaaaaacacg

SEQ ID NO: 81485 - DNA, 726 bp, Zea mays
  misc_feature: Ceres CLONE 1566979
  misc_feature: Encodes the peptide sequence at SEQ ID NO. 81486
caccgcggtggcggccgctctagaactagtggatcccccgggctgcaggaattcgtctcacccctagaaaaagggaccgacgggcgagagagcggaagcgacgactagctctgcggcctctgccccaagcgccgacgatgggtgccggtgctactgccagggacgaggaggctgctaccggccaccaccatgggaggaagccgcatggcgcagcggcggagtacgcgcaggacgggtccgtggacctgcgcggcaaccccgtgctccgctcccagcgcggcggctggaccgcctgctccttcatcgtcgtgtacgagctgttcgagcggatggcctactacgggatctcgtccaacctcatcatctacctgacggacaagctccaccagggcaccgtcgaggcctccaacaacgtcaccaactggtccggcaccgtcttcctcacgccgctgctcggcgcctacgtcgccgacgcctacctcggccgctactggaccttcgtcgtcggctccgccatttacctgctgggggatggtgctgctgggtgctgtcccgtctccggtgcccggggccttaaaaacccccccccccccctttggggggccccccgggggggggggggggcccccccagggggtttgggggcctctcccattttggggggggttttttttggggggggccttatataggggggcccccgggggaaaaaggggggcccaaccc

SEQ ID NO: 81486 - protein, 184 aa, Zea mays
  misc_feature: Ceres CLONE 1566979
MGAGATARDEEAATGHHHGRKPHGAAAEYAQDGSVDLRGNPVLRSQRGGWTACSFIVVYELFERMAYYGISSNLIIYLTDKLHQGTVEASNNVTNWSGTVFLTPLLGAYVADAYLGRYWTFVVGSAIYLLGDGAAGCCPVSGARGLKNPPPPLWGAPRGGGGAPPGGLGASPILGGVFFGGGLI

SEQ ID NO: 81487 - DNA, 633 bp, Zea mays
  misc_feature: Ceres CLONE 1566981
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (600)..(600): n is a, c, t, g, unknown, or other
tggagctcccgcggtggcggccgctctgaactagtggatcccccgggctgcaggaattcgtctcacccctagaaaaaactccgcagtgtcagtcactgcccccccatcacgccgcccgccctttctcggccgttgccgcgagctcgctccgacccaccgccaatggcgacggcgatgggcgcgatggccgccacctgcatggcctcgatgccggccgccgctacgtttccccggtgatctcggcgtcggacgacgcgagcggctgtaccaggtggcgccgccggtgggggaaaaaaagggtttgctttcgaaccccccctgcccggaaggctgttcctggtttttccccaaaggggggtttttttggaaaaaatatttccccggggggggaaacttcttcaaaaaaaaagggggcccttttttttcccgcggagaacccccccccccccccccccaggggggtttttttttgggggggaaaaaccccccccctgggggggaaaggggggggggggtttttttttggaaaaaaaaaaaaaaaggggggttttttttttttcccccccccccccgccgggggggggggggannnnaaaatanaaaaaaaaggggggagagggggggggggggcca

SEQ ID NO: 81488 - DNA, 825 bp, Zea mays
  misc_feature: Ceres CLONE 1566982
  misc_feature: Encodes the peptide sequence at SEQ ID NO. 81489
gcggtggcggccgctctagaactagtggatcccccgggctgcaggaattcgtctcacccctagaaaaaagcgcgactccgtgcgacggcgaggcctctgtcccgtcctcgtctcctcgaggcccggaggctgcgagtctgtgacacttgaccgtgaggcggacggcgactcggaggacttcaccagcgagtccctcaagcaccgaggccgagccgcccaccgcccgccgccgcctcgcctggcgctagtcgccgttgccgagcctgttcggcacatccgttggggtgccggggcaccgatcaggctgcgcacagccgaagtcggcctccgggtgccccaagctgcagagcagcgcgccagcgcccgtggaccggtgaatcagactacccttgtttcaaatcctgggtccgccattgggggcggtgaggccaccctagtagaggctagaggatgatatacactgcgatcgacacgttctacctgacagatgagcagctccgtgactcgccatcacggaaggatgggatcgacgaggccaccgagactgcgctccgcgtctatggctgtgacatcatccaggagagcggcatcctcctcaggctaccacaagcagtgatggccaccggcacaagtattgttccatcgctttttactgcaagaaatcattttgttcgatttagggggcaaagagagttgctgcctagcctgtgtttggccgggcagggaaatttggaaggagagtccccgcgaaattccagcgcctattattatttggccctccaacaaaaatgggaatgtgtaggaacaaaaaaacttggccaattt

SEQ ID NO: 81489 - protein, 125 aa, Zea mays
  misc_feature: Ceres CLONE 1566982
MIYTAIDTFYLTDEQLRDSPSRKDGIDEATETALRVYGCDIIQESGILLRLPQAVMATGTSIVPSLFTARNHFVRFRGQRELLPSLCLAGQGNLEGESPRNSSAYYYLALQQKWECVGTKKLGQF

SEQ ID NO: 81490 - DNA, 798 bp, Zea mays
  misc_feature: Ceres CLONE 1566983
  misc_feature: Encodes the peptide sequence at SEQ ID NO. 81491
gcggtggcggccgctctagaactagtggatcccccgggctgcaggaattcgtctcacccctagaaaaggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgggctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttccacgaagacagcctggcgttcccagtcgcgtctgctggccaagtccggcatcgggcgaagagtcgtacatgccgcgctggcgttgtttcaagccccaacgccagctggcgcccccattgaaagaggggcccccccccaggcgttcccgggccttgtttccgggtgcctggacaaccctgttccaaaaaagggccgccgtccgggccccaggaacttggggccttgcttggtgggttcaaacttgacagtctttttttaaacccagagcccc

SEQ ID NO: 81491 - protein, 214 aa, Zea mays
  misc_feature: Ceres CLONE 1566983
  misc_feature: SWISSPROT Homolog: EC 2.3.1.119 Icosanoyl-CoA synthase
GGGRSRTSGSPGLQEFVSPLEKAREEQALLSTEIVNRGVEPSGPDAGSPAFSVRVRRRLPDFLQSVNLKYVRLGYHYLISHGVYLATIPVIGLVCGAELGSLSRDELWRKVWGEATYDLATVLAFLAVLAFTISVYIMSRPRPVYLIDFACYKPADELKVSKAEFIDLARKSGKFHEDSLAFPVASAGQVRHRAKSRTCRAGVVSSPNASWRPH

SEQ ID NO: 81492 - DNA, 795 bp, Zea mays
  misc_feature: Ceres CLONE 1566987
  misc_feature: Encodes the peptide sequence at SEQ ID NO. 81493
ctccccgcggtggcggccgctctagaactagtggatcccccgggctgcaggaattcgtctcacccctagaaaaaaaaagttactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagcattgaaaggacctttccctagtacgagaggaccgggaaggacgcacctctggtgtaccagttatcgtgcctaccgtaaacgctgggtagccaagtgtggagaggataactgctgaaagcatataagtagtaagcccaccccaagatgagtgctctacagagatacctcaaaacccaaccaggccggcgtccaggtgtccacagaaagaggagagcacacagagcgggagatcatggagctctgcgtctctaccaccgcctccgtccgcgccaccgccgcgcccatatccttcgcgccgccccggcgaggcgcgtctgcttccaccgccctcccgctccaccgacgaatcccaactcgaggctggtgttgcgccagcgcggccgtgcctgacccggcgccctccgaagagctcgcatccgcctcctacaccgtcgtcgtcgcggacaagcccgattcgcctgccgatgacaaggtcgacgaggttagcggcgcgcctagtggctccgcaggagcgaccg

SEQ ID NO: 81493 - protein, 95 aa, Zea mays
  misc_feature: Ceres CLONE 1566987
MELCVSTTASVRATAAPISFAPPRRGASASTALPLHRRIPTRGWCCASAAVPDPAPSEELASASYTVVVADKPDSPADDKVDEVSGAPSGSAGAT

SEQ ID NO: 81494 - DNA, 900 bp, Zea mays
  misc_feature: Ceres CLONE 1566989
  misc_feature: Encodes the peptide sequence at SEQ ID NO. 81495
  misc_feature (900)..(900): n is a, c, t, g, unknown, or other
taaagctggagctccccgcggtggcggccgctctagaactagtggatcccccgggctgcaggaattcgtctcacccctagaaaaagacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagccatggccatggatcccgttctgaaggtggccctgggctcggcggcgttcgccgtgttctgggtgctggcggtgttcccggcggtgccgttcctgcccatcgggcgcacggcgggctccctgctgggcgccatgctgatggtgctgctgggcgtgatgagcgccgacgacgcctacgccgccgtggacctgcccatcctgggcctgctgttcgggaccatggtggtgagcgtgtacctggagcgcgccgacatgttccggcccctggggggcctgctgtcgtggccggacccaagggcgggcgggacctgctgggtgggcacctgccccgtgtccggcgttggcctccgcggttcttcaaccaaagagacccctggtgcgtcggggcgtcccccgagcttcatcccccaaaaaagtgcgcggccaaaaaaacaacctggccccccgcgcccccgttacttggttgggagccggggcgttccagagggccaaacatggggggttccgggcggaaaacgggcgaggtagtggcaaaccctcttaaagaaacgtggtggtaatcccgccgcgtgtaatagagcggggatttttcttcctn

SEQ ID NO: 81495 - protein, 174 aa, Zea mays
  misc_feature: Ceres CLONE 1566989
MAMDPVLKVALGSAAFAVFWVLAVFPAVPFLPIGRTAGSLLGAMLMVLLGVMSADDAYAAVDLPILGLLFGTMVVSVYLERADMFRPLGGLLSWPDPRAGGTCWVGTCPVSGVGLRGSSTKETPGASGRPPSFIPQKSARPKKQPGPPRPRYLVGSRGVPEGQTWGVPGGKRAR

SEQ ID NO: 81496 - DNA, 845 bp, Zea mays
  misc_feature: Ceres CLONE 1566990
  misc_feature: Encodes the peptide sequence at SEQ ID NO. 81497
ctccccgcggtggcggccgctctagaactagtggatcccccgggctgcaggaattcgtctcacccctagaaaaaatctcgctctcccgtttctgctcgcaagtcacacacacagctccggtagatccggccctcgcctctggctccatgacgagattagcttcagacggcagggatcgatactagcaagcaagcaagcatggcgcacgacttgtgcgaggacttggagctcgtcgccgacgacggcggcggcttccatgactactactgggacgacgacttccatttccacgacgacggcttctccgcctcccctacgacccccggcagcggtggtgcgccccgcgcgagcagcaccagatgggtgatatttcagcctcggactacaaagaacgcgaagacatgcaggggataccctgggaaagactcaactacaccagggaccagtatcgtcggatgaggctcaaagagtacaagagctaccagaacctcacgaggacgacacagcgggctacaacaacaggaatgcaaacaggtggagaggaaggacacattctacgagttccatctgaacacgagagccgtcaagtcaacgatagtgcatttccaggtacggtttcaactcggtacttctctgtccacacacctgaccaagacgtgtttcgcgcgaggatgtgaagtgccctttgattagcgcactggaatttacattaatcttctgctcatcccatattgcccaaccgacaaaaaaaaacacagtcaggatagtagtcataccgttggcaacaggctgttacgcttgcacaattcattctccttaaggctagtttagtttgtgaactttac

SEQ ID NO: 81497 - protein, 105 aa, Zea mays
  misc_feature: Ceres CLONE 1566990
MGDISASDYKEREDMQGIPWERLNYTRDQYRRMRLKEYKSYQNLTRTTQRATTTGMQTGGEEGHILRVPSEHESRQVNDSAFPGTVSTRYFSVHTPDQDVFRARM

SEQ ID NO: 81498 - DNA, 810 bp, Zea mays
  misc_feature: Ceres CLONE 1566991
  misc_feature: Translation starting site: 125
  misc_feature: SWISSPROT Homolog: EC 1.3.3.4 Protoporphyrinogen oxidase
ctccccgcggtggcggccgctctagaactagtggatcccccgggctgcaggaattcgtctcacccctagaaaaagtgtcatccactccgccgcacaggcgctcagctccgcaacgccgtcggaaatggtcgccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctctgggaggagggtcccaacagcttccagccctccgaccccgttctcaccatggccgtggacagcggactgaaggatgacttggtttttggggacccaaacgcgccgcgtttcgtgctgtgggaggggaagctgaggcccgtgccatccaagcccgccgacctcccgttcttcgatctcatgagcatcccagggaagctcagggccggtctaggcgcgcttggcatccgcccgcctcctcaggccgccgagagtcagtggaggagttcgtgcgccgcaacctcggtgctgaagtctttgagcgcctcattgagcctttctgctcaggtgtctatgctggtgatccttctaagctcagcatgaaggctgcatttggg

SEQ ID NO: 81499 - DNA, 882 bp, Zea mays
  misc_feature: Ceres CLONE 1566992
  misc_feature: Translation starting site: 566
  misc_feature (462)..(462): n is a, c, t, g, unknown, or other
  misc_feature (529)..(529): n is a, c, t, g, unknown, or other
tccccgcggtggcggccgctctagaactagtggatcccccgggctgcaggaattcgtctcacccctagaaaaaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttgttctgaggtgtcattcgctagtgctcagagccggcttggttttctcgaaagatcagcagccactcttgattcanggacttgtcacacctgatagcatctaagtaatacatcttttatccagatggcactgcaaaacattgntgcttcaaacagggatgatgccttctacaggtacagatgccccgaatgattacaagaatgaaggtcgtggttatgggtatcaaaccaaattttggaaactgtgtgacaaaaaaaaagctttgccgggctgttttctttaaaccaaaatcttttggaggaaccttgggggccccccccaattttgtagaaaaaacggggtttcccttgtgtaagggggggctttgataaaataaaaaaggggggggggtccctttgggggttccctaaaaaaattttccccccgttttggggggggggggaatctcggaaaaaaaatttttttttttaaaacacacagagtttttccccgaaga

SEQ ID NO: 81500 - DNA, 854 bp, Zea mays
  misc_feature: Ceres CLONE 1566993
  misc_feature: Encodes the peptide sequence at SEQ ID NO. 81501
ctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgaccagcttgtggcgcaaggtgtggggggaggccacctacgacctcgccaccgggctcggccttcctgccgtcctcgccttcaccatctccgtctaaatcatgtccagggcccgggcccgggtaccttatcgaacttccaagctaaaaagccggccgaaaaactcaagggggcccaaggggggaaattctcccaccctggggcgccaaaatcccgggaaatttcacaaaaaaaaaaaccccgggggtttccaatcccggtttggggggggccaaattccggggttctggcgaaaaaaaattttaaaattgcccccccctccgcgtgttttttaaaacccaaaacacccgcggtggggcccccaccataaaaaagagggggggcccccccccccaaaagagggtctccaccacgcggctcttttttc

SEQ ID NO: 81501 - protein, 205 aa, Zea mays
  misc_feature: Ceres CLONE 1566993
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDQLVAQGVGGGHLRPRHRARPSCRPRLHHLRLNHVQGPGPGTLSNFQAKKPAEKLKGAQGGKFSHPGAPKSREISQKKKPRGFPIPVWGGPNSGVLAKKNFKIAPPSACFLKPKTPAVGPPP

SEQ ID NO: 81502 - DNA, 781 bp, Zea mays
  misc_feature: Ceres CLONE 1566994
  misc_feature: Translation starting site: 221
  misc_feature (753)..(753): n is a, c, t, g, unknown, or other
  misc_feature (754)..(754): n is a, c, t, g, unknown, or other
ccccgcggtggcggccgctctagaactagtggatcccccgggctgcaggaattcgtctcacccctagaaaaagtcgaacggaacccagaggaacagagcagacgacgcgaggcgatttctgcgggtttgcttgctccatctgtagaccttaggccgccgccgggcgaccgtgcgcgtgcggtgctcacgccccaccccgctcaggtgaaggcacttcaagatgggcgaggtacacgaagctgacaagaacattgagatctggagggtgaagaagttaatcaaggcacttgatgctgcaaggggcaatggaactagcatgatttctctcatcatgccacctcgtgatcagatttcacgcgtcactaagatgctggggtgatgagtacggaactgcctcaaacatcaagagcagagtcaacagacagtctgtggtgggctgccataaacttcggctcaacagaaggttgaagctttaccagtccaagtttccccccaaagggtttgggggcccctataaccgggaacccctttttccccccaatgatgggcaagggaaaaaaaaagggttccccttttaaatttccaagccccttttggggcccccattaaagggctctccccccggaataccccttgggaaaaaaaaaagtttcccccccacctgaggggccccctaaaaaaaaagaattttttttaaaactttttttaaaaaaaaaaaaattttgggggggtttttaaaaaaaaaaccccccnncccgggggggaaaaaggggggcccacc

SEQ ID NO: 81503 - DNA, 863 bp, Zea mays
  misc_feature: Ceres CLONE 1566995
  misc_feature: Encodes the peptide sequence at SEQ ID NO. 81504
  misc_feature (595)..(595): n is a, c, t, g, unknown, or other
ctccccgcggtggcggccgctctagaactagtggatcccccgggctgcaggaattcgtctcacccctagaaaaagtcagtgccagcgccagcggagaaaagaaacagagttcgaccggccccgccccgccccccaccgcagcgcccgcgaagccgccaaacaccaccacctatccgccagaagcctcttcctccctcgctctccctcagcggcgcgctgccaatggccgcgtggtgaagcgcacccgacggaagaagcaggcaccaacacccaagccccctgtgccttcgccgtcgctgcccgcgcaagattgagatcccggattcagacaggtgctaccattcgatttgatttggcgcggagcactttcctatggccgcctccatcgcggcctcgtccttctttccagggtcaccggcgccggccgctcctaagaacggccttggggagcgcccagagagcctggacgtccgcggcgttgcggcgaagccgggagcctcgtcgtctagtgccgtgaggggcggcagacgcgcgcccacgctgcggtccccaagatgacggtgggggcagttccccgttggcggatggggagacnaaaccgacctttctttcgggcggaaaaatttttaaaaccgtttcctgaagggaggagggtcctttggggcctaaccaaacatttttttgggcccaaaaaaaacaggggacaaactttaatgggaaaccttaggagggctgaattttttcctgaacatttttgggtttggccggaaaaaaacaaaggggggttgtttttggggaaaatttcccttatgggccccacaaaaaaggggggaaaaaaagggcctcttttaggacgccgtaaa

SEQ ID NO: 81504 - protein, 61 aa, Zea mays
  misc_feature: Ceres CLONE 1566995
MAASIAASSFFPGSPAPAAPKNGLGERPESLDVRGVAAKPGASSSSAVRGGRRAPTLRSPR

SEQ ID NO: 81505 - DNA, 920 bp, Zea mays
  misc_feature: Ceres CLONE 1566997
  misc_feature: Encodes the peptide sequence at SEQ ID NO. 81506
ctggagctcaccgcggtggcggccgctctagaactagtggatcccccgggctgcaggaattcgtctcacccctagaaaaaaaccgaatccccagaccaaatcgccgtcgccgtcgcatcgcagcagcgggagtcccagggtcccggaccgaatccatttccagacacccaaggccaagatccatcgctcgttccagccagcctttcttcttcttctgcttggtcgtctgatctcgttttccattcgtgtccaatccgatccagccaaccgctgtgaatgatggcgctcaacctgtcccaccagaccggcgcggccgtggcggcggcaccggcggcgccacgcgcggccgtcgtcgcggcggcggccacggcgccacgctcggccgtcgtcgccgcacccaccaccgtggcgccgccggccgcgtcggcgcccgcccccgctccggcgctccagctgcagacgatgacggtggacccggcccccgcgcaagcacccgacgcggtgaagcccgacctcgccaatggcgtgccaggcgctggtggaaggccccccccgaaggcggaacacgccgacgtggccgcccaagctccggaagagggccgggggggccacttccttcgaaaaagatcccccttgaaacccgggggcaaaggaaggggaacttcgctaaaccggtggcaggggccttgggaggccaaacccgggggggcctttaaaaaacccccgggggggaagggcgcccttggggggagagcctgtggggggggatctcccaaagacttaagggtcctcggagaatataaaccttcaccgcggagcacggggaattagttggaaaagcccatagaaaaacacgggctttcaggttctggcgcgccaggtgtgtttttcacgaaggggggggggataattgttgctaa

SEQ ID NO: 81506 - protein, 38 aa, Zea mays
  misc_feature: Ceres CLONE 1566997
MACQALVEGPPRRRNTPTWPPKLRKRAGGATSFEKDPP

SEQ ID NO: 81507 - DNA, 879 bp, Zea mays
  misc_feature: Ceres CLONE 1566999
ctccccgcggtggcggccgctctagaactagtggatcccccgggctgcaggaattcgtctcacccctagaaaaactctccgacatctcactagttagtcactccccatccgctgttccgcgccaccaaatccctacctccacccattcatacgcccatcccaccaaccatggccaccgcctccgactctgacgccggcgcccagccgcgcgacgaccccagccttctcccgttcgcctccttctcgttcgcgctctccatccgcgcgccggcaacccccacactcgcctctgtcccctccaccatccacctccccactcaaatctctacactcgccgtctgcctccacccctccgccgcgcagccccttccccgccgtcccacccgcctcaacccccccacctactccgtcatctccccgctgccctcctcaacgccgggcctctcccgctccttcccctcgggcgcacccgccgcctccgggcgccgccgcacgctggtctggttccgcgccgacctccgcctccacgaccacgagccgttccacgccgcagcgggggcgtcctcctcccttctcccggtcttcgtcttcgacccgcgggacttcggcaagtccccctcggggttcgaccgaacgggcccataccgcgccaactttcttcttgactcagtcgctgacctgcgccggagcctccgcgcccgccggcggggactggttggtgcgcgtgggcaggccccaaggtggtcatcccccgaactctccccgggcagcggggcgcggaaggccgtgtacgcctcacgggggaggtatcaacgggacgaaggtcggcaccgaaggaagaggggggcaaaaagggtgttggagaaaaggagggttata

SEQ ID NO: 81508 - DNA, 845 bp, Zea mays
  misc_feature: Ceres CLONE 1567003
  misc_feature: Encodes the peptide sequence at SEQ ID NO. 81509
ctccccgcggtggcggccgctctagaactagtggatcccccgggctgcaggaattcgtctcacccctagaaaaagactacatgtttttttctttttggtcggacagcatgagtaacagcagacccgcaataaacagatctcctcgttgatgactgatacagatcgctgcctcgaccccctttggaccgaccttcacacctcaggtgaaggcttctgacccccttctgaacctcaacggatagatccaggaaaaggaagggattctcccggacaagcagcggctaatttatgctagcaactgtatcgagaacgtggtggcacagttgcctactacacgatccacaaggagagcaccgtcgaccatgttgtcttctacatgggagggatacacatcttccatgagaacgtcactggaaacaatatcacccgcaacgagaagtcctctgacacaatcgacaacaagaatggtcgagactcgagacaaggagggaattcctgcggaccacggacggctcatatgtagatggcacagatctggaggagcggcgaacgctagccaactataacattgagaaagaaagcaacctccacatgtgtgtggctgtctcaagggcagcatgcagatatttgtgaagactctcactggcaagacaaaccatctagacggcgagtcttctgatactatcgacaatgtcagagcagagattccatacaaggagagagtccttccggactagcatcggctaattggtggcggaagaacctcatagcacggaaagacgcttgcgcactatatatgcagaacgagagagacgtctcttggtgcagtgtatcagaggtggcat

SEQ ID NO: 81509 - protein, 39 aa, Zea mays
  misc_feature: Ceres CLONE 1567003
MQIFVKTLTGKTNHLDGESSDTIDNVRAEIPYKERVLPD

SEQ ID NO: 81510 - DNA, 978 bp, Zea mays
  misc_feature: Ceres CLONE 1567004
aagctggagctccccgcggtggcggccgctctagaactagtggatcccccgggctgcaggaattcgtctcacccctagaaaaagccgtctgctgcagctgcatcacagaatcctcccggtcgccgggatcagatgtctccggccccacctgtcatctaccaaacaaactcccataatatctctcccagttcagtcccgtatcccccagtccccaccaggcaatcaagaacaccacctaccgctgacttgtcaattcctgtctgtgcgcgcgcgcgcgcgtggcgccggccgagcggccgttgacccgatgaccggcgcggcggccgtcgatcccccggcgcctcagccgcggtggctgacggaccttccccgctcatcgcgctcatctttctacgacgtcttcgggaagcccccttttggcatccaaggaacatcggtccccccaaagggcgggcgagccgccgccttgctcccctgaaaccctccgggctttcaattcggttccctccccccaagatcccttcctggggggcggcattcccctcaaaaaaggccccccctgtgggtccaaacagggggccccaaaaactctttccacccaaatcaggggggcttttgtttctccccccacaaacccaaaaaagacagaccgggggggggtttaacaccggggtgggaaccacactggttggggtggagttacctataccgaccagaatcttttatttagggcgcccccccctcccccaccggtgagggggaatttacccccccgaccttcaggggggggttttcacttccaaaaaaatggggggcgggatttgttggtggaaaaaatacccttcttaaaaaaaacaaaggtccgactcacaaaaaccgggggggcgcgcggattatccccccaagaaaatataaactcaaccgttaacccctagatgagaggggggaaacataggtacttttcccacctctcctcct

SEQ ID NO: 81511 - DNA, 804 bp, Zea mays
  misc_feature: Ceres CLONE 1567006
  misc_feature: Encodes the peptide sequence at SEQ ID NO. 81512
ctccccgcggtggcggccgctctagaactagtggatcccccgggctgcaggaattcgtctcacccctagaaaaagtcgggagcggcagctcccaaccatacgtccatatccccctcccaaccaaaaaaaaaactcccatcaatggcgatctgaatcaaccaaggcatctggaagcttggacatggagcggatcctcaagtccgccagggagtcgggctccctgaacctctccaatcgctccctcagggagatacccaaggaggtgtacaacaacttggacactggcagccaggatgagaaatggtgggagggagtggacctccaaaagctcattctggctcacaataatcttgaggtgttaagagaagaccttaggaacttgtcttcgcttgttgttctaaatataagtcacaacaagatatcttcccttccagcagctatcggagatctcccgttgctaaaatcactggacatgtctttcaatcaaataaacactctgcccgaagagattggcctggctactgctttagtcaaggttgacttctcaaacaattgccttactgagcttccacctaacctcgccacatgcccggacttgtccgaactcaaggcatcaaacaacaacatatccagagtaccagatgtacttgctggctgttccaagttaagtaaattggatctagagggtaacaagcttgtggcactttctgaaaacatgtttgtgtcatggacaatgctcacagaattgaatctcgcaaagaatctacttacagccatcccagaataacatcgattcccccttcc

SEQ ID NO: 81512 - protein, 201 aa, Zea mays
  misc_feature: Ceres CLONE 1567006
  misc_feature: SWISSPROT Homolog: EC 3.1.3.16 Phosphoprotein phosphatase
MERILKSARESGSLNLSNRSLREIPKEVYNNLDTGSQDEKWWEGVDLQKLILAHNNLEVLREDLRNLSSLVVLNISHNKISSLPAAIGDLPLLKSLDMSFNQINTLPEEIGLATALVKVDFSNNCLTELPPNLATCPDLSELKASNNNISRVPDVLAGCSKLSKLDLEGNKLVALSENMFVSWTMLTELNLAKNLLTAIPE

SEQ ID NO: 81513 - DNA, 787 bp, Zea mays
  misc_feature: Ceres CLONE 1567007
  misc_feature: Encodes the peptide sequence at SEQ ID NO. 81514
ctccccgcggtggcggccgctctagaactagtggatcccccgggctgcaggaattcgtctcacccccccctagaaaaaatctccatctacctacgctctcgcgagtcgcgacgacatcctccgcggagcttgcgcgggtacggcacggagatggccgcggccgggccgacgacgtccccggccacggcgggcgccgtggaggagctcacgcggctgtaccgggagctgccgccgcgcccggccgtggaggaggtggaggcggcggcggcggtgctggcgtcggcggccgcggaggaggaggcgcgcctcgccgagatcgacagggaggaggcgctggcgcgcgggggcgcgccgcccgagctcctcgacgtgctgtgggaggcccggcgcagctccgtgcgcctccgcgcgctgcagcagcgcaaggaggccgcgcacgtcctcgagctcgagaggcggttcaggctcttcgacgacctcatccagcgggcgtcgcgtcttctgtcccccggcggtggtgccggggccaggagcggcacgggtggtgccgcggtggaccacgacgaggtcgtcgaggtcgacgccacccggaacacggagctggacgccgcgccagccgagattggtcgcgggagcaagggcggcttgggactggaacccaagtccgtctcgtcgctgcgtcgtgctgcttcggcaggtactgacacagaaaagctgggccttatccaagtggcaagccttatagagtcatcggcaaagaaggggactacagagctcaatctccggg

SEQ ID NO: 81514 - protein, 212 aa, Zea mays
  misc_feature: Ceres CLONE 1567007
MAAAGPTTSPATAGAVEELTRLYRELPPRPAVEEVEAAAAVLASAAAEEEARLAEIDREEALARGGAPPELLDVLWEARRSSVRLRALQQRKEAAHVLELERRFRLFDDLIQRASRLLSPGGGAGARSGTGGAAVDHDEVVEVDATRNTELDAAPAEIGRGSKGGLGLEPKSVSSLRRAASAGTDTEKLGLIQVASLIESSAKKGTTELNLR

SEQ ID NO: 81515 - DNA, 816 bp, Zea mays
  misc_feature: Ceres CLONE 1567009
  misc_feature: Encodes the peptide sequence at SEQ ID NO. 81516
agctccccgcggtggcggccgctctagaactagtggatcccccgggctgcaggaattcgtctcacccctagaaaaacctctcccccggaatcccagaaatttccgcccacaccaaccggcacctattccgtgggcgcgaaaccctaatcggcgcccgcctccatctccatggcggagcaggacgacgccgcggggcagagcccgctcgactccgttccgatcgacgaaacttgtgatgctgaagatatgcattctcctttgtccttttcttacagaagtcagcctaaatctgtgggagctggtcttagcaatatggggaacacatgcttcctgaacgcaactcttcagtgcatcactcacactgtaccgctttttctcaagcttcgctcaactgatcattccaccccatgctcatataataaggatggggtttgttctttctgtgcccttaaaagacatgttgatgaatcaattcaaaggtctggatctgttatagcaccagcaaagttcagagataatttaaagaaggtatcttccgatttttggccaggacagcaagaagatgcacatgaatttctacgttgcctgcttgaatactggcacaagtgtactccttgatcccatggcaaaggggcaggggctcatccttttgaccgaaaaaagtttggccaaccagaattttttggagggaacactggaaaaagccattttatctttggcttcccaagggtggggccaccgcccccaaaaaaccttttgaaccccccttctggggaattaaagcttgggaagaatgtgatccggggtgggatcccc

SEQ ID NO: 81516 - protein, 149 aa, Zea mays
  misc_feature: Ceres CLONE 1567009
  misc_feature: SWISSPROT Homolog: EC 3.1.2.15 Ubiquitin thiolesterase
MAEQDDAAGQSPLDSVPIDETCDAEDMHSPLSFSYRSQPKSVGAGLSNMGNTCFLNATLQCITHTVPLFLKLRSTDHSTPCSYNKDGVCSFCALKRHVDESIQRSGSVIAPAKFRDNLKKVSSDFWPGQQEDAHEFLRCLLEYWHKCTP

SEQ ID NO: 81517 - DNA, 836 bp, Zea mays
  misc_feature: Ceres CLONE 1567010
  misc_feature: Encodes the peptide sequence at SEQ ID NO. 81518
tccccgcggtggcggccgctctagaactagtggatcccccgggctgcaggaattcgtctcacccctagaaaaactctccaaccacaaaccctcgtggccgcagctgtttctgtttctattctcacgtcacgcgcaggctgcgggcaagcaatggcaggtgggccctgtcgcgctggccgatccagcgctgactcagcccccgcaccgcatacatgagagatgagaagccgccacccgccgctgcggctgcggcgcccgcgccaccacgagtgacccatcgtgctcggatcgtacggcctcaaccgcaaaatccagtatttaagcgccgcggaacactcgtcgagaggagaggacagagcagaggaccaccaccggaccgggctggagctggaggcgtggcggcgccggcgcgtccatcaggaggagaaggggcagggatggtgctgggcggcggcatggcggcagcggccgtaggcggggacgacgctgtcgtcatgcagctgggcgccgccgagggcgaggagaccgtcgtcaccgtcaactgccccgaccagacaggccctggctgcgacctctgccgcaccatcctcgagttcggcctccgcatcacccgcggcgacgtgtccacggacggccactggtgcttcgtgggtgtctgggtcgtgccccgctcctcgtccatcaaggtccggtgggccgagcctcaagacccgcttcagggccatggtgccctttctcaaactcaaccccttcttaaacgggaagtgagccagtccaaaccagggcccttggaatttaaccccctaaatttatttccccggacccaaaagattctc

SEQ ID NO: 81518 - protein, 133 aa, Zea mays
  misc_feature: Ceres CLONE 1567010
MVLGGGMAAAAVGGDDAVVMQLGAAEGEETVVTVNCPDQTGPGCDLCRTILEFGLRITRGDVSTDGHWCFVGVWVVPRSSSIKVRWAEPQDPLQGHGALSQTQPLLKREVSQSKPGPLEFNPLNLFPRTQKIL

SEQ ID NO: 81519 - DNA, 890 bp, Zea mays
  misc_feature: Ceres CLONE 1567012
  misc_feature: Encodes the peptide sequence at SEQ ID NO. 81520
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacttcagctctcatcaagccgcggccgacgaacggggagctccgccgcgcggtggcgggaggtccacggcagcaaacactgggaagggtctgcttgaaccccattgacgggggtgcttcctccagggagctcaatccgctacgggggagttttcgccagggccaccctaacaaaaggtttggaaaatgaaaccggttttcccccctaatgggggaagtttgaaaaatacccggggaaaaaacatttttttcacaaaggtttgggctctgggggggatttgggtataaagagggaccccgcttttctttttagcccccctggggaaagaacctttaagtttccccaaaaatttggggaataaaaaaaggcgcccccaaacccccaaaaatgggggagggagatccccgggcgcttttcattgggggaaaagtggggcccttttctcaccagaaagaa

SEQ ID NO: 81520 - protein, 97 aa, Zea mays
  misc_feature: Ceres CLONE 1567012
MAATVSSCLSLVPTVHHRAGGFPSSVALTNTLQRRRRSRRYLVVASATRAEQEAAPVTIEDVDFSSHQAAADERGAPPRGGGRSTAANTGKGLLEPH

SEQ ID NO: 81521 - DNA, 918 bp, Zea mays
  misc_feature: Ceres CLONE 1567013
  misc_feature: Encodes the peptide sequence at SEQ ID NO. 81522
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (536)..(536): n is a, c, t, g, unknown, or other
  misc_feature (874)..(874): n is a, c, t, g, unknown, or other
  misc_feature (876)..(876): n is a, c, t, g, unknown, or other
nnnnnnnnnnnnnnnnnnnnnnnnnnnnnnnnnnnnnnnnnnnnnnnnnnnnnnnnnnnnnnnnggggggnnnttttnnnnccccnnnnnnnaaaaaactggagctccccgcggtggcggccgctctagaactagtggatcccccgggctgcaggaattcgtctcacccctagaaaaagtcatagagagagccactggccacaggtaggcaggcaggaggacgagtcggcaaggaagctgcctgctttcagaaagagtcatagagatagttattaagatggcgttgcttcggctgcttgccctctccctgctcttcgcagtggccactcctgtcaaggacatcgcccacgatgcctgctcgtcagaagtgaaggatttccagcacctgaacaacagctcggggctccacctgacgctgcaccacccgcagagcccctgctccccggcgccgctgcccgccgaacctccccttctccgcgggtgctcgccccacgaacgggggcgcgcattcgggtcgtttggcggggcggccttgncaaagaaggccgtccctctcgggcccaaccttgctttgaacaaaaaaccccgccggggggccgtccctccttccttcccccccaaatgaaaaaaatccccccgcgggttcccttggcccccttcgggcccccggggaaacttttcccctttggggggtttggggaaaaaaaaaggttaccccccccaattggggggccctctggggacccccccggggccaaaaattctaaaacagttaaatggggggccggggggaaaaaaaccgggggggccccctccgccctccccacacctgggggcccccccaagggggggtctccccccccctccggggttntnggggtgtgggggggggcccccacccccccccgaatgtttccg

SEQ ID NO: 81522 - protein, 115 aa, Zea mays
  misc_feature: Ceres CLONE 1567013
  misc_feature (87)..(87): Xaa is any aa, unknown, or other
MALLRLLALSLLFAVATPVKDIAHDACSSEVKDFQHLNNSSGLHLTLHHPQSPCSPAPLPAEPPLLRGCSPHERGRAFGSFGGAALXKKAVPLGPNLALNKKPRRGAVPPSFPPK

SEQ ID NO: 81523 - DNA, 874 bp, Zea mays
  misc_feature: Ceres CLONE 1567021
  misc_feature: Encodes the peptide sequence at SEQ ID NO. 81524
ggagctccccgcggtggcggccgctctagaactagtggatcccccgggctgcaggaattcgtctcatcccccctagaaaaaaccgactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcgtcggcgagttcctcggccgcggcgtcacctgccagcttatcagctccaccgtcgtggaccctaacaacggcaaccgcgggaagttgggcgccgaggcgagcctggagcagtggctgctgaacccgccgccgcttctgtccagcgagaaaccagtccgcgtcaccttcgactgggaggtggagaagcagggcatcccgggcgccatcatcgtcaagaacaaccacgctccgagttcttcctcagaccatcaccctcaacgacgtccccggccacgcaacatcgtcttcgtcgccaaatcatggatctacccggcggccaaggaccggtacaaccgcggtcttctttttccaaggacaggtacctccccagccaaaaagccggggggggccttaaaccctatcccgaaaaaaaaactttcggaaccctgaggggcgaaaaacacaaaggggcccgtacaaaggaaaaaagaaccgggttttataccgtataagagagtttaaaaaaaaacctctgggcttttccttgaaaagcggggaaaaacccgggcgcccgttttcttgggggggggaccaaagaag

SEQ ID NO: 81524 - protein, 191 aa, Zea mays
  misc_feature: Ceres CLONE 1567021
  misc_feature (58)..(162): Pfam Name: PLAT Pfam Description: PLAT/LH2 domain
  misc_feature: SWISSPROT Homolog: EC 1.13.11.12 Lipoxygenase
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSEKPVRVTFDWEVEKQGIPGAIIVKNNHAPSSSSDHHPQRRPRPRNIVFVAKSWIYPAAKDRYNRGLLFPRTGTSPAKKPGGALNPIPKKKLSEP

SEQ ID NO: 81525 - DNA, 906 bp, Zea mays
  misc_feature: Ceres CLONE 1567022
  misc_feature: Translation starting site: 197
  misc_feature: SWISSPROT Homolog: EC 4.3.1.5 Phenylalanine ammonia-lyase
  misc_feature (507)..(507): n is a, c, t, g, unknown, or other
  misc_feature (508)..(508): n is a, c, t, g, unknown, or other
ctccccgcggtggcggccgctctagaactagtggatcccccgggctgcaggaattcgtctcacccctagaaaaaaagaagagcacgcccactcctctccggctcctcttcttctccaccacaccacaggcaccggcaccggcaccgcctcctccctccctcctgccaccgcgcggcaccccagccacagcacagcaatggcgggcaacggcgccatcgtggagagcgacccgctgaactggggcgcggcggcggcggagctggcggggagccacctggacgaggtgaagcgcatggtggcgcaggcccggcagccggtggtgaagatcgagggctccacgctccgcgtcggccaggtggccgccgtcgcgtccgccagggacgcgtccggcgtcgccgtcgagctcgacgaggaggcctgcccccgcgtcaaggccagcagcgaggtgatcctcgactgcatcggccacggcggcgacatctacggcgtcacccacgggcttccggnngaacctcccaccgccgcaccaaggacgggccccgccctgcaggttcaagcttcttaaggattttaaacccgggaatttttgggacccgggaaggaaagggccaaccccttcccttggaaaggaaccccggggggaaaattttggggggaaataaaaaacttctggaggggggttacccggggattccgttttaagatactcggggggctaccccaaagtttctcaaacaccgggggaaaaccccggtgcttgcccccctgggggggacaaaaccccgcgggggggggaaaaagtggcccccttcttataaaaccggggggcttataaggggggcccccccacaggggggggcttccctctttagggggggggagggggggcccccccgaagagtttaa

SEQ ID NO: 81526 - DNA, 888 bp, Zea mays
  misc_feature: Ceres CLONE 1567023
  misc_feature: Encodes the peptide sequence at SEQ ID NO. 81527
ctccccgcggtggcggccgctctagaactagtggatcccccgggctgcaggaattcgtctcacccctagaaaaagacccggcccaagctgccatcgaggagggacgagggagggatccagcgagcggagcggagcggacgccaccctcgcgcgcacacctacgcgcaggcgcatacaccaacgacgccgaccccttccagggagggagggagggaaccacacaaccggacccgacccgacgccccgaggcgaaggcgagggcgagcggtcagccggccggggcggggaccaggggggatcccctcggcggcggcggccatgggcgcggcctccccggcgatgtgggccgggctggtcctggtggtgttattggccgcatcgggcccggcgtcggcggggctgccgaggttcgccgaggcgcccgagtacaggaacggggacgggtgcccggccccggtgacgggcgcgggggtctgcgacccgggcctggtgcacatcgccatgacgctcgacgcgcactacctcaggggctccatggcggccatctactcgctgctcaagcacgcctcctgccgggaagtcatcttcttccaattcctcgctcggaagggcaggcggccccgcccgaccgaccaccaaactttcggggccgccgggggccgccttctttccggtccccttgaggttttgaggatatgcccggttccgcgcctaaagggagttcgccgggggattattttcccgcgttcgggtggcccgcccgggggctggggggggggcccccttaaaagtggggcgcccgcaatccatctcttaccggaaagttgatttccgggggactttgtggttgccccggcgcccaaaaataagtctcttcgactcctccaa

SEQ ID NO: 81527 - protein, 169 aa, Zea mays
  misc_feature: Ceres CLONE 1567023
MGAASPAMWAGLVLVVLLAASGPASAGLPRFAEAPEYRNGDGCPAPVTGAGVCDPGLVHIAMTLDAHYLRGSMAAIYSLLKHASCREVIFFQFLARKGRRPRPTDHQTFGAAGGRLLSGPLEVLRICPVPRLKGVRRGIIFPRSGGPPGGWGGGPLKSGAPAIHLLPES

SEQ ID NO: 81528 - DNA, 859 bp, Zea mays
  misc_feature: Ceres CLONE 1567024
  misc_feature: Translation starting site: 149
  misc_feature: SWISSPROT Homolog: EC 2.1.1.14 5-methyltetrahydropteroyltriglutamate--homocysteine S-methyltransferase
ggagctccccgcggtggcggccgctctagaactagtggatcccccgggctgcaggaattcgtctcacccctagaaaaatcccgtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggtttgacacctacttctccatggccaggggcaacgccactgtccctgctatggagatgaccaagtgttttgacaccaactaccactttattgtcccggaattgggccccaaacaccaggttctcctatgcttctcacaaggctgttaacgaatataaggaggctaaagcgcctcgtgttgaatacgtgccagtacttggtggaaccattttctacctgttgctcccaaaccctgccaggggtttgaaaaagggatccccccttttttccctttttaagagatcctttccggtctaagggggttcttttcctaatttaaaaggcccgggggctccggaattcccttttgaagacccccttttgtccccacccttttttcaaaaaaaagggggggtttttttgggggaaaaccaaaaaagaaaatcttcttttcttgggagaag

SEQ ID NO: 81529 - DNA, 795 bp, Zea mays
  misc_feature: Ceres CLONE 1567027
ccccgcggtggcggccgctctagaactagtggatcccccgggctgcaggaattcgtctcacccctagaaaaagtctgttcgtccggtctccctggaagcgccgccgatattttgtgcacccgggctgcgtcagcggcgacgactactactcctctaacaggaagtgtcagtacgccaccccggccccccgaccccccgtgttctcttccgggcaaccccctgcatgctccctcgggggcggccggtgctcctacaactgcgtgcccgctaccctcgatgatatttcctttccccgagggccccaccactgacatcatggtgccgatctgtcatcgccgtggaggatgatcattcttacggagacgtgggggacgatgaccccttccgcttccggatccgcatgtgaccccctgccttcggagcgcgcggttctgccgcgacgactgtgtttctacttctcatgatggagacgcgctcagatcttctatggcggtttcatggtctacgacccgcacgtgtccatcctcctgttacggcgcatctcgtgttcctcctggaactattgagtgccagatgagagggttctcgttatcatcgggatcgccagttacacttccaagcttatcttgctcctgtcgtgagcgcatatttcgtcattctccacttgacgactagcctgcgtggactgatttgtcagttcagcttgctagcaatacctgctttatctgagcgtctgagatatggatctgagcagttctggatgatgcctgagccgggatcatgcgtggcctggaa

SEQ ID NO: 81530 - DNA, 859 bp, Zea mays
  misc_feature: Ceres CLONE 1567028
  misc_feature: Translation starting site: 315
  misc_feature (36)..(36): n is a, c, t, g, unknown, or other
aaagctggagctccccgcggtggcggccgcattccnaactagtggatcccccgggctgcatgacttcgtctcacccctagaaaaaggttccattccaagtccacctgcccctttttccctatctatcctgtactctctctctctccccccggttctccgttccacatcgcgtgcgcattgagacgacgagtttctagagcgccgtaccgcgcacggctcccgagccccaccggcaccgcaaagcgccggaatcgtgagcgcgtccggcctcgcctagctgctccgcggtgagaggcggccgaggaggacgggcgatgtacccggtggtgacgggcacgccgccggcgcggctgccggcggcgtcgcgggtggacaaggccacgagccacctgctgcagggtcccgactgggccgtcaacctcgaaatctgcgacaccctcaacgccgaccgctggacaaacgaaggatgtagtaaaagctgtgaagaagctattgcagcataaggatccaaaagttaaattcgttactttgacgttatgggagacaatggtgaagaactgtggggaataatgtgatattgaagttgctgagccaccatggtttacgagagatttttaaaagttgtcataaaaaagggtgatatgcaattgagggaataagggattttggtactttcttgggttgcagggcaggaggggaattcggtggaaactatggcggggagagaatccgccggtgctctccgggcccgagacgtttgaaaatgaacatataggcgtaggggtgttggaggtcccgtgcagaaggtgggggtacaaattgaaccgcgccggatttgtttagagaggccgcatggtag

SEQ ID NO: 81531 - DNA, 831 bp, Zea mays
  misc_feature: Ceres CLONE 1567030
  misc_feature: Encodes the peptide sequence at SEQ ID NO. 81532
ctggagctccccgcggtggcggccgctctagaactagtggatcccccgggctgcaggaattcgtctcacccctagaaaaactgcaaccggaagctcatcggcgcgcgcttctactccaagggccaccgcgccaactacccgaccaacccctcggaggcggcggctctgctggagtacgtgtcgccgcgggacgcgcacgggcacggcacgcacacggcgtccaccgcggcgggcgcggccgtcgccggggccagcgtcctgggcgccggcctcggggaggcgcgcggcgtcgccccgggcgcgcacgtcgccgcctacaaggtctgctggttcaacggctgctacagctccgacatcctcgccgggatggacgacacggtgcgcgacggcgtcgacatcctgtccctctccctcggcgggttccccatcccactcttcgaggacagcatcgccatcggcagcttccgcgccacggcgcgtggcgtctccgtcgtgtgcgccgctgggaacaacggcccggcgcggagctccgtcaccaaccaggcgccctgggtgctgactgtccgcgcggccaccatggaccgccgctttccggcgtacgtccggctcggtgaagggatgtgtcctgtacggagagttcatgttcccccgggggaaaccgggtttgaaaaaaggcggggaaggaacctggaaactgggaaccatgtgttacgccccttgggggggggaacccgggaaatcccgaaaataccggcccttcaagaggggtccccctttgtaataaaaaccccgccccgtgtgctcacgcgaaaaaaaagtgggtgggcccta

SEQ ID NO: 81532 - protein, 155 aa, Zea mays
  misc_feature: Ceres CLONE 1567030
  misc_feature: SWISSPROT Homolog: EC 3.4.21.25 Cucumisin
MDDTVRDGVDILSLSLGGFPIPLFEDSIAIGSFRATARGVSVVCAAGNNGPARSSVTNQAPWVLTVRAATMDRRFPAYVRLGEGMCPVRRVHVPPGETGFEKRRGRNLETGNHVLRPLGGGTREIPKIPALQEGSPFVIKTPPRVLTRKKSGWAL

SEQ ID NO: 81533 - DNA, 790 bp, Zea mays
  misc_feature: Ceres CLONE 1567031
  misc_feature: Translation starting site: 247
gcggtggcggccgctctagaactagtggatcccccgggctgcaggaattcgtctcacccctagaaaaaggcagagaggagcgcatcgcatcagcgtcaccaataccacgcgagccgtcccccctccttgtccatccccggccggcacgacgaaccgcctgaggagggagcaatagctcggccgctcggggctctcgctcttggctgcgtgtctgaagctgttgatgcgagtgaaggctcggtttccatggctctcatggcggcggggatggacgaccacgacgagtacgccaagctcgtcaggaggatgaacccgcccagggttgtgatcgacaacgaggcctccgacgacgccaccgtgattaaggtagacagcgtcaacagccacggcacgctgctcgccgtcgtccaggtcatcgccgacctcaacctcgtcatccggaaagcatacttctcctcccgatggaaacttggttcatggacgcgtttcaatgtcaccgacccgtgacggcaacaagggtctggaacgcctcaaacatcttcctacatccagaaaaaccctgggaggtgggacaactgggacctccccggggggggcccaacccgggggggcatcttgccccccgggggaatacccccccatttgaacttccgggggcccggaaccccccgggggctggttctccccagaggggggccggggggcccccgggccctgggggcttacccggggtcccaaaaacccgggaaattttttgaaaccccccaacaaacccgggccggggggggcc

SEQ ID NO: 81534 - DNA, 784 bp, Zea mays
  misc_feature: Ceres CLONE 1567036
  misc_feature: Encodes the peptide sequence at SEQ ID NO. 81535
  misc_feature (784)..(784): n is a, c, t, g, unknown, or other
tggagctccccgcggtggcggccgctctagaactagtggatcccccgggctgcaggaattcgtctcacccctagaagccctcctccccatcgcgtgtgtccgctacccctccccgaccagatcgctacgagacgccgcgcgatccgacccaggccgacgccgacgacccctctcgcggccggggggcatggcgtacggcgaccgcgtcaccaccttcgaggactccgagaaggagagcgagtacggctatgtccgcgaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctgaaattcttggaaacatttttgacggtatccagcggcctctaaaaaccatcgctattgagtcaggagatgtgtatattcctcttggtgtttcagttcctgcccttgacaaagatgtattgtgggaatttcagcccacaaagctaggtgttggagatgtcgtcacaggtggagatctatacgctactgtttttgagaacacattgatgcagcaccatgttgctcttccacccggttctatggggaaaataagttgcattgcagcagctggccagtacaacctgcaggacacagagctagagttggaatttcatgtcatn

SEQ ID NO: 81535 - protein, 198 aa, Zea mays
  misc_feature: Ceres CLONE 1567036
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVREVSGPVVVADGMGGAAMYELVRVGHDNLIGEIIRLEGDSATIQVYEETAGLMVNDPVLRTRKPLSVELGPEILGNIFDGIQRPLKTIAIESGDVYIPLGVSVPALDKDVLWEFQPTKLGVGDVVTGGDLYATVFENTLMQHHVALPPGSMGKISCIAAAGQYNLQDTELELEFHV

SEQ ID NO: 81536 - DNA, 845 bp, Zea mays
  misc_feature: Ceres CLONE 1567037
  misc_feature: Encodes the peptide sequence at SEQ ID NO. 81537
tccccgcggtggcggccgctctagaactagtggatcccccgggctgcaggaattcgtctcacccctagaaaaaatactacctcctcagacaccggcggcggccatgccgcctccgcgtccgacgcaccccccacttccccctcctctgccgcccgggccgcctcccctaagcgcccgtcgtctccctctcccgcccaaccgcccggcccccacgtctctcctcctcgcgccgccctcctccccagcccgtgccctcgcgcttctcttccccgactcctccgcccatctcttcccgtccctaccctccgtctcccccttcgccacctcttatcccgctcacacccccgtcccatcaccactcgccgccgccgcctccttcgcgctcctcctgccgtcgtcacacctcatcttcctatccgcgcatccgtccccttccaactcctctgtccacctccgcgcctattccctcgctcccgcgcccgctttcccgcgctttgcgcccgcctcgctctccttcaagcgccatgcctcagctgccagcctggcccctccaggacctacccttcggcattggcgtccggcctggccgggggggtcaaacaccgtcttgctgctctcactgtccaccggccaaaatctgggtgctcttttccgaaactgggccgcggacggcccgacaggtggaactgccccaaagtgggccggatcgtctaagcttcgaagtcggccgcgggccccgggtaacgccaatgggaaaatccccaatgggggaaaggcttgcttgcctttgggggaaggtttggccggatatttcctcgatctttcccccccctcacggggggatt

SEQ ID NO: 81537 - protein, 247 aa, Zea mays
  misc_feature: Ceres CLONE 1567037
MPPPRPTHPPLPPPLPPGPPPLSARRLPLPPNRPAPTSLLLAPPSSPARALALLFPDSSAHLFPSLPSVSPFATSYPAHTPVPSPLAAAASFALLLPSSHLIFLSAHPSPSNSSVHLRAYSLAPAPAFPRFAPASLSFKRHASAASLAPPGPTLRHWRPAWPGGSNTVLLLSLSTGQNLGALFRNWAADGPTGGTAPKWAGSSKLRSRPRAPGNANGKIPNGGKACLPLGEGLAGYFLDLSPPSRGD

SEQ ID NO: 81538 - DNA, 842 bp, Zea mays
  misc_feature: Ceres CLONE 1567038
  misc_feature: Encodes the peptide sequence at SEQ ID NO. 81539
  misc_feature (453)..(453): n is a, c, t, g, unknown, or other
  misc_feature (454)..(454): n is a, c, t, g, unknown, or other
ctccccgcggtggcggccgctctagaactagtggatcccccgggctgcaggaattcgtctcacccctagaaaaatcatgataacttgacggatcgcacggccttcgtgccggcgacgcatcattcaaatttctgccctatcaactttcgatggtaggataggggcctaccatgaagctcggggtggaggtgaggagggacggcgagggcctggtgacggctcaagaggtcgaggcgaaggtgaggtgggtgatgcaggactccgacggcgcgcgggagctcaagggacgcgcggaggcggcgagggcgagagcggccgaggcgctggcggaagggggtccgtcgcgtgcagctttcctcgagttcgtcctagacctgttggcttccgaaggcatggttaacgtttgaagtttgacgagtgtatttacttgtaataaaaaacaataattttgtnnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttttccttttaaaaaaacccttgcgcccaaaaaaaaatttttttagtccagcgatggaaaaaaaaaaggggggttttttcccgggggggggggttgggcctttccccccaaatcttaaattaaccaaggggtttccccccccccccggaaaccagggggaactcccccttggggtttttaaaccccccttttaccgggaaggtttcccccccccggttccgcgccccaaaggcctaaaaacccccctccccttccagggttacccccgccgggcctccaagggaaacccca

SEQ ID NO: 81539 - protein, 78 aa, Zea mays; identical to SEQ ID NO: 81383
  misc_feature: Ceres CLONE 1567038

SEQ ID NO: 81540 - DNA, 789 bp, Zea mays
  misc_feature: Ceres CLONE 1567039
ctccccgcggtggcggccgctctagaactagtggatcccccgggctgcaggaattcgtctcacccctagaaaaaacgatgggccacgccacaccagtgagcacccttcctccctgttcttgcctctgtcctatactactactactacccatctttagccgccgcgtgcatgcaagaagagaaatagccgccgatcgatcagcgctcgaccgacccgtcatccttgacgaacgaccagctaggaaacaggaggcaccttctttgcacgtgtcagtgccagccagacgaacccaagggctagctgtcaggacggctcagctccagctttgcggccctccagctctccccagttcaagttcaatattggcgagcatgcgagtttgccctcttccgtcgtcgtcatcatcatcgtcctcgcgatcccggcgtccctgtttcggcctacgcctcccgtagacaacagttgcgccctgctctccggcaagctatggccaagctgagctgcttccccgctctgctccccggcaagaggaagaagaagacacgcaagatcaccgatgctattcatgcccagcggccaaacaagggccccaaggtgaagcccggtccaaaattaaaatttttgaaccgaacccttgggggcagggggttgtccaagaaagataattccccccccaaaattttcggggcccccggggggggacccccccaatataaggggaaaggggggtaaaaaaaacggggggtttgggtaaaaaagaaaaaacaaatttttgttccaaaaatttcg

SEQ ID NO: 81541 - DNA, 824 bp, Zea mays
  misc_feature: Ceres CLONE 1567041
  misc_feature: Encodes the peptide sequence at SEQ ID NO. 81542
  misc_feature (345)..(345): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (782)..(782): n is a, c, t, g, unknown, or other
tccccgcggtggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcancagcgcggcgcggaccagcgcggacccgccaggcggcgtgccgctgccttcagaacctcgccaacggcggtcagaacgtccacatggggaaccgtcgcccccatcccccggaaagtgcgggggtttcccgtgggattccccattaggattgtccccccgcttggaaaaaaaatcgcctaattttccaccacccccaccctatatagccctcccgaaaagtttccaaaaaatttccccggcctttccccaatgttagtaaaccccggggggaaaaaaaaaaaaaaacccccttttttttccccggagaaccccccgccttttttttttcccccctttttaataccgggcgggggggggccccccccccaaaaaaggagaaataatgggggccccccccaaggggggatttttttcctccccccccccccnnnnnnggnaaagatagataaaaaagtagttgtggggaccgggcggccggc

SEQ ID NO: 81542 - protein, 151 aa, Zea mays
  misc_feature: Ceres CLONE 1567041
  misc_feature (67)..(67): Xaa is any aa, unknown, or other
MAAVLNSRKTAQAVVAVLVAAALLASSTSAAITCGQVGSSLAPCIPYATGRASALPASCCSGVKSLXSAARTSADPPGGVPLPSEPRQRRSERPHGEPSPPSPGKCGGFPWDSPLGLSPRLEKKSPNFPPPPPYIALPKSFQKISPAFPQC

SEQ ID NO: 81543 - DNA, 843 bp, Zea mays
  misc_feature: Ceres CLONE 1567042
  misc_feature: Encodes the peptide sequence at SEQ ID NO. 81544
  misc_feature (788)..(788): n is a, c, t, g, unknown, or other
ctccccgcggtggcggccgctctagaactagtggatcccccgggctgcaggaattcgtctcacccctagaaaaaactcgctcgtccatccatccatccacgcccccccccagaaccagtccccccagcgcctcacggtcgcaatttattgcttgcgcaccgcctcgccgctttggcgtggggcgtttgcctgtgtggcgcttcgcaggtgccgtggcttgccgcttccttcgccgtgctcactagtcaccagagagggaggaggctctggcgctctgcttctgctgccgcttcttcttcttctcctgctgctgctcttacggagataagcagggggggccgggccggggcagggggagggggaggtgacagctgagctgactagctgagtgaggcatggggatggacgccggcggcggcaagctgccgtacagctacgccggccaacaggacggagggaagctggtgaagagcgtcagccgcgtggagccgcgcaggttcggcctgggcctcgtggcgggcttcctcctcgtcacctgcgcctacttctccaccgccaagttcgacgccatccagatcgccatgaccagccgacccgtctccagcaatgcggccggcgtcggagtcggctcgctgggagtgggcgccgccgccgccgacacctccaacgcctccaggcagggattagatttgggcgcgatgtccatggccgaggaagggagcgaggccgaggcgctcgagaagacggcggcaaggcttcttcaccttcggggcccaggttctggtcangcgttcctgccgctctccttcctccgtgtcgtcagaggaagccgcgacagcacgc

SEQ ID NO: 81544 - protein, 149 aa, Zea mays
  misc_feature: Ceres CLONE 1567042
  misc_feature (131)..(131): Xaa is any aa, unknown, or other
MGMDAGGGKLPYSYAGQQDGGKLVKSVSRVEPRRFGLGLVAGFLLVTCAYFSTAKFDAIQIAMTSRPVSSNAAGVGVGSLGVGAAAADTSNASRQGLDLGAMSMAEEGSEAEALEKTAARLLHLRGPGSGXAFLPLSFLRVVRGSRDST

SEQ ID NO: 81545 - DNA, 923 bp, Zea mays
  misc_feature: Ceres CLONE 1567044
  misc_feature (428)..(428): n is a, c, t, g, unknown, or other
ctccccgcggtggcggccgctctagaactagtggatcccccgggctgcaggaattcgtctcacccctagaaaaaatagacaagtaatcccaatcccgtcctacctggatggttcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactaggtggtgggtagccaatccccccnagccaggagcagccgccaagccagccctgggcattgaatccgttctggaagggtggcttgggctccgggggtttcccccttggttttggggggttggccccctttccccggggggggcgttttcttgcccctttgggggccaggggggggtttccctttttggggcccccttctctaaaaggggcttcctgggggtgtttataaaagcccaaaaaaaacctttataccccccgggggaaaacttccccccctctggggggccttgtttttttgcgaccacctggggggggaggagggtggtctccctgagaggcccgccccccaaaatttttccccgaaccctcggggggcgccctctttttttttttgggggaaaaaacaacgggggggggcgggggaaacctcttttgggtggcccaacccctcccccggggtgttgggcggtttcttccctcccgggtttttttaaaaaaaaaaaaaaaatttgtttggttg

SEQ ID NO: 81546 - DNA, 855 bp, Zea mays
  misc_feature: Ceres CLONE 1567049
  misc_feature: Encodes the peptide sequence at SEQ ID NO. 81547
  misc_feature (484)..(484): n is a, c, t, g, unknown, or other
  misc_feature (494)..(494): n is a, c, t, g, unknown, or other
  misc_feature (498)..(498): n is a, c, t, g, unknown, or other
ggagctccccgcggtggcggccgctctagaactagtggatcccccgggctgcaggaattcgtctcacccctagaaaaagaccccccctgccgcaatcgatcccagctcacgttgcgcctccgcgcaggcgcaggcaccggcggcggcgcggcgggggatggtgccggtggcccccgcggaggcggagctcggcgccatggtggcgctcgctctcaacggcacgcggcgccggctcgggggcagcttccagctctgcgcgccctgcacctgctgcggcggggccagcggcgcctgcatcctcgcgccctgctgctactccatcaactgcaacatccccaaccgccccttcgggtactgctccttcacgcccaaatcctgccagtgcgtcggatgcaacctctgagctccgtggccgcgggattcattggattggattggtcagagtgtgtttgtgtgtgtgtgtatgatatgaaagaaaaaaatngggggggtgnatangaaatctgtataaaaaattccccacatccttagttaagtggcgattgctattacttctacctagtagtattttgctgtgatcactgctacattcgacttagttgagggaaaaaaagagaaaggggtctgggttgatctagaggtcactactctggggttttgctgtcccgtgtggcgtctggcgtgtgcgcacgcacctccccaggccccagtgccaccttccctcctcggctcgactcgcccggcgctccgccgcagctggctcatcccaatcccctcgtacagtcgtgctccgcgcccgcttcaccgcctgaacaaagatggaggccttcctagccggcctcttcaggcgcctcc

SEQ ID NO: 81547 - protein, 81 aa, Zea mays
  misc_feature: Ceres CLONE 1567049
MVPVAPAEAELGAMVALALNGTRRRLGGSFQLCAPCTCCGGASGACILAPCCYSINCNIPNRPFGYCSFTPKSCQCVGCNL

SEQ ID NO: 81548 - DNA, 798 bp, Zea mays
  misc_feature: Ceres CLONE 1567051
  misc_feature: Encodes the peptide sequence at SEQ ID NO. 81549
ccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaacccaacctggtgcacgcgcagagcatcctggccgtgctcggcttccaggtcatcctcctgggcctcgtcgaagggcttccgcatcaacgccctcaacggggtcggcgagggcaacaacctctaccccggggggccagtatttcaacccgcggggccttggccgaagaaccccgttacctttcccggt

SEQ ID NO: 81549 - protein, 216 aa, Zea mays
  misc_feature: Ceres CLONE 1567051
  misc_feature (69)..(210): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPTWCTRRASWPCSASRSSSWASSKGFRINALNGVGEGNNLYPGGPVFQPAGPWPKNPVTFPG

SEQ ID NO: 81550 - DNA, 831 bp, Zea mays
  misc_feature: Ceres CLONE 1567052
  misc_feature: Encodes the peptide sequence at SEQ ID NO. 81551
ggagctccccgcggtggcggccgctctagaactagtggatcccccgggctgcaggaattcgtctcacccctagaaaaaaatccggcgagtggccgagtggggtaggttgtgtgcggcatgacgaccacgcgcgaccgtggcgccggcggcggatcggcgtcgagggtcggtgacggggacgtcgacctgggcgagggctgggactggggcgccatcccgcggctcctctcctccgcctgcctcttcctctgctccggaggctgttttggttgctgcgataagactgtaaagcaactgggtgaactgtccagaaacttgatcacccaggaccaaataaccattggagagccattttggagcacaaccaccatcgaggttgaaccagcagatctcagcggtgttacttcagtcaatacatctaacttggcctctggaactggtagcagtcataaccttcctggacttggtaataatggtaggtcactctgaatcgtttttcaaggtctgctaaactagggtgttttcactggatcgacatattgtctcatttactacaaccttaaccttgattttgtcctagcttctctgagctgaggaaaagaatgtcggtcttagtttttccgtgtttttaatgagaagtttatctccacttgatatgttgatcttaaaagtatcattgcttggcataaatctcaatatttatttgaattgtgtcatgatctaagtcatctaactattgttggtaccaagacttacatttggtgtactatattatcatgtcttagttttccatggttttaatcagaaatttatttcgaagattttgaaccc

SEQ ID NO: 81551 - protein, 123 aa, Zea mays
  misc_feature: Ceres CLONE 1567052
MTTTRDRGAGGGSASRVGDGDVDLGEGWDWGAIPRLLSSACLFLCSGGCFGCCDKTVKQLGELSRNLITQDQITIGEPFWSTTTIEVEPADLSGVTSVNTSNLASGTGSSHNLPGLGNNGRSL

SEQ ID NO: 81552 - DNA, 826 bp, Zea mays
  misc_feature: Ceres CLONE 1567054
  misc_feature: Encodes the peptide sequence at SEQ ID NO. 81553
  misc_feature (745)..(745): n is a, c, t, g, unknown, or other
ctcaccgcggtggcggccgctctagaactagtggatcccccgggctgcaggaattcgtctcacccctagaaaaagtcacgcatcccgagccccgactcctctccttctccctcgtacctccacccccctctctgcccttccggggccggccttcgcttgtgccactcccgtggcgcccacgccgcgcacgcgtgctcgcctcccctcggcctcgcctgcaaccgttcccgccggcctcccgcgtcgcggcgcaagaggataccctggatttcgtccgtggcgagtggctaccgcttcttctccttttgtgacatctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcagcccgaagcaggccgcggtgatgaccaggaggtcaggctgttgtcggttgcttggaatcaggactgtggatgcttcgctgccggtaccagtaacggattcaggatctttaactgtgagcctttcaaggagactttcaggagggatctcaagagtggcgggtttgcgattgttgagatgctgttccgttgcaacgttcttgctcttgtaggtggcggctccaatgtgctgtacccgccgaacaaggtgattatctgggacgatctcctgagccngtgcattggggagttcgcctttcgctctgatgtccgagctgtaaaaatagcaaaggactacatcgtggatgtcctcgagcg

SEQ ID NO: 81553 - protein, 120 aa, Zea mays
  misc_feature: Ceres CLONE 1567054
  misc_feature (94)..(94): Xaa is any aa, unknown, or other
MAQPEAGRGDDQEVRLLSVAWNQDCGCFAAGTSNGFRIFNCEPFKETFRRDLKSGGFAIVEMLFRCNVLALVGGGSNVLYPPNKVIIWDDLLSXCIGEFAFRSDVRAVKIAKDYIVDVLE

SEQ ID NO: 81554 - DNA, 857 bp, Zea mays
  misc_feature: Ceres CLONE 1567056
  misc_feature: Encodes the peptide sequence at SEQ ID NO. 81555
  misc_feature (824)..(824): n is a, c, t, g, unknown, or other
ctccccgcggtggcggccgctctagaactagtggatcccccgggctgcaggaattcgtctcacccctagaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatgttcgcgccctccaagaaacatgaacactctgaccaagctgcagaggccatcaacgccgaggagcaagctgcacagctagagaacgagctggcagttaaagaaagggagactcttgatgtgctcaaggagctggaggcaaccaagaagatcatagcagacctgaaactgaagatacggaaggaagccactgaaacatcccctgaagaggctgctgaccaggtttctgaggcgggagctcaacagcagaaacctgaaaactacaacattgatgtggtggtggacatggaaggtgtagaagagaacctatcaggttcggttcccggtgatctcgagcaggcgaaggcaaacctgaacagagctacatgtgatctggctgcggtgcgggctgcagtcgagctactgcgaaacgcatacgaaagaagaaagtgtggctgaaaagacccgagagaagctctcctctgaaacttcgggcgttttcttctttggaggatgactggnatcagacagcccaaagaatggacccccttagga

SEQ ID NO: 81555 - protein, 199 aa, Zea mays
  misc_feature: Ceres CLONE 1567056
  misc_feature (28)..(200): Pfam Name: DUF827 Pfam Description: Plant protein of unknown function (DUF827)
MSSEAGCSAPAAAAPDGAGGGRVEIDTSAPFESVREAVDRFGGSAAWSSDLVRRMFAPSKKHEHSDQAAEAINAEEQAAQLENELAVKERETLDVLKELEATKKIIADLKLKIRKEATETSPEEAADQVSEAGAQQQKPENYNIDVVVDMEGVEENLSGSVPGDLEQAKANLNRATCDLAAVRAAVELLRNAYERRKCG

SEQ ID NO: 81556 - DNA, 790 bp, Zea mays
  misc_feature: Ceres CLONE 1567057
  misc_feature: Encodes the peptide sequence at SEQ ID NO. 81557
ctccccgcggtggcggccgctctagaactagtggatcccccgggctgcaggaattcgtctcacccctagaaaaaatcttctctgaccctccgattctacgtacaatagctcgatgctagattacatctatcctgtgcatactttaccatgtatgcagaacctacgttacacccggtctagcccttgcctctgcgggctgctcgcgacaccgtctatgctcgctcattgcacaccaggatctcggtccctgcccgtcggaataactgcatgccagcgcctgccacggcctctgacatgtagccgcagccgcggggagatgacaacctcctcgctgtgtggctgcctactcttagctgggaccatcgcctactatcgtgtatgtcggaggcaaggttctgctgattaactgtatcggcggacttcctgcaggcgatcaagctctccatgcagcttgtcatggcctccatgatctattccaacagacgcggtctgaatgtcgaggcaacggtgctggacgccgtcgtgtgcagcctgaacagaaagctccacggaaagctcatctggcacgatgcgctgagggcgcccagcgcagtggagatgaagaacccaacgacattctcatgatcctcaggctgctgagaatgacgacacgtatgtgcggccccaacaaataggtcttaccagtctacttctcctgctagagatcggtgtcacccgtccatgaggacaagtacatgcctcatcttagcgagcaacacgagggatgaggagataaaccttgagaacccgt

SEQ ID NO: 81557 - protein, 59 aa, Zea mays
  misc_feature: Ceres CLONE 1567057
MQLVMASMIYSNRRGLNVEATVLDAVVCSLNRKLHGKLIWHDALRAPSAVEMKNPTTFS

SEQ ID NO: 81558 - DNA, 839 bp, Zea mays
  misc_feature: Ceres CLONE 1567058
  misc_feature: Encodes the peptide sequence at SEQ ID NO. 81559
ccccgcggtggcggccgctctagaactagtggatcccccgggctgcaggaattcgtctcacccctagaaaaacagttgccttcgcatcgccggacgccgctcgccctccgcttctgtgactacgtccgagatggccgcctcggcattggcctcccgcgcgctgcggcctccgcacggccgccaccctcccgccccttcgccgcgtccgcgtccgcgctcggcaaccgccgccgctccaaggacgcgctgccgcgcggtggctgcggacgagcgccccgccgaccccgcgttcccggagcgccagaaccgcgggatttccggggcggtggagaggccggaggcggacgtggttgtgataggcagcgggctcggcgggctgtgctgcgccggcctcctggcgaggtacggccaggacgtgctggtgctcgagagccatgaccgcccgggaggcgccgcgcactcgttcgatatcaagggattcaacttcgattcagggccatccttgttctccggattccagtccagaggcccccaggcaaatccacttgctcaggtccttgatgcattaggcgaatcagtcccttgtgcgtcttatgactcttggatggtttatgtacctgaaagacaattcctctcacggataggaccaactgaaattcctcaaggacctttgagatgtttgttgggaattgacccctgtccaggaaatggaaaaaaacttccttggaggccagtttattccctatggtcctgccgcctgccaaaggccttttggccctccccccttttccatttccgagagggggatttttggggccattattattctcacccacccg

SEQ ID NO: 81559 - protein, 236 aa, Zea mays
  misc_feature: Ceres CLONE 1567058
  misc_feature: SWISSPROT Homolog: EC 1.3.99.23 All-trans-retinol 13,14-reductase
MAASALASRALRPPHGRHPPAPSPRPRPRSATAAAPRTRCRAVAADERPADPAFPERQNRGISGAVERPEADVVVIGSGLGGLCCAGLLARYGQDVLVLESHDRPGGAAHSFDIKGFNFDSGPSLFSGFQSRGPQANPLAQVLDALGESVPCASYDSWMVYVPERQFLSRIGPTEIPQGPLRCLLGIDPCPGNGKKLPWRPVYSLWSCRLPKAFWPSPLFHFREGDFWGHYYSHPP

SEQ ID NO: 81560 - DNA, 892 bp, Zea mays
  misc_feature: Ceres CLONE 1567061
  misc_feature: Encodes the peptide sequence at SEQ ID NO. 81561
  misc_feature (395)..(395): n is a, c, t, g, unknown, or other
ccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccanctccctcctcacggcccccaagccctccgccgcggcctccgacctccccgagggcgctcagtggcgctacagcgagttcctctcccgcgtcaagcgcggcaaggtcgagcgcgtgcgcttttccaaggacggcggtctgctccagctcaccgccgtcgacgggccgcgcggccaccgtcgtcgtccccaacgaccccgaccttaaagacatcctcgccacaaagggggtcaacttttccgtttccaaaggggagttggcgggccccggggggggtttttcgccttgttggggaaacctccttttctcctttaaacggggttgggggggcttttttttccttttcccccccccccaaaggggggggcccgggggccggggcctgggggcccttggggggcccctaggaaatttcgggccctccccaaagaaaaatttccaaggaggggccccagaaaagaggtgttccacccttcctcaaaattttcggggcggcaaa

SEQ ID NO: 81561 - protein, 151 aa, Zea mays
  misc_feature: Ceres CLONE 1567061
  misc_feature (84)..(84): Xaa is any aa, unknown, or other
MAPPSVSASHLLITASLPKPKPSSLRPPRLPLAKPLPASAALLALAASPALAADAPAPAPAPTPAPAPELQAEAPTPTVNPFSXSLLTAPKPSAAASDLPEGAQWRYSEFLSRVKRGKVERVRFSKDGGLLQLTAVDGPRGHRRRPQRPRP

SEQ ID NO: 81562 - DNA, 1060 bp, Zea mays
  misc_feature: Ceres CLONE 1567062
  misc_feature: Encodes the peptide sequence at SEQ ID NO. 81563
  misc_feature (16)..(16): n is a, c, t, g, unknown, or other
  misc_feature (71)..(71): n is a, c, t, g, unknown, or other
  misc_feature (72)..(72): n is a, c, t, g, unknown, or other
  misc_feature (75)..(75): n is a, c, t, g, unknown, or other
ggggggtttgcttccntttttaatgagaggaagtgagagcagtgcacgccagactaacctattatcaaaannaanaaaactggaactccccgcggtggcggccgctctagaactagtggatcccccgggctgcaggaattcgtctcacccctagaaaaaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttggtttgggggcctattctgtttggttaccaatctttggtgtggggccaatgggcgcacctttgaaaaatctccccaaaaggatctttggggaattggctgaaaaatggctgtcttgggcagggggggggggtgggttaagcaaaattcccttgtgggcctggggggcaaacaaccaaggggttccctttttaacctggaggggggtttcttttgggccaaagaaaaaaattttgggggggggggaaacacaaaaaacaattcccgccccccggggaaatgcaggagtcccccccctcttgccttcctaagaggggggcaattcctttggaaaggggcaaaaacgccccccacagaaattaaccccccccccactgggatttttttttgggcccaaattatgcgcttgcgccgggaaaaatggggatattcaggggggggtcctctaattctgggcctccttgggccccctcctttaaccatttttttctgaaaaattccccccccaactgggaaaatttgtcgggggaaaacacccttggggacacccgccttaaaacaaacgg

SEQ ID NO: 81563 - protein, 138 aa, Zea mays
  misc_feature: Ceres CLONE 1567062
MMRCAATGGGCVASWSGDWRLPAVNPCSVRMPTGNDGWCAGLRSRAADLAGLEMANLRGGVGGLFRASPRYGRLQATAAVDPEDIPLEKVQVKSSGHVLPYVGVAWFGGLFCLVTNLWCGANGRTFEKSPQKDLWGIG

SEQ ID NO: 81564 - DNA, 817 bp, Zea mays
  misc_feature: Ceres CLONE 1567064
  misc_feature: Encodes the peptide sequence at SEQ ID NO. 81565
ctccccgcggtggcggccgctctagaactagtggatcccccgggctgcaggaattcgtctcacccctagaaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaacccggcccgaaagtggtcaagggcgaccccggccggccaaagggaaaggcccgccgcgcaagggcgcgccctcgacgcccgagggggcaccaggaggaccggcacccccgccggccccggcatttggcgttagggaaagtttcccctaaggttcccccagggggtttaaaaaccttttggccctggttaagtttttccaagccgggcctttaagtttcaaaaaaaggggtggttttttttaagttccccccggggcgccttgtggaaacctttttttggggtgcaaaaaaaccgggggggtcttccccggggaaaaaaccgccttcctcaagggggaaaggggccccccccccccagaaaccttgg

SEQ ID NO: 81565 - protein, 145 aa, Zea mays
  misc_feature: Ceres CLONE 1567064
  misc_feature: SWISSPROT Homolog: EC 4.1.1.49 Phosphoenolpyruvate carboxykinase (ATP)
MATPNGLARIETTGKKKQDNGVWYDDSSAPVRAQTIDELHSLQRKRSAPSTPKRSAPTTPIKGGAHSPFAVAISEEERHTQQMQSISASLASLTRETRPESGQGRPRPAKGKGPPRKGAPSTPEGAPGGPAPPPAPAFGVRESFP

SEQ ID NO: 81566 - DNA, 887 bp, Zea mays
  misc_feature: Ceres CLONE 1567065
gagctccccgcggtggcggccgctctagaactagtggatcccccgggctgcaggaattcgtctcacccctagaaaaagaacagtattgactgctgttcgtctcatccctgacgcagtgaccatgatcacctatgacctagccgagctccgtgcctccgtccctccatctcccttttgcattccgcccccagattcccgaatcctccggctcgccccctctccgagactccgactgcctcccctgaagctagctagcctcctagcccctggtctggtcctcccgctgtgcctgtgaggcgctgctctaccaaggaggccgctggctgctccgctgcgctgcagtgaggctgcaaaagctggcggcttcttctcactgggcgtcgccataaacagtggagattcccatccccattttcccaattatggatagccagcggcaaccgggggagcaccgctgaggccgctcgcccgccatcccgcccgccattgctcccgtcgagcattctttcaggtttcgggggaaatacctgggatgagcattgctcgtcgccgccagcactcccgagttccgacttattagctacaaacaggcggttgaatttttggctactccctacccaactcccggcgggggtttttttttttttggggcccttttggttcccgctttctcctttccagaaaaggccccggaatttcccccccatttggaagcccccccaacccggttccccaaaaaggagggcccttcaaatagaaaggggcccaagcctttcgggggttttgccaatcccgaaggaatcccccccccttattggtgggggaggggtttttttcgccttataaaccccctaattttcctctttgtttcccgcgcaaaaagaaca

SEQ ID NO: 81567 - DNA, 1004 bp, Zea mays
  misc_feature: Ceres CLONE 1567069
  misc_feature: Encodes the peptide sequence at SEQ ID NO. 81568
  misc_feature (36)..(36): n is a, c, t, g, unknown, or other
  misc_feature (52)..(52): n is a, c, t, g, unknown, or other
  misc_feature (1004)..(1004): n is a, c, t, g, unknown, or other
aaagctggagctccccgcggtggcggccgcattcgnactagtggatcccccngggctgcattacaaaacaagcggctctagaaaaaggacagaaggatcagagctcaaacgcttttttggccatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtatggtacaccaagggtccgtcacactagggcttgcagaagtacaagggggcatcaaaaatttgggtttaagggtctcagggtggagctattcatctaggatccccctgggggggtgggggaagccagggtaaagcgaagaggggggcccgcctcccccggattatttggaataacttgaattcgaggcaggggcggaggagaccagggggaaaatctgcccgcgggggggcaaaagagcaaaaaccgcggtggtttcaatggttgccggaatgtgtgtgggcgattgtacaaaagttgttcgcggaggggctgtaagtggggtctccaagatttttgctagaaaaacagaaggcgccggtgataccaggggcgcggcgggtgcgatctggtatccatggtaagttttttgagaattcgttatgagggcagatatggtaaggtacgaaaaagaaggtgaatatctctacagtatagtcgtgcttgtggtgtgtggcccactcctcgtaatgttgcggacgcgttcgcggagagtactcagtaan

SEQ ID NO: 81568 - protein, 50 aa, Zea mays
  misc_feature: Ceres CLONE 1567069
  misc_feature (12)..(12): Xaa is any aa, unknown, or other
KLELPAVAAAFXLVDPPGLHYKTSGSRKRTEGSELKRFFGHFLMGPNQSF

SEQ ID NO: 81569 - DNA, 861 bp, Zea mays
  misc_feature: Ceres CLONE 1567071
  misc_feature: Encodes the peptide sequence at SEQ ID NO. 81570
  misc_feature (586)..(586): n is a, c, t, g, unknown, or other
  misc_feature (681)..(681): n is a, c, t, g, unknown, or other
ctccccgcggtggcggccgctctagaactagtggatcccccgggctgcaggaattcgtctcacccctagaaaaaggttccattccaagtccacctgcccctccctccctatctatcctgtactctctctctctccccccggttctccgttccacatcgcgtgcgcattgagacgacgagtttctagagcgccgtaccgcgcacggctcccgagccccaccggcaccgcaaagcgccggaatcgtgagcgcgtccggcctcgcctagctgctccgcggtgagaggcggccgaggaggacgggcgatgtacccggtggtgacgggcacgccgccggcgcggctgccggcggcgtcgcgggtggacaaggccacgagccacctgctgcagggtcccgactgggccgtcaacctcgaaatctgcgacaccctcaacgccgaccgctggcaaacgaaggatgtagtaaaagctgtgaagaagcgattgcagcataaggatctaaaagttaaattctttactttgacgttattggagacaatgatgaagaactgtggggaatatgttcatttttgagttgctgatcagcatngttttacagagattgtaaaaatgtccagaagagcatggatatgcagtgagggatagggctttgtactttctggatcatgggcaggagcaatgggntggactgggtggcaatattcacagtactactggtcatacattgaactaaagaagggcgggagtatgttccccccacgcccgggaaaggcccctccaaatttacctcctccgggaaccctcgggggatggggttccccaagaattccctctgggaacttaaaggggaaaatccttttgggt

SEQ ID NO: 81570 - protein, 88 aa, Zea mays
  misc_feature: Ceres CLONE 1567071
  misc_feature (13)..(88): Pfam Name: VHS Pfam Description: VHS domain
MYPVVTGTPPARLPAASRVDKATSHLLQGPDWAVNLEICDTLNADRWQTKDVVKAVKKRLQHKDLKVKFFTLTLLETMMKNCGEYVHF

SEQ ID NO: 81571 - DNA, 854 bp, Zea mays
  misc_feature: Ceres CLONE 1567073
  misc_feature (831)..(831): n is a, c, t, g, unknown, or other
ggagctccccgcggtggcggccgctctagaactagtggatcccccgggctgcaggaattcgtctcacccctagaaaaagatctctcgcgagcatctcccgtgcccctcactgtttagtggcgaccactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaagtgcccgagcattggaccactgtcacttccggtgctgtgcaggcccccgtagtgcaaactctttcaagaagaaagactctttcgagaagaaagactctttgctcgaacttcatccggaggtatctctgctccgtggccagaagagtgccgaggttgtgccaatgaaaggttcgtctgatggggggctgttagagggactgggggtgccaccggaccgaaatgattacagtgaggctaagatcaaggtagttggagttggaagcggggcgtcggaatgcagtccatcgggatgaattgagagctcccttgaacgggcgtttaaattttgggatccggaaaaccctgaatgtgcagggcccattaaaaatggcctccccggggcatcccccacaaaaaaaactgtcaaaattgggaacaggcgatttgtcacctccaaaancccctcgggcgcccctggggagt

SEQ ID NO: 81572 - DNA, 791 bp, Zea mays
  misc_feature: Ceres CLONE 1567074
  misc_feature: Encodes the peptide sequence at SEQ ID NO. 81573
  misc_feature (618)..(618): n is a, c, t, g, unknown, or other
  misc_feature (619)..(619): n is a, c, t, g, unknown, or other
  misc_feature (685)..(685): n is a, c, t, g, unknown, or other
ctccccgcggtggcggccgctctagaactagtggatcccccgggctgcaggaattcgtctcacccctagaaaaaatcactccctcgcctcccccgctgtgccggcctgcacacacagacacacacaccacagcctacagcgcttctgctgctccagctcctcgtactaccgcgcccgcgcgctgctcgttccccggcctctgcttgcttggctcgtcgagcccagaggttggtggagaggcggggcttattgccccagataggagatcggggacgcgggagggcgcgtcgcgctcgggccggtctcggttcagcgggatcacttggccgtggccgtggtcgggcctccggcgcccatgtggtgagccaagccaggcttttgttgcccggggggcagagatcttgcacttgcagcagtgaagccggcggtgcggtccggtccggtccggagccgagcggcgcccaccgccatggccggcagcgacgaggtcaaccgcaacgagtgcaagggggcggtgccgatccacacatgggtcctcatctccaactttcagctggcgtacaacatgctccggcgggcggacggcaccttcgaccgcgacctggccgagttcctggnnaccgcgggtggcgcccgacgcgcgggcccagaagggggtctcctccttcgacacgtgatcaacacntcgaccgggctggaggtcgcatctaacggggccgccgcaaaaacaaacgggggggggggggccccccttgcccatccttggattccctccgggggaaccccggcgg

SEQ ID NO: 81573 - protein, 107 aa, Zea mays
  misc_feature: Ceres CLONE 1567074
  misc_feature (50)..(50): Xaa is any aa, unknown, or other
MAGSDEVNRNECKGAVPIHTWVLISNFQLAYNMLRRADGTFDRDLAEFLXTAGGARRAGPEGGLLLRHVINTSTGLEVASNGAAAKTNGGGGAPLAHPWIPSGGTPA

SEQ ID NO: 81574 - DNA, 893 bp, Zea mays
  misc_feature: Ceres CLONE 1567076
  misc_feature: Encodes the peptide sequence at SEQ ID NO. 81575
  misc_feature (421)..(421): n is a, c, t, g, unknown, or other
  misc_feature (479)..(479): n is a, c, t, g, unknown, or other
  misc_feature (495)..(495): n is a, c, t, g, unknown, or other
  misc_feature (527)..(527): n is a, c, t, g, unknown, or other
ctccccgcggtggcggccgctctagaactagtggatcccccgggctgcaggaattcgtctcacccctagaaaaagtggcaacaatagcagcagccgggcgggagctcccgcttccccccctccccccatcagatgatcagatcagtccgtccctgcccatctgccctgctctctaatggcattaactgccgcccacccacccgccatctcctcccctacccagctgcacgctcctcttctcctgctagcagtactgctatatatcaataatactagctggaccctttccactcccctcacctctcactaccaccaccactgccccggatccataccagctgcagcagcagcgcgcgcgagctagcttcggtcggtcgatagatcgatcgatcgctcggccatcatggcgcgggaagagcangcgctgctgtcgacggagatcgtgaaccgcggcgtggagccgtcgggcccggacgccngctcgccggccttctncgtgcgcgtgcgccgccgcctgccggacttcntgcagtcggtgaaccctcagtacgtgcgcctcgggaacaactacttatcagccacggggtgaaccgggcaccatcccccgtaatcgggctggggggcgggccccaattggggaaccttaacccccaacaaatttgggcccaagggtgtggggggaggccccttagaaccttccccccggggttccctttctctgcgggccccgcctttccaaatttcgggtaaaaaaatggcaggggcccaggcgcggggaaccctaaaaaattttcgggggaaaaaaaacggcgccaaaaaaataatggtgttccagggggggaatttttatcaccttgggcggcaaaattcgggggtttttatcaaaaaaacac

SEQ ID NO: 81575 - protein, 61 aa, Zea mays
  misc_feature: Ceres CLONE 1567076
  misc_feature (6)..(6): Xaa is any aa, unknown, or other
  misc_feature (26)..(26): Xaa is any aa, unknown, or other
  misc_feature (31)..(31): Xaa is any aa, unknown, or other
  misc_feature (42)..(42): Xaa is any aa, unknown, or other
MAREEXALLSTEIVNRGVEPSGPDAXSPAFXVRVRRRLPDFXQSVNPQYVRLGNNYLSATG

SEQ ID NO: 81576 - DNA, 786 bp, Zea mays
  misc_feature: Ceres CLONE 1567077
  misc_feature: Encodes the peptide sequence at SEQ ID NO. 81577
tggagctccccgcggtggcggccgctctagaactagtggatcccccgggctgcaggaattcgtctcacccctagaaaaaagccgcctctgctcctcctccgcctccttcttcttccccctctcaaggctctcctcctccacagcctgcagtccagctcaccaggaccaggcaggagaagaagttgcatagccgcgcatctgcatccacatccacactctgaacagttgagtccctcctctccctatcccccccagttgccttatctcctcgcgtcctagctacaaccatacctgcgtgcgccggcagcgagaaaggagcagctaccggccgtgacgttcttctcaccgtacgtcgccgagggattagataaactaagcagggcgctgcacgaggatggggtgcggggcgtcgagccagaaggacgccggggcgccgcggaggcggccggtgagcgtcggcgacgtggtcgtcttcctcccgggcctccgcgtgccgagggccgtcgacttggcccaggcgctcggcggctgcctggccaggagcgccgtggaccggctgtcggctctgcgatcgcgggtcgtcgagatggcaatgcgagagtcggcggcggcgctcaagcccaggcggagggcggcggcacggcacgggtctagtacagccaatcttctacaggccctcgaagactacttgccggctctgctaggactggtaaaagaaggtagcgtcttgaggaaacaagtgcacttcacctggagtaaccaggaggataatgctgaggagacggc

SEQ ID NO: 81577 - protein, 130 aa, Zea mays
  misc_feature: Ceres CLONE 1567077
MGCGASSQKDAGAPRRRPVSVGDVVVFLPGLRVPRAVDLAQALGGCLARSAVDRLSALRSRVVEMAMRESAAALKPRRRAAARHGSSTANLLQALEDYLPALLGLVKEGSVLRKQVHFTWSNQEDNAEET

SEQ ID NO: 81578 - DNA, 869 bp, Zea mays
  misc_feature: Ceres CLONE 1567079
  misc_feature: Encodes the peptide sequence at SEQ ID NO. 81579
tggagctccccgcggtggcggccgctctagaactagtggatcccccgggctgcaggaattcgtctcacccctagaaaaagcatctcccatctcccatctgccgtctcccctcttcctcctcccctgcgatcttctccaccgcatcacctccctcgaaccctagacccacccacgcgcccattgccttcggtcgccatgtccgccgctcagcttctccgtcactcgcgcaagctgcggagtttgcaaaatgctgtaggttgtgagaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacttggagaatagcatccaacagccttaccccaagtgctgctagctggctcagtggttcattctcatgtggacaggtagtctcagcgcggccattctcaagtagtgcagagctgcctccacataaagaaattgggatgccgtctctttcacctacaatgactgagggaaacattgccaagtggcttaagaaggaaagagacaaggtcctcccctggtgaggttctctgcgaaggtggaaactgacaaagcccactgtggaagatggcattgcatggaaacagggctatctttgctaagaatttttcataggagatggtgccgaaagaaaattaaaagttggtgaaggtccatggcttaaaactgctaaaaagaaagaagggtgaccattccagaaagtttaaagggattaattaacccgttgaatcttctcgggtgaaaccggtaggtt

SEQ ID NO: 81579 - protein, 147 aa, Zea mays
  misc_feature: Ceres CLONE 1567079
  misc_feature (3)..(146): SWISSPROT Homolog: EC 2.3.1.12 Dihydrolipoyllysine-residue acetyltransferase
  misc_feature (118)..(144): SWISSPROT Homolog: EC 1.2.4.1 Pyruvate dehydrogenase (acetyl-transferring)
MSAAQLLRHSRKLRSLQNAVGCENFSFVRHFSSGSGSFIARENGIGKRTRGTRFSQHNQPAKQLETFSAGVNGSCTWRIASNSLTPSAASWLSGSFSCGQVVSARPFSSSAELPPHKEIGMPSLSPTMTEGNIAKWLKKERDKVLPW

SEQ ID NO: 81580 - DNA, 898 bp, Zea mays
  misc_feature: Ceres CLONE 1567080
aagctggagctccccgcggtggcggccgctctagaactagtggatcccccgggctgcaggaattcgtctcacccctagaaaaaatcgtccgcacgccacgtcgcagcaaggttctcacgattctctgtcgtcctgcggtttcgtgatctcttgtgccgtgcggcgatctcgatccggccactcgacttgcccccttttgtggctgtgtcgcggagcgagaccactcgttgatgacagcctgtgcttggccaggctagacggagcaggtccagcgggacgagtgaggatcgtccagttcgtggagactgtctaccgtttctctgggggggccgtggtttgtgctgggagggaaggaatccatggggctgcagctcgatccgcgctgagggttgaaagaaccggccttgttgtgtgctccacccaatcaaggaaaacgggcaaggattgctgctttgctgtctttggatccggtacgccattggggatgtcaccatcaatatggcgaagtgacggttctgcaccactgtttcccttagcctaattcgatgtatttggaacacggatgtgattacaatctcggttgctgtcctgtgaagctccatctgggggtttccgcaggccgggatccagaaggaaggtccccttggaattccgtcgcctggacgccccccttgtaacctacggagtcttagttggtaactttgttgtagatttttcggggggcccccctggtttaggggagccccccggatctcccttagaattcaccaccgtgtgggaaaaatggtcttccccccctcgatgggggaaagaccccttttggtggcctccctgccccacaaagaagaacccctttggttatttcttggacacattttgtgtttcttttacaagaggg

SEQ ID NO: 81581 - DNA, 982 bp, Zea mays
  misc_feature: Ceres CLONE 1567081
  misc_feature (980)..(980): n is a, c, t, g, unknown, or other
ccccgcggtggcggccgctctagaactagtggatcccccgggctgcaggaattcgtctcacccctagaaaaaagcgctgcagtagcagcaatgcagccacaccgcaggaacagttacaccgaaccatagcgcttctacttcaaccacgcctcccgtcccatcctttccgcacgagcagcccaccaccaccacgccatctcggacgcctcttgcttccttactctccacggtcccggaaggaagcgccgcatgctgctcggggcggtcacgtgccgcgcatccagggtcaaggagcccagctccaagcgcacgcgcctcgcctccgccgccgccacaggcgctgacaaaagaggcgcacaaatacttcgaccacgccgtggtcaccgtccgcgcgggcaaccgctggcacagagccttgctacccatgcctgcggagcccttcccaggactccgcgaaaccccgcggtatgttcaaccagggcccaaaagaatagcaagaaagttgtccatacaaacaaaatctacttacgggtcccttggacgcttcccgactggccggaacactgaccgaaaaactttttttgggtggttccccccaacctaagtccaaaccaaggacgccttaacattcaatttcaaaccaacaagggcttctggttaactggcccaccaaaacgcggggaaagtgaaaaacgtggggggaccccccgctttgggccgggcacctcttaaaacctctcgcagaaaatcacaaaagcagggattttcgcccgggggaaaaaacagccttaaaagaaataaccccttgcgccctcgctctggaaaacttgtttgtggtaaacaaccccaaacaaaagaggggggcttgtttatttgggggagggaattttggggctctcacaaaactttaaagaaatagaaagaggcctacgttatcccctcaacaaaggtatgtataaacaggactggacaaataaaantt

SEQ ID NO: 81582 - DNA, 877 bp, Zea mays
  misc_feature: Ceres CLONE 1567082
  misc_feature: Encodes the peptide sequence at SEQ ID NO. 81583
  misc_feature (451)..(451): n is a, c, t, g, unknown, or other
ggagctccccgcggtggcggccgctctagaactagtggatcccccgggctgcaggaattcgtctcacccctagaaaaattggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtaccctgagacttacactgatgacgntgcgcatgagattgctggagagcttcagggcaatcctgacctgatcatcggaaactacagtgaccgaaaccttgttgcgtgtttgctcgccaccagaagggtgttactcaccggaccattgcccatgccttgaaaaaacaaagacctaaactccaaccttaccgggaaaaagttggaggaacttaccctttttcggggccgtttcccccctaattttatttcaaagaaacctggccaattttttttttcccggttctttttaaaaaaaaaccccaaaaaaaaagaaaccccgcgccccaaaaaaaaaaaacaaaggggggtaaaaaaaaccgggggtgtttcaccctttttccccgcgtttttttttttttttcaaccaccaataaaaaaaattgttttctctgggggggagagaattcttttatc

SEQ ID NO: 81583 - protein, 163 aa, Zea mays
  misc_feature: Ceres CLONE 1567082
  misc_feature: SWISSPROT Homolog: EC 2.4.1.13 Sucrose synthase
  misc_feature (120)..(120): Xaa is any aa, unknown, or other
MVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYPETYTDDXAHEIAGELQGNPDLIIGNYSDRNLVACLLATRRVLLTGPLPMP

SEQ ID NO: 81584 - DNA, 914 bp, Zea mays
  misc_feature: Ceres CLONE 1567083
  misc_feature: Encodes the peptide sequence at SEQ ID NO. 81585
ggagctccccgcggtggcggccgctctagaactagtggatcccccgggctgcaggaattcgtctcacccctagaaaaaacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatggaagccgcaccgcaatccggaatgacgcaacccgctggctgggcgccgctaccggcttccctcaaaccaaaaatgcaagggggtaaccgccccccaacccccgggccccgccaaaaccccccaaaccttctgggccccctttttccacccccccaaaaaaaaaaacattaaaattttcctgtgggcctcccgttccacccccgggaaaaacccccccccggggaccccaaaaatccccccccgggttcaaagaggcctttttaaaaattttgggggagaaaaaaaaaattgccccccctttttttttaaaaaggggccccttataaaaggttttttgtgcgccaaaaaacaattttgtgcgggggggggccccccccccccgggcggggggggcccccctaaaaaatttaaaaacacccgggggcccaaaaaaatatttcaaaaaaaaaaaatatggggcgggggggggggccttttttacccccaccccccaccaaaaaaattgagcgaagggggcttcggggggtttttttctttctctctctcaaaaaaaacaaaattgtgggttctccccca

SEQ ID NO: 81585 - protein, 100 aa, Zea mays
  misc_feature: Ceres CLONE 1567083
MDPSSAGSGGNSLPSVGPDGQKRRVCYFYDPDVGNYYYGQGHPMEAAPQSGMTQPAGWAPLPASLKPKMQGGNRPPTPGPRQNPPNLLGPLFPPPQKKKH

SEQ ID NO: 81586 - DNA, 832 bp, Zea mays
  misc_feature: Ceres CLONE 1567085
  misc_feature: Encodes the peptide sequence at SEQ ID NO. 81587
  misc_feature (815)..(815): n is a, c, t, g, unknown, or other
ctccccgcggtggcggccgctctagaactagtggatcccccgggctgcaggaattcgtctcacccctagaaaaacgttcgtctgacttgggtataggggcgaaagactaatcgaaccatctagtagctggttccctccgaagtttccctcaggatagctggagcccacacgagttctatcgggtaaagccaatgattagaggcatcgggggcgcaacgccctcgacctattctcaaactttaaataggtaggacggcgcggctgcttcggtgagccgtgccacggaatcgggagctccaagtgggccatttttggtaagcagaactggcgatgcgggatgaaccggaagccgggttacggtgctaaactgcgcgctaacctagaacccacaaagggtgttggtcgattaagacagcaggacggtggtcgtggaaacaacaacttagcataacaaaagcccttgcccacgccatgacgctcagcaagaagcaaggcgcaggcactgatcagcaggccttgctggatgctcagctgcagctctggcaccacaccatcgcttttgtcaagtccatggcgctcaaggccgccgtagacctccgcatagcggacgccatccacctgcacggcggctcagccaccctctcgcagatagtcaccaaggtcacactccacccgtccaagataccatgcctgcgacgcctcatgcgcgtgctcactctcaccggcgtcttcagcgtcaacaccggacgccgttgtcgacgagcccgtttacggtctcacgctggcgtctcgccatctggtcgggccggggctgnactagaccccgtatctt

SEQ ID NO: 81587 - protein, 120 aa, Zea mays
  misc_feature: Ceres CLONE 1567085
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
  misc_feature (115)..(115): Xaa is any aa, unknown, or other
MTLSKKQGAGTDQQALLDAQLQLWHHTIAFVKSMALKAAVDLRIADAIHLHGGSATLSQIVTKVTLHPSKIPCLRRLMRVLTLTGVFSVNTGRRCRRARLRSHAGVSPSGRAGAXLDPVS

SEQ ID NO: 81588 - DNA, 892 bp, Zea mays
  misc_feature: Ceres CLONE 1567087
  misc_feature: Encodes the peptide sequence at SEQ ID NO. 81589
  misc_feature (471)..(471): n is a, c, t, g, unknown, or other
tccccgcggtggcggccgctctagaactagtggatcccccgggctgcaggaattcgtctcacccctagaaaaaacacacccggaccccggtctgcgtttgtccctgcgggctgcggccctgcctcttctcttctcccgttcccctcgccgcgtgagctctctctctctctctcctctgtggtgacgactgggcgcccgcacccccggcagccgccgccgcccagtccccgtcgggcccttcggcaggtcttcttcggccccttcgccggcgacgagccgcaccaggcgtacatgtgtacacccaggcccttaactgcgcccgcccctgcgactggttttcctgctggtttgtgtggatttggctgccggaggattggtgcagcctttaggatcacggtagattcgctgtgaaatccgaagggtgctcaggtcatgttgggggaccagcgcatgatactgggcttagactcngcaacctcatcaagcactgcccctgatttgacccgcgctgaagaggatccttctgtgagcaggagctgcgtgatccaccgcctgcaggtggggtgggcgccaaaaggaagaacgggtgaaggttctggtaatttttttttcaagaaaaaaaaaccgggaggtggttcaaggaaattttgaaccaaagcctgggcctttcaaaatggaaggttttaaatagaggggggggaaaaccaaacggggcaccctatttggggggaattggcggggaaattggggcattttaagggcgggttccggtttttcccggggtttaatatttttaagggggggagagggtgtaaaaaagtttttttactctcccctttttgagggtttgggggggatttttccccttttaagccccttaggtgtggtgaat

SEQ ID NO: 81589 - protein, 72 aa, Zea mays
  misc_feature: Ceres CLONE 1567087
MLGDQRMILGLDSATSSSTAPDLTRAEEDPSVSRSCVIHRLQVGWAPKGRTGEGSGNFFFKKKKPGGGSRKF

SEQ ID NO: 81590 - DNA, 920 bp, Zea mays
  misc_feature: Ceres CLONE 1567088
ctccccgcggtggcggccgctctagaactagtggatcccccgggctgcaggaattcgtctcacccctagaaaaaaccggacaggtagcgcaccacaagacggactgccgcatagaacatatcaaggccgcctcgttctctcaacatacggaggcagcagccgggaagcagcgcgcgcgtgcagtcacccatccatccgtgcgtccgtccgtcgtacaccgtacaacgccagagcgcgctcgacacagaacccagctagcaacacaagaaaagtctggtggcgacggaagccgctgtcgcggacagcttgccacagtacaatccttggaccagacaaaaagcagtttaaggctcgagcgagcaagctagcgcgcccttcatcgctacgagcctacgacacgcgatcgagccgggcattgctgacctcgagttaacaaaggcgaacagaggtggtttattccagctaggatccttgtcgtgagcccagacgatctgaccagaccttggtatccgggggggttggtcaagaacacccttcccctattttgagaagtcgggacaggtttcattaaatctacaaatggtttccaaaattaaagtgggcacaacgaacaaaaaaggaatttgctaaaaatgggtgagtaggttgggaacccactaaaatacatcgcttgggaaagtattaacacgttcggggaattttttttggtttgaggggatctttctttccccacatccattccccaattaaagaccataatttggtcgggacaggatggggtacccctctctttgggaagaacaagaaagaaaggggtgcgggggtaatggactgaaaatctttcacaggaaaaaaccccagttacctccccgatatgagaaacgcccgagaaaataatagggcgctctaaacataaaggg

SEQ ID NO: 81591 - DNA, 824 bp, Zea mays
  misc_feature: Ceres CLONE 1567089
  misc_feature: Encodes the peptide sequence at SEQ ID NO. 81592
  misc_feature (505)..(505): n is a, c, t, g, unknown, or other
ccccgcggtggcggccgctctagaactagtggatcccccgggctgcaggaattcgtctcacccctagaaaaaaagctagctagctctgccctctgctcggggctcctccttcccagtaacaactaacaagtctacacacaggggacaccacaagtacatcgccaccgacggaggaggaacaacaagaaccccgatgacaattgcagccgcggtgaccgcgcccacgtccgcgccagtgcacgtcgcgccgcgccacgccagccccgcggtccagccgcgcgccgcgccgcgcagggagccgtcgccgctcaaccccaacgcgccggcgcaggcgctccgctccgccagcccggcgggcggcgggtcttccgcggccacggacggcgccagggctcacatcgccaaccttgacaaggtgctcgggaagccgccgcaggtgccgaggcccgcgagccacgccgccgccagcaggcagggccagggccaggggcaggacggcgagcangagccgctcaacgtccggcacggcctgctcaacgcgctcaacctctccttcttcgtgcccatgcccggggatgcgggcgcggacggccgccgacgagcacatgtcgccgcgcagcctcatgcacatgcagcagctcctctccggcggactccccgcgggccctcccccgcgggtgcaacaatcgcggccgcggcttggcgcagccctccccccggggaaggggccgccttgggaagggcccccccttaaacccccctggggaaactcggaaaccttcccgcggcgggggctgccctcccctatagggggaaaattttgg

SEQ ID NO: 81592 - protein, 186 aa, Zea mays
  misc_feature: Ceres CLONE 1567089
  misc_feature (104)..(104): Xaa is any aa, unknown, or other
MTIAAAVTAPTSAPVHVAPRHASPAVQPRAAPRREPSPLNPNAPAQALRSASPAGGGSSAATDGARAHIANLDKVLGKPPQVPRPASHAAASRQGQGQGQDGEXEPLNVRHGLLNALNLSFFVPMPGDAGADGRRRAHVAAQPHAHAAAPLRRTPRGPSPAGATIAAAAWRSPPPGEGAALGRAPP

SEQ ID NO: 81593 - DNA, 823 bp, Zea mays
  misc_feature: Ceres CLONE 1567093
  misc_feature: Encodes the peptide sequence at SEQ ID NO. 81594
ctccccgcggtggcggccgctctagaactagtggatcccccgggctgcaggaattcgtctcacccctagaaaaaaccccacccccaaaatcacacgaacccagagagtggattataaataagccctcccaaaccccttccatttcccgtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggtttgacacctacttctccatggccaggggcaacgccactgtccctgctatggagatgaccaagtggtttgacaccaactaccactttattgtcccggaagtgggcccaaacaccaagttctcctatgcttctcacaaggctgttaacgaatataaggaggctaaggcgctcggtgttgataccgtgccagtacttgttggaacagtctcgtacctgttgctctcaagcctgccaaggggtgggagaagggattccctcttctttccctactagcagcatccttccagtctacaaggaggtcatgctgaatttgaaggcagctggggcttcatggaatcaa

SEQ ID NO: 81594 - protein, 180 aa, Zea mays
  misc_feature: Ceres CLONE 1567093
  misc_feature (2)..(179): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPEVGPNTKFSYASHKAVNEYKEAKALGVDTVPVLVGTVSYLLLSSLPRGGRRDSLFFPY

SEQ ID NO: 81595 - DNA, 933 bp, Zea mays
  misc_feature: Ceres CLONE 1567100
  misc_feature: Encodes the peptide sequence at SEQ ID NO. 81596
ccatctgtagcttcccttggtggcggccgctctagaactagtggatcccccgggctgcaggaattcgtctcacccctagaaaaaattccggcggctcaatcccagtcaatcatatagcagagcagcccgtgaccccctgggcgtgtgctgcgactgctaagagggaggagggatgatgagactccgacctcgtcatcgacctggatgcgacgggggagacggaagacgacaggcggcggcttcgcaaggagcaggaggccctgcacgccagcagcctcagggtccccaggcgaccgccatggcatagtcagatgactgtggaggagcttgatgtgaacgagcgtcgggcctttctggtgtggcgcaggaatcttgcaagattggaagagaatgataagcttatcccgactccctttgagaagaatattgacatttggagacaactctggagagtgcttgaacgcagtgatttgttggttatggtggttgatgctcgggatcctttgttctaccgctgccctgaccttgaggcatatgcaaaggaaattgatgaacacaagagaacaatactccttgttaacaaggctgatctgttgccgttaaatatcaggaagagattgggctgattattttaagggacatgacattctctatgtgttctggtcggctaaagctgccactgccacattaaaaggcaaaaagttaagttggatacctctgaaagaaaaatctgcttcaccttgatttggcatacccaagattttttggaatgggatgggaactcctcggattgaagccttgcaagctctgaaatgtagaaactctattgtttgactcttaagaaattaggaatcttgccccctacttttgttgaattgatatcacccatacccctcgcgcgttctcttctaggagatttacggtgttatcact

SEQ ID NO: 81596 - protein, 104 aa, Zea mays
  misc_feature: Ceres CLONE 1567100
MTVEELDVNERRAFLVWRRNLARLEENDKLIPTPFEKNIDIWRQLWRVLERSDLLVMVVDARDPLFYRCPDLEAYAKEIDEHKRTILLVNKADLLPLNIRKRLG

SEQ ID NO: 81597 - DNA, 835 bp, Zea mays
  misc_feature: Ceres CLONE 1567101
  misc_feature: Encodes the peptide sequence at SEQ ID NO. 81598
  misc_feature (369)..(369): n is a, c, t, g, unknown, or other
  misc_feature (767)..(767): n is a, c, t, g, unknown, or other
  misc_feature (777)..(777): n is a, c, t, g, unknown, or other
ctccccgcggtggcggccgctctagaactagtggatcccccgggctgcaggaattcgtctcacccctagaaaaaatcgcaaacaccagcggcggcgccgggaccccgaaaaccctctccccgcgcaccacggccaacaggaaccactccgctcttccgagccctagccgtcccgggccgggccgggctcccctacatgacgccggcgtgaggcaggcgcttagtggatcgcgctggtgggaggatgcagggcagtgtcatggcccatgccgccgcggcggcggcggccgcgtcgacggtgaccacggcggtggcgcccccagtcacggcgcacgcggtggcggtggcgcccccggtcacggcgcacgcntgcgggcggcggcgggcaacggcagcgccaccgccgcgccgccgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaagggtgatccagacagatgggaatttgcaaatgagggttttctgagaggacagaagcatctgctgaagactatcaacagaaggaaacccatccttgcagggggacagccaaccacagcaacctcagtcgcagaacgctcctgtgcctccctgtgtagaggntgggtagttnggggtttggaagaaaaaaaattaaccggctaaaaagggaaaaaaaaggttcttaatct

SEQ ID NO: 81598 - protein, 127 aa, Zea mays
  misc_feature: Ceres CLONE 1567101
  misc_feature (2)..(126): Pfam Name: HSF_DNA-bind Pfam Description: HSF-type DNA-binding
  misc_feature (118)..(118): Xaa is any aa, unknown, or other
MKTYEVVDDPATDDVISWGPGNNSFIVWNTPEFARDLLPKYFKHSNFSSFVRQLNTYGFRKGDPDRWEFANEGFLRGQKHLLKTINRRKPILAGGQPTTATSVAERSCASLCRGWVVXGLEEKKLTG

SEQ ID NO: 81599 - DNA, 871 bp, Zea mays
  misc_feature: Ceres CLONE 1567102
  misc_feature: Encodes the peptide sequence at SEQ ID NO. 81600
ggagctccccgcggtggcggccgctctagaactagtggatcccccgggctgcaggaattcgtctcacccttagaaaaatctcaacgcaaacccaactgtcttggttgcgcaagcaccaagcaggtggaagatgatggaggtggcgggggctcaggcccgcgcggttcccctcctgctccgcaacaccgcctccctgcggacctccgtctccgtctcctgcacgggctcccgccggagctgggtggcggcggccacggcggagggggacgagacccgcggcttcgacaaggtgcccatggacacccccggcgcgtaccgcctggtagaccgggacaccggccgcagcgtcatcgtgtggggcggcaccgacgacagcgacgaggcctccatgccgtccccggcggtgctctcccggaccaccgaccgccgccacagccaaggtgttgggggaagtacaggtatcgggaatttcggcaagttcaaggcacagaagataaaatccttggtcacgaggtcagctcaacgcaagagggagagttctaatcgctcaagcactggcttggtctgatgaatcttctttcaatggctctgatgattgaaaaggaaagcttattttgagagaagaaagcatgttctcaaacttcgaaccccccccgaaagaagaagagttggttccaagaaatggaaaaacctccaaagggcacctttctcccgaagttccggtttttggccccaattaccaagggggaaagaagaaaaccaaacttttcccggggtttcaagaggctcccttttttggtttcaaaaaaaaaggggggggaaattgttttcccccaattttttttcttttgggaacgggcggaatttccga

SEQ ID NO: 81600 - protein, 144 aa, Zea mays
  misc_feature: Ceres CLONE 1567102
MEVAGAQARAVPLLLRNTASLRTSVSVSCTGSRRSWVAAATAEGDETRGFDKVPMDTPGAYRLVDRDTGRSVIVWGGTDDSDEASMPSPAVLSRTTDRRHSQGVGGSTGIGNFGKFKAQKIKSLVTRSAQRKRESSNRSSTGLV

SEQ ID NO: 81601 - DNA, 851 bp, Zea mays
  misc_feature: Ceres CLONE 1567104
  misc_feature: Encodes the peptide sequence at SEQ ID NO. 81602
  misc_feature (793)..(793): n is a, c, t, g, unknown, or other
ctccccgcggtggcggccgctctagaactagtggatcccccgggctgcaggaattcgtctcacccctagaaaaagaggcggccaggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcaagcgctcggtgctcaagtccttctcgtacgtggtccacgacctggtgatcgccgcggcgctcctctacttcgcgctggccatcataccggcgctcccaagcccgctcggctacgcggcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccctacttctcgtggaagtacagccaccggtgccaccactccaacactgggtcactggagcgcgacgaggtgttcgtgcacaagaacgacgaggcgctgccgtggtacaccccgtacgtgtacaacacccggtcggncggctggtgcacatcgtggtgcagctcaacctcgggtggccgctgtacctggcgacat

SEQ ID NO: 81602 - protein, 203 aa, Zea mays
  misc_feature: Ceres CLONE 1567104
  misc_feature (95)..(201): Pfam Name: FA_desaturase Pfam Description: Fatty acid desaturase
  misc_feature: SWISSPROT Homolog: EC 1.14.99.33 Delta(12)-fatty acid dehydrogenase
  misc_feature (184)..(184): Xaa is any aa, unknown, or other
MGAGGRMTEKEREKQEQLARATGGAAMQRSPVEKPPFTLGQIKKAIPPHCFKRSVLKSFSYVVHDLVIAAALLYFALAIIPALPSPLGYAAWPLYWIAQGCVCTGVWVIAHECGHHAFSDYSLLDDVVGLVLHSSLMVPYFSWKYSHRCHHSNTGSLERDEVFVHKNDEALPWYTPYVYNTRSXGWCTSWCSSTSGGRCTWRH

SEQ ID NO: 81603 - DNA, 791 bp, Zea mays
  misc_feature: Ceres CLONE 1567105
  misc_feature: Encodes the peptide sequence at SEQ ID NO. 81604
ctccccgcggtggcggccgctctagaactagtggatcccccgggctgcaggaattcgtctcacccctagaaaaaaaacggcgaccttcctccatggccaaatcgttgtcctcctccgcttccctccaaatccaccctggatccaaccccgattttccccagcagaagcaaacccgagcaaattgagcgcttgcagcttcacccggcgaagcagaatcgaatcggagccgctcgccactccgcgatggggatcctcctccggtccctcctcgtcgcctcgctcgtcctcagttcgctcgtcttgcacgtcgcagcggctaaaactatagatccttacaaggttctaggagttgacaagaatgctagccaacgggatattcagaaagcctttcacaaactttctctaaaataccaccctgacaagaataaagggaagggcgcacaggaaaaatttgaagaaataaacaatgcatatgagattctatctgatgaagagaagaggaaaaactatgacctctacggggatgagaagggtaaccctgaatttggtggtggaaattttggaaatcatgggggttctacatacttcactggtggtggccctaagtccagtcaattcacatctggtaatggatggcagacgatgggtggtcaaggaaatacaaaaacgttttcattttcatttggtggtaaacctggggccagtggtggaaacccgtttgggtggtgttttgatctttggtgatgttttctcgaacctttttggtggtggaccaatgggtgatagccata

SEQ ID NO: 81604 - protein, 166 aa, Zea mays
  misc_feature: Ceres CLONE 1567105
  misc_feature (29)..(90): Pfam Name: DnaJ Pfam Description: DnaJ domain
MGILLRSLLVASLVLSSLVLHVAAAKTIDPYKVLGVDKNASQRDIQKAFHKLSLKYHPDKNKGKGAQEKFEEINNAYEILSDEEKRKNYDLYGDEKGNPEFGGGNFGNHGGSTYFTGGGPKSSQFTSGNGWQTMGGQGNTKTFSFSFGGKPGASGGNPFGWCFDLW

SEQ ID NO: 81605 - DNA, 795 bp, Zea mays
  misc_feature: Ceres CLONE 1567106
ggagctccccgcggtggcggccgctctagaactagtggatcccccgggctgcaggaattcgtctcacccctagaaaaactctctcctctacctcctttgcctctaaccgttagctttcttccctccctctcctctctcccccctcctcataacaagatactactcccacccattcagatcctaagttgctgaccttgctgctgcttgttggagatacagttgctggttctaagttccaagcaccatgagtccacccagtgagatggggcactctggggacccaacctaggacaccggtttatgttgagagactcgcgtgggaaacacacagggagaccatgaggaagtacttccagctcttgggggagatcctggaggctgttgtcatcacggacaagaccactggcggatcctagggctacggaattgttaccttccgggatccggacgcgacaatgagagctagctgttgatcccgcaccagagattgatggaaggagggctgacggaaatctatgcgtcgctggcggctcaaagatctaggccttcctactccccagtatgaaggagctagaaactttcgagtactgaaatccttcaaccagcaggccgcaatccaagatggactcagcgcagctttgccttctcatgcctcctaccctcagtatgtcatccgcacaagccttctcttcgatggctatggatactctccatatacgacagactagggctatgcagacaacctctgcaagatatactgcaggagctcattacccgctctatgggaggagcacc

SEQ ID NO: 81606 - DNA, 719 bp, Zea mays
  misc_feature: Ceres CLONE 1567109
  misc_feature: Encodes the peptide sequence at SEQ ID NO. 81607
  misc_feature (283)..(283): n is a, c, t, g, unknown, or other
  misc_feature (284)..(284): n is a, c, t, g, unknown, or other
  misc_feature (308)..(308): n is a, c, t, g, unknown, or other
  misc_feature (309)..(309): n is a, c, t, g, unknown, or other
  misc_feature (333)..(333): n is a, c, t, g, unknown, or other
  misc_feature (334)..(334): n is a, c, t, g, unknown, or other
  misc_feature (378)..(378): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
aagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacgggcgagnngtcctcgagtccaagaaatcatcnnctcgatcggggagaacgcagaagnngtccccgcggctttcgggctttcggtcaccctttctcccacggnagggagggcgaattgcggaaaacgcccatcgaaggggcaatgaaacgggccaagggagcctgggaccggccccgccaaacaattcacccggtttcaaccgaagggccccccaatttccccccccgggccggccccccttttgaaaaggccccgcccggcccgggttggggggtaacccgggggggggtgggggccccctttttaaaaaggggccggggccgggggtttttaaccccnnnccccttttttggccccggggggcccccccccccccttttaaattaatgccccccgctgtttgggcccccnnnntggttttttaaaacggggggggggggggg

SEQ ID NO: 81607 - protein, 112 aa, Zea mays
  misc_feature: Ceres CLONE 1567109
  misc_feature (34)..(34): Xaa is any aa, unknown, or other
  misc_feature (43)..(43): Xaa is any aa, unknown, or other
  misc_feature (51)..(51): Xaa is any aa, unknown, or other
  misc_feature (66)..(66): Xaa is any aa, unknown, or other
MAASDVEYRCFVGGLAWATDDHSLHNAFSTYGRXVLESKKSSXRSGRTQKXSPRLSGFRSPFLPRXGGRIAENAHRRGNETGQGSLGPAPPNNSPGFNRRAPQFPPPGRPPF

SEQ ID NO: 81608 - DNA, 906 bp, Zea mays
  misc_feature: Ceres CLONE 1567123
  misc_feature (180)..(180): n is a, c, t, g, unknown, or other
  misc_feature (181)..(181): n is a, c, t, g, unknown, or other
  misc_feature (188)..(188): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagactggccggcaagggctgatgnngcccggncttatcggcatcgatctcggcacgacgtactcttgcgtcggcgtgtggcagcacgaccgcgtcgagatcattgccacgacccagggtacccgcacacgccttcgtacgtcgccttcaccgactccgagcgcctcatcggagatgcggccaagaaaccagtcggcatgaacccccatcaccccggctttggatgcccagcgtctcatcggcagggaggttcctggaatcgtctgtgtcccaaagggaattcaaaatttgggccctttcaaggggctttttttgggcccggggggaaaacccaaaattttttttccccccccccaggggggagggaaaaaacatttttcccctaaaaaaaaattcccccctatggggtttttttcaaaaggccgcagaaatattttctaaaactttcttcctgttgggggcccccaaaaaaaaaagtggggggggaaaaaaaacccccccccccttttttttgaggccccccaagaggggggggcccccaaagaaaaatgcgggggggagaattttccccccctaaatgaggggggggaggttaaaaaaaaaaaacaaaacggggggggtgtaccccccttggtgtttgaaaaaaaaagaaactctccttcttttgggggagaaaaaaatacccccccctttttttttttttgagggggggggccctttttttttctccccccctcccccccaccgaaga

SEQ ID NO: 81609 - DNA, 833 bp, Zea mays
  misc_feature: Ceres CLONE 1567129
  misc_feature: Encodes the peptide sequence at SEQ ID NO. 81610
ccccgcggtggcggccgctctagaactagtggatcccccgggctgcaggaattcgtctcacccctagaaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccggcgaagaccttcttccacgacgtcggcctcggcggcatcggctacgaagtcacccgctacctctacgccacctgcaacgacctcaagttccccaacttcggcatcaagacggccgcccaactctaagatggtgggcgaagttcggcacgtttcatcgggtaagttgggcggtgtcacccgacgagaagacgg

SEQ ID NO: 81610 - protein, 174 aa, Zea mays
  misc_feature: Ceres CLONE 1567129
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPAKTFFHDVGLGGIGYEVTRYLYATCNDLKFPNFGIKTAAQL

SEQ ID NO: 81611 - DNA, 804 bp, Zea mays
  misc_feature: Ceres CLONE 1567135
  misc_feature: Encodes the peptide sequence at SEQ ID NO. 81612
ctccccgcggtggcggccgctctagaactagtggatcccccgggctgcaggaattcgtctcacccctagaaaaatctggtagtggcaacttccgtttcagcccgccgcgcggaggccgctggttggccaggggacaccacgccttccattattagagtaccactactccattagtaccagcgtaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcaggaggcggcgcagcagatcatcagcgacgagctcatgctggacggcaacccgcgcctgaacctgggcgtcctcgtcaccacgtggatggagcccgagtgcgacaagctcatcatggactccatcaacaagaactacgtcgacatggacgagtaccccgtcaccactgagctccaggacccgctgcgtaaacatgaaagctcacctgtttcaacgcgcgaaatcaagaggaccaaacggcttttgggggtcggaaaatggggatcctcggaagcaaatcatgcttgcagggttgggggtttaaaaaagaaatggccaaaaccaaaggaaggggggcgggggaaaacccgtgtgaaaaaaaccaaaattgttacccgggggccaaaaattaaaggtttttctggggaaaaaatttttccaggggattttttggggggggaaccttaaaggggg

SEQ ID NO: 81612 - protein, 188 aa, Zea mays
  misc_feature: Ceres CLONE 1567135
  misc_feature: SWISSPROT Homolog: EC 4.1.1.15 Glutamate decarboxylase
MVLSHASSGRDDDDAVASTFASRYVRERLPRYRMPERSIPQEAAQQIISDELMLDGNPRLNLGVLVTTWMEPECDKLIMDSINKNYVDMDEYPVTTELQDPLRKHESSPVSTREIKRTKRLLGVGKWGSSEANHACRVGGLKKKWPKPKEGGRGKTRVKKTKIVTRGPKIKGFSGEKIFPGDFLGGEP

SEQ ID NO: 81613 - DNA, 906 bp, Zea mays
  misc_feature: Ceres CLONE 1567140
  misc_feature: Encodes the peptide sequence at SEQ ID NO. 81614
tccccgcggtggcggccgctctagaactagtggatcccccgggctgcaggaattcgtctcacccctagaaaaaagcctcctctttcgatagctggcgaaggcgcggcgcgcagggccagtagcaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaggccgcgtcgtcgctggagagatacctctcggcgacggtgacgggagcggtgatgggaacgggggcggccccaccagcttcggccccgccgcgcgccccgccggcgatgaaggggggacggaagcagtatagcgcgttggggctgtcacgctcgagaagggcaagctcgatcttctcccagcgcccgcaagaaaatcaggcccgaatttggccaaccagtgggtggttgttggaaaatatttggaaaaaagggatcgggcaagggtgggggggggtaaataccccccatcaaattaattttgcaaactatccacgccccgctcgggggggatttttgtaggaaccgcacagagcgcaacaagggcgcttttctcgaatatgagaaaaagaataagacggatcagataaattaatcgggagcgagaacagcgcaagatataggttataagtggattagtcccggccgtcctgacggtatgacgcgcggaaagcacgtcgcgcaacgcattcctcgtcacacgtgattgtgagtatcttactactc

SEQ ID NO: 81614 - protein, 77 aa, Zea mays
  misc_feature: Ceres CLONE 1567140
MKGGRKQYSALGLSRSRRASSIFSQRPQENQARIWPTSGWLLENIWKKGIGQGWGGVNTPHQINFANYPRPARGGFL

SEQ ID NO: 81615 - DNA, 848 bp, Zea mays
  misc_feature: Ceres CLONE 1567141
  misc_feature: Translation starting site: 256
gagctccccgcggtggcggccgctctagaactagtggatcccccgggctgcaggaattcgtctcacccctagaaaaagtctaccctcctctccttcctcgccgcacacacagagtcacagacacacgcaaaaacatttctcccccctcccgactgctactgccgctgcctcctccccctttccgcccgccttcgctcctccgtctagggtttcccgccgccgcctgatccgagtcagatgccgcccgcaacagccatggcgccgccgtcccagcccccgtctaactcaggggatccgctgtacccggagctctggcgcgcctgcgccggcccgctcgtcaccgtcccccgcgtcggcgacctcgtcttctacttcccccagggacacatcgagcaggtggaggcgtccatgaaccaggtcgccgggaaccagatgcgcctctacgatctgccctccaagctgctctgccgcgtgctcaacgtcgagctcaaggcggagacggacaccgacgaggtctacgcgcagatcatgctcatgccggagcccgagcaaaccgatgtgccggctgagaagccgagttctgcacctgctgcgtcgccgaggccagcagtcaggtccttctgcaagacgctcaccgcctcggacaccagcacacacggtgggcttctctgtgctgcgccgacacgctgacgagtgcctccctcccctggatatgacctagtcgccctccacacaggaagctggtggcgaaggatctgcaatggcatggaagtggcgctttccgcccacatctttagagggcagccaaggaggcatctccttcagaggtggtgggagtgttttttgtt

SEQ ID NO: 81616 - DNA, 742 bp, Zea mays
  misc_feature: Ceres CLONE 1567143
  misc_feature: Encodes the peptide sequence at SEQ ID NO. 81617
  misc_feature (589)..(589): n is a, c, t, g, unknown, or other
  misc_feature (742)..(742): n is a, c, t, g, unknown, or other
gagctccccgcggtggcggccgctctagaatagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccttcgncggccgcctcgcccgcaacgccttcctctccgggcacgtgctcctcaacggtctgcaggccaagctctccttcggcgcctgcggcgtacgtgacgcaggacgactacctgatcgggaacgctgaacggtgcgcgaagacgatcgggctactcn

SEQ ID NO: 81617 - protein, 165 aa, Zea mays
  misc_feature: Ceres CLONE 1567143
  misc_feature: SWISSPROT Homolog: EC 3.6.3.28 Phosphonate-transporting ATPase
  misc_feature (125)..(125): Xaa is any aa, unknown, or other
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDAFXGRLARNAFLSGHVLLNGLQAKLSFGACGVRDAGRLPDRER

SEQ ID NO: 81618 - DNA, 1326 bp, Zea mays
  misc_feature: Ceres CLONE 1567146
  misc_feature: Encodes the peptide sequence at SEQ ID NO. 81619
  misc_feature (74)..(74): n is a, c, t, g, unknown, or other
  misc_feature (75)..(75): n is a, c, t, g, unknown, or other
  misc_feature (740)..(740): n is a, c, t, g, unknown, or other
tgtgttggttgcctctcattcgccttgaagagggggaagggggggaaggggagagtgggaggaggttggggtgnnaactggggctcccctcggtggcggccgctctagaagtagtggatcccccgggatggatgaatgcgtctcacctctagaaaaacgacgtgtcttgctgggacgcagcatccacgcgacgcggacgcccatccacgcacgcggcgtacggcaccgacatggccgtcctcgcgggcgacgctctcttcccgctggcctacacccacgtcatctcccacaccccgtccccggacccggtcccccacgccgtcctcctgcgcgtcctcgccgagttcgcgcgcgctgtcggatccaccggaatggcggccggtcagttcctcgatctggccggtgctaccgcccttggcgaggccgaggtcatgcaggtcctgacgaagaatttcggggagaatggccgaatgttccgggggccccccggggtcatgactcgagtggggccggggccaggatcaggaagccacagctgtcgacgccttgcggtgcgacaacccagtcggcggaccctggtaacgagactttggtctcaatcaatctttcccggtaaggggcgattcgggtgtgaaatccgggctctagtattgagaggaacgcgaagcccgcgctaggagggttgaccagtggcggatcaacctccttgggggggggaaattggagaacacccaagcctngctcgagcttatgtggggacgcaaatgtttgcgtctgatggcaagaggggacaaaagtccttccccaggaaggggggggagctggattcacaaaggggggatcccgccaaaggtgggagagcacataaaaacagggaggagtctcaatggaaggtaaatagggggggtttcctccgtctagatgggatgaaaaaaatgaactatttgtcgctggggtgcgagaaatttcagcccgggcggtgggtggctatttccacctccctcgtgttggagaaaaaacaaagccacatctcgccgtgctgcgggacacctgcgcgcgctccgtgaggggggcagtaaaagaagggcgtggtttccttttacgccgacctctcaaacaagggacaagtgctgaagccggggaaacaaccccgatcgaaattcacatgctccacctagtgagaaatgtgggggaggtagagtgagcaccttcaaggcctacgccgcggacacaacatttgtgacatttttggaaacgggtttttcggagcgtccatttgcgtaatctcggtagtccgcggctccctacgcaactatcttcgggcgg

SEQ ID NO: 81619 - protein, 148 aa, Zea mays
  misc_feature: Ceres CLONE 1567146
  misc_feature: SWISSPROT Homolog: EC 2.5.1.10 Geranyltranstransferase
MAVLAGDALFPLAYTHVISHTPSPDPVPHAVLLRVLAEFARAVGSTGMAAGQFLDLAGATALGEAEVMQVLTKNFGENGRMFRGPPGVMTRVGPGPGSGSHSCRRLAVRQPSRRTLVTRLWSQSIFPGKGRFGCEIRALVLRGTRSPR

SEQ ID NO: 81620 - DNA, 840 bp, Zea mays
  misc_feature: Ceres CLONE 1567148
  misc_feature: Encodes the peptide sequence at SEQ ID NO. 81621
  misc_feature (819)..(819): n is a, c, t, g, unknown, or other
  misc_feature (820)..(820): n is a, c, t, g, unknown, or other
ggagctccccgcggtggcggccgctctagaactagtggatcccccgggctgcaggaattcgtctcacccctagaaaaagccttcatcataagaaccgtgataacacgacaccacacaacggctgctccatcgcgttcgcttcgcgtcgtctcctgcaccattcgcttcccctcttcctcgcccgtcgtctcctccgatcgcccccagttaccgctgcaattcgatcggacgattagctagctgctaaaccgccatgaggaatcacaagaagcttctccagttcctgcggccggacccggcggtggcggcagcgccggcgaggtcgtccacgacgtcggacgacgaggacgacggcacgtcgcgttccacgccggcgactccgaccacgagcgcgagcgctgcggcgtcgccgtacgcctcgtccccgtggacgcatctcccggggctcggccccgacgaccctggtggccccgaggtggaggcgaccgggctcctcggctcgctcgtcaaggaggacgggggccacgtctactcgctggcggcggcgcgggacctgctgtacacgggcacggactcgcggaccgtgcgggtgtggcgggagcgggaccgccgcgagctgggcggcttccgctcgggcagcggcctggtgaaggccatcgtggtgggcggggacggccgcgtctacacggggcaccaggacgggaaggtgcgcgtgtggcgcgcgccgcactcggcggacgaggtcgtcgaggacccctccgcgctccgccgcgtggggacgctgccccggctccgcgacgtggctcgcagctccctccnntcgccgtcgcaagccatgct

SEQ ID NO: 81621 - protein, 195 aa, Zea mays
  misc_feature: Ceres CLONE 1567148
  misc_feature (189)..(189): Xaa is any aa, unknown, or other
MRNHKKLLQFLRPDPAVAAAPARSSTTSDDEDDGTSRSTPATPTTSASAAASPYASSPWTHLPGLGPDDPGGPEVEATGLLGSLVKEDGGHVYSLAAARDLLYTGTDSRTVRVWRERDRRELGGFRSGSGLVKAIVVGGDGRVYTGHQDGKVRVWRAPHSADEVVEDPSALRRVGTLPRLRDVARSSLXSPSQAM

SEQ ID NO: 81622 - DNA, 776 bp, Zea mays
  misc_feature: Ceres CLONE 1567157
  misc_feature: Encodes the peptide sequence at SEQ ID NO. 81623
ggagctcaccgcggtggcggccgctctagaactagtggatcccccgggctgcaggaattcgtctcacccctagaaaaaagtagtgctgcgcatatgcacacaaagggcaggaccgcaggagcacacacctcagtgcgccagcgttctgcacctcgctagctcgtcgtcttgcctgcgctgtcgtcgctgatccttgagatctgcagactccatggaggctgcagcagcgacgacggcggcggcgcttcttcctcccgctcggaaggtgttcatcctgcccctgcttctcctcctggctgcatcgtcgctggttccacgagcttcgtctgatggagcgcaatatgattatagagcttacactgagtgcaaacctcaccctgagccagctctgtacaacggtggcgtcctgcgctgggcgagcaaaataacggacttcagaacggaggacgaaggcaactactccccggcatttgtgctctacaacatgtcggcggcgactgcgtacagcttctcttgctgggtgaaaatcgacgggccagaaagcgcacatgtgaaggcgaagatactgaccgtggagaacgcagcgtcgcagtgcgtcggcaccgctatcgcgcgcaacgactgctggtcttttctcaagggtggctttactctcaactccacgtctcaaacctcggtgctctatttgcagactgcgagcccaaatgcttctacgatctcaatcagaagcccctccttgcagcccttctcacccgatcagtggaatcagcacaggc

SEQ ID NO: 81623 - protein, 188 aa, Zea mays
  misc_feature: Ceres CLONE 1567157
MEAAAATTAAALLPPARKVFILPLLLLLAASSLVPRASSDGAQYDYRAYTECKPHPEPALYNGGVLRWASKITDFRTEDEGNYSPAFVLYNMSAATAYSFSCWVKIDGPESAHVKAKILTVENAASQCVGTAIARNDCWSFLKGGFTLNSTSQTSVLYLQTASPNASTISIRSPSLQPFSPDQWNQHR

SEQ ID NO: 81624 - DNA, 806 bp, Zea mays
  misc_feature: Ceres CLONE 1567161
ggagctccccgcggtggcggccgctctagaactagtggatcccccgggctgcaggaattcgtctcacccctagaaaaaatcgtgctctgctcactctctccaagacaaatgacatgcgttgcgttgcgttgcttgctagcaacttgatatattcttgctgccatgccaatcgtcggtgctgatcctaatcatcctgtctaagctcagacgacgacacatcgagggatgcccctcgccggagccgcgacggccgcgaacctgccacgactcgccccgtacgcccaagtaccagcccgcccaccacgctgtcttcgccactcggcatcgccgacgtggcggccctcgccgacgccgacgccgacgccaagagcgtctccccgcccgcatggccggacgacgacgacgacgacgtcgccgggagggacgactgggtccaccatctcccgccccttgacatgcacatgccgccgctcggcctcggcgccccaaaagctgggagccccacgcgcaaccttccgggtccgggggggcttaacccttttggaaggcccaggagaaccccgaacagccccctttccctggggtgggtttattggccaaaacaaactcccccatttttggggggtttctggggaaaaaaccaaaaaatccccaacttgggggaactttttatgaaaacccgaaaaccaaaaaaaccccctctttttcctccccccggggccccccccccccccccacaatttattcaaaagaccttttttgtgggggccctcccccagaggtgggagacaaataaaccccccgcc

SEQ ID NO: 81625 - DNA, 1161 bp, Zea mays
  misc_feature: Ceres CLONE 1567165
  misc_feature: Encodes the peptide sequence at SEQ ID NO. 81626
  misc_feature (68)..(68): n is a, c, t, g, unknown, or other
  misc_feature (69)..(69): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
ggggggggtggttttttttgcgccacccacacacccttattatgattgaaatacacatcctcccccannaaaaaaannnnnnaaaaactgggactccccgcggtggcggccgctctagaatagtggatcccccgggctgcaggaattcgtctcacccctagaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgacgcctggcggacttcctgcagccggtgaacctcaagtacgttccccatcgggtaccactacctcatcagccccggagtgttcctgggccaccatcccccgtcatcccgcatggtggggcgggccccaaaccggggcaccctcaaaccccaaaaaaaccttgtgccccaaaagggtttgggggggaaaggcccccatacaaaactttccccacccgggggcccccctattctttccccaggcctttccccttaaacaaatatttccggttttaaaaaaaaaagggtaaaaggttttcccccccccccccccccaaaaaccccaatattaaaaaaattttcacggtggggttaataaaacccccggtgcccaaaaaagaaatcttctagaagagggtgttgttccacagggcgaggcgaaaattatttctcttcataaccaccttgtggggcggcacgcaagaaatactccgtggtgaaaaatttccttctccaaaaaaaaagaacaaacacacactccggcggggtattcactccccacctctcttattcttttcttgtgagtggacaaaagaatccgctccactggatttaacggtggcgcaactataagaaataataatggaatatcgccctcccctcaccaccttgactgtggtttgtatacataaaaacaaaaagatacacctctcgcttgtgtggcctccctccccttccccacctaaaaagagaagtagtggtgcccccccctcccgagaactaagatctctcccctccg

SEQ ID NO: 81626 - protein, 126 aa, Zea mays
  misc_feature: Ceres CLONE 1567165
MAREEQALLSTEIVNRGVEPSGPDAGSPAFSVRVRRRLADFLQPVNLKYVPHRVPLPHQPRSVPGPPSPVIPHGGAGPKPGHPQTPKKPCAPKGFGGERPPYKTFPTRGPPYSFPRPFPLNKYFRF

SEQ ID NO: 81627 - DNA, 800 bp, Zea mays
  misc_feature: Ceres CLONE 1567167
  misc_feature: Encodes the peptide sequence at SEQ ID NO. 81628
ctccccgcggtggcggccgctctagaactagtggatcccccgggctgcaggaattcgtctcacccctagaaaaaggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctcgaggagctcatgcaaggtgtaagtcttactgcaagaagggcagctgtgcatgttaagacccatacatagcctctcttgattacacagcacggggggtgaaaacttgagatacagttgatctcctggttcagagtatgggttcaaggtttgcatcgcatcagctgagcaatggcctgtatgtttctggtcgacctgagcaacctaaggagaaggccccaaccatttgttccactgcgatgccatatactgggggtgacatcaagaaatcaggagagctggggaagatgtttgatctccatgttgagaagtcaagaaaatctggtcctctaggaaatgctcctttcaggaaatactcatttgggagtgctgctttccactctgggaccgtatccaatgctgggcgtcgggtcaatttactctggttctctttcatcttcagtttcctggtggctggccggatccggccggaaccaaaatccaacctctgggaccgcctcaaattagccttggaaaagcccaccaagaaggccactttggggccccccgttcgggaagggaggggacccccccaag

SEQ ID NO: 81628 - protein, 146 aa, Zea mays
  misc_feature: Ceres CLONE 1567167
MGSRFASHQLSNGLYVSGRPEQPKEKAPTICSTAMPYTGGDIKKSGELGKMFDLHVEKSRKSGPLGNAPFRKYSFGSAAFHSGTVSNAGRRVNLLWFSFIFSFLVAGRIRPEPKSNLWDRLKLALEKPTKKATLGPPVREGRGPPQ

SEQ ID NO: 81629 - DNA, 841 bp, Zea mays
  misc_feature: Ceres CLONE 1567176
  misc_feature: Encodes the peptide sequence at SEQ ID NO. 81630
  misc_feature (661)..(661): n is a, c, t, g, unknown, or other
  misc_feature (662)..(662): n is a, c, t, g, unknown, or other
  misc_feature (718)..(718): n is a, c, t, g, unknown, or other
ggagctccccgcggtggcggccgctctagaactagtggatcccccgggctgcaggaattcgtctcacccctagaaaaaaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcanngaagaagtttgacgatgaaatccgtaacgataactggggatattgaaagagatggnagagaactcttatgatgccattttccatgtcccgtgagaaccaaatatttttcctgtgccctggaaatggggtgttttccatagcattgtgcaccggggttttggggtgggaatgccttacaa

SEQ ID NO: 81630 - protein, 159 aa, Zea mays
  misc_feature: Ceres CLONE 1567176
  misc_feature (12)..(159): Pfam Name: Mt_ATP-synt_D Pfam Description: ATP synthase D chain, mitochondrial (ATP5H)
  misc_feature (156)..(156): Xaa is any aa, unknown, or other
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFEKYPELXEEV

SEQ ID NO: 81631 - DNA, 785 bp, Zea mays
  misc_feature: Ceres CLONE 1567181
  misc_feature: Encodes the peptide sequence at SEQ ID NO. 81632
tggagctccccgcggtggcggccgctctagaactagtggatcccccgggctgcaggaattcgtctcacccctagaaaaataaaacactagctgcttcagatcagaacttactctgctatctccttatttgtatgacgccggggttaacacctctcttgtgcatcatcatcttcgcaggttcactttgatattccaacaaaggtcacattgctagactcccagattggttcctaacaatgagggcacatgaacgagctgccagtttggctcttgcctgtacgttgattgtgcagttcagccatcactgcctttatagtgttccttaccttcttattttccctttgatataacaagcctgtgccgacctcagcagcatatgtattttacaaatatgcaggtctgagcttggctccacttctggttaacgtaaacccaaatgtgaatgtggtattatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagc

SEQ ID NO: 81632 - protein, 89 aa, Zea mays
  misc_feature: Ceres CLONE 1567181
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLG

SEQ ID NO: 81633 - DNA, 822 bp, Zea mays
  misc_feature: Ceres CLONE 1567182
  misc_feature: Encodes the peptide sequence at SEQ ID NO. 81634
  misc_feature (678)..(678): n is a, c, t, g, unknown, or other
ctccccgcggtggcggccgctctagaactagtggatcccccgggctgcaggaattcgtctcacccctagaaaaaagggcaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatctcgtggactcaccgccagacagcttcccggacgccgtggaggacgacagcgatgacgacgttgaggacatcgaggagctggagcgccgcatgtggcgcgaccgcatgaagctgaagcggctcagggagctgcagcagagccgcngcaaagatcccatggctagcggggggggggctggccgacggctcatccaagccaggcagtcgcaggagcagggctcggcgcagaagatgtcgcgcgcgcaggacggcatccttcagtacatgctcaagatgatggaggtgtgcc

SEQ ID NO: 81634 - protein, 149 aa, Zea mays
  misc_feature: Ceres CLONE 1567182
  misc_feature (102)..(102): Xaa is any aa, unknown, or other
MMGGGLMMDQSVVFPGVHNFVDLLQQNGDKNLGFASLMPQTSSGDQCVMGEGDLVDSPPDSFPDAVEDDSDDDVEDIEELERRMWRDRMKLKRLRELQQSRXKDPMASGGGAGRRLIQARQSQEQGSAQKMSRAQDGILQYMLKMMEVC

SEQ ID NO: 81635 - DNA, 837 bp, Zea mays
  misc_feature: Ceres CLONE 1567185
  misc_feature: Encodes the peptide sequence at SEQ ID NO. 81636
  misc_feature (718)..(718): n is a, c, t, g, unknown, or other
  misc_feature (757)..(757): n is a, c, t, g, unknown, or other
  misc_feature (801)..(801): n is a, c, t, g, unknown, or other
  misc_feature (802)..(802): n is a, c, t, g, unknown, or other
ggagctccccgcggtggcggccgctctagaactagtggatcccccgggctgcaggaattcgtctcacccctagaaaaaagctcacagctcacgcacccatccacctccaaagtccaaaagcggaacccacgcctgccgcaacggcgaaaccgtcggaaccctagatctctctcgcccgcgctccgaaaccccagatccgccatgcaccagcctagagctcgctacccacccggctatggctccggcggtggaggcggagccggacgtggcggtggaggcggaaatggaggaggtggcggcggcggtggcggaaaccacaactactacggccgaaacccgcagcaacaccactaccaccagcagcagcagcagcagcagtcgcagcactctcataggaactcttcgtaccagcaacagtggctgcggcgagaccaggcccccgccgttgcgggggcagcgtccggaaacgctgtggccaagacggcgtctcagcttgacgccgtaggctcgagctcccaagactggaaggctcaactaaatataccagctccagatacacgctacaggacagaggatgtcactgcaacaaaaggcaatgagtttgatgattatttcttgcaacgtgaactgcttatgggaatctacgagaagggatttgaaagaccatctcctattcaagaagaaagcattcctattgcgctgactggaagtgatattncttgcagggcaaaaaaatgcactggaaagactgctgccnttttgcattccggcacttgaaaaaattgatcctgaaaaaaagcnntatcagttgtatactagtaccaacaggggactgga

SEQ ID NO: 81636 - protein, 191 aa, Zea mays
  misc_feature: Ceres CLONE 1567185
  misc_feature (173)..(173): Xaa is any aa, unknown, or other
  misc_feature (186)..(186): Xaa is any aa, unknown, or other
MHQPRARYPPGYGSGGGGGAGRGGGGGNGGGGGGGGGNHNYYGRNPQQHHYHQQQQQQQSQHSHRNSSYQQQWLRRDQAPAVAGAASGNAVAKTASQLDAVGSSSQDWKAQLNIPAPDTRYRTEDVTATKGNEFDDYFLQRELLMGIYEKGFERPSPIQEESIPIALTGSDIXCRAKKCTGKTAAXLHSGT

SEQ ID NO: 81637 - DNA, 837 bp, Zea mays
  misc_feature: Ceres CLONE 1567186
  misc_feature: Encodes the peptide sequence at SEQ ID NO. 81638
ctccccgcggtggcggccgctctagaactagtggatcccccgggctgcaggaattcgtctcacccctagaaaaagaggaaacgagagagagaaaaacagcccgatctcctcctcccactccgatcgccctaccgatcgccgcctcgtgaagcttccctgttccctccccgccgcccgcgacgccatggagccgccgcacaccgaggaggccgccgctgctgcagcaggaggagcagagggcggcagcgcaagcccgggcaccggcctcgaagggccgatgctgaggctggggctggacggcggcggggagggggaggacggggagctgggggctggggaggaggcggacacgtggcttccagagcggcctggcgaggccgactgtggctactacctccgcacgggcgcctgcggcttcggggagcgctgccgctacaaccacccccgcgatcgtggcggcactgagtttggtggaggtgccaagaatggagcagcacaatactttccagaacgacaagggcaacctgtatgcgagtattatttgaagactgggacttgtaaatttggttccaattgcaaatatcaccatcctaagcaagatggatctgtgcagtctgttatattaaacaacaatggattccctctacgtccgggtgagaaagaatgctcctactatatgaaggactgggccaatgccaagttgggttctacaatgtaaattttcatcatcccagaatttgggtggtatttccggtaacccccttggcaatatatcccggcaatttacaatcaggcattctggtgcccttccccccccttaacataagggctttaaaa

SEQ ID NO: 81638 - protein, 177 aa, Zea mays
  misc_feature: Ceres CLONE 1567186
  misc_feature (111)..(137): Pfam Name: zf-CCCH Pfam Description: Zinc finger C-x8-C-x5-C-x3-H type (and similar)
  misc_feature (62)..(88): Pfam Name: zf-CCCH Pfam Description: Zinc finger C-x8-C-x5-C-x3-H type (and similar)
MEPPHTEEAAAAAAGGAEGGSASPGTGLEGPMLRLGLDGGGEGEDGELGAGEEADTWLPERPGEADCGYYLRTGACGFGERCRYNHPRDRGGTEFGGGAKNGAAQYFPERQGQPVCEYYLKTGTCKFGSNCKYHHPKQDGSVQSVILNNNGFPLRPGEKECSYYMKDWANAKLGSTM

SEQ ID NO: 81639 - DNA, 862 bp, Zea mays
  misc_feature: Ceres CLONE 1567188
  misc_feature: Translation starting site: 103
  misc_feature: SWISSPROT Homolog: EC 2.7.11.1 Non-specific serine/threonine protein kinase
ggagctccccgcggtggcggccgctctagaactagtggatcccccgggctgcaggaattcgtctcacccctagaaaaaaattcgagttgtccgcttccagtcatgtcgccgccgctgaaacctaaatttaaaaataagttcgtcgggggtccggccgatttccgccaaattttgttgctgttactgatacaaggcacgcggtgaccaccatgggcaactgctgcgccacgccgtcgatcgactgaggagagcggcaaaagccgtcagaagaagccgaagcaaaaggcaaacccctacaacgtggcgtataaccgcggggcggatccggctgcggcgcgcccgggcctggtggtgctgcgggacccgacggggacgggacctccgcgcgcattacaagctgggcggcgagctgggccgcggcgagttcggcgtcacgtacctgtgcacggagtccgccacgggggcgcgctacgcgtgcaagtccatctccaagcgcaagctgcgcacgcccgtggacgtggaggacgtgcgctgggaggtggacatcatgcgctacatgtctccgcagcctaacatcgtcagcctccgtgccgtctaccaggacgaggacgtcgtgcacctcgtcatggagctctgtaaggggaggtcagctcttcgacaggatcgttcgccgggggcactaaaagcgatcgtggcgcctcccgcggttacgcgcaacaataatttgagttcggccaaaatgtgcccaaagggcatgggcgtcactggcaaccggggattcttaaaccccaaaggaactttttttaaattgccaaaccaaggaagggaagaagttcctctcttttggaaaaatcaaatcgga

SEQ ID NO: 81640 - DNA, 813 bp, Zea mays
  misc_feature: Ceres CLONE 1567190
  misc_feature: Encodes the peptide sequence at SEQ ID NO. 81641
ggagctcaccgcggtggcggccgctctagaatagtggatcccccgggctgcaggaattcgtctcacccctagaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccactgggtgttgcgtctcaggggcggcatgcagatatttgtgaagactctgactggcaagactatcacccctgaagtcgagtcttctgataccatcgacaatgtcaagggccagattcaggacaagaagggcatccctccggaacagcagcggctcaatttttgcccgcaagcaactcgagggacgggcgccccctggccgaactaccacattcggaaaggagaaccccca

SEQ ID NO: 81641 - protein, 220 aa, Zea mays
  misc_feature: Ceres CLONE 1567190
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHWVLRLRGGMQIFVKTLTGKTITPEVESSDTIDNVKGQIQDKKGIPPEQQRLNFCPQATRGTGAPWPNYHIRKGEPP

SEQ ID NO: 81642 - DNA, 831 bp, Zea mays
  misc_feature: Ceres CLONE 1567191
  misc_feature: Encodes the peptide sequence at SEQ ID NO. 81643
agctcaccgcggtggcggccgctctagaactagtggatcccccgggctgcaggaattcgtctcacccctagaaaaacctcctcatcaaatcccgtctcctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcggcagatttgtcaagacgctgtatttcttcaacgggcctccaaaccttctcaagattgtagaatctatcatcagcagtttcactggacctgcttctagtgaagcgccaaagaaaatggaaacatcagatgtggtgctggttactggagccaccggtggtgttgggcgacgggtggtggacgtcctgcagaagaaaggagtacctgttcgagtattggctagaaaatgtagacaaggcaaggagcatgttggggccggatgtacctctgatcataggagatgttacaaggaagatacacttgatcctaagctattcaaggggataaaaaaagtagtcaatgcagtctctgtcatagtggggccaaagggaaggtgatacaccagacaggcagaagtccaaacaaggcattcaatttttcgaccctgaaatcaagggaccttccccggaa

SEQ ID NO: 81643 - protein, 198 aa, Zea mays
  misc_feature: Ceres CLONE 1567191
MNCSSCCAAATPSSPALLARPRGGLAASCSTTTANQKVLFLGSKQFPRITYSRASSRLSRREVIAFAGQQPWDIGRFVKTLYFFNGPPNLLKIVESIISSFTGPASSEAPKKMETSDVVLVTGATGGVGRRVVDVLQKKGVPVRVLARKCRQGKEHVGAGCTSDHRRCYKEDTLDPKLFKGIKKVVNAVSVIVGPKGR

SEQ ID NO: 81644 - DNA, 824 bp, Zea mays
  misc_feature: Ceres CLONE 1567192
  misc_feature: Encodes the peptide sequence at SEQ ID NO. 81645
ctccccgcggtggcggccgctctagaactagtggatcccccgggctgcaggaattcgtctcacccctagaaaaacacccaacattgaatttgaagttctgtttcctctttgttcagacgacactctccaaatgaatgccttatattttgtgttgctcctcttttctgcagagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagagtcgcctagccgggagcacataaaaatggccgtgtgggtactcaccacgatgctcactgctgcgttctcatacaaggtggcagcaattatgccactcccggtgcaggtgctggtgtgggcaatggcaggagcaactgtgttcggtggtttttatgctttcttcatccaccaggaaaaaaccgcccagctgggacccccaaaaccataacgaggtacaaatctcatctgtgccttgctcttagttcccaaatggaattaactatgcatgatttgtttggaaactcttatttgcatccatccagataatgcatccaccataaggtaatatcttggataacatctggtgcctgatggggatccaaaatgtctt

SEQ ID NO: 81645 - protein, 153 aa, Zea mays
  misc_feature: Ceres CLONE 1567192
MASKQQQKQFLDEAMIKQPTPEEDREGAWPSVLTIIGFGFLTFNSFMAVYRSNGDVGSISFVVFSYLVLVLLFYCLRRFETTPPESPSREHIKMAVWVLTTMLTAAFSYKVAAIMPLPVQVLVWAMAGATVFGGFYAFFIHQEKTAQLGPPKP

SEQ ID NO: 81646 - DNA, 831 bp, Zea mays
  misc_feature: Ceres CLONE 1567194
  misc_feature: Encodes the peptide sequence at SEQ ID NO. 81647
  misc_feature (613)..(613): n is a, c, t, g, unknown, or other
ggagctccccgcggtggcggccgctctagaactagtggatcccccgggctgcaggaattcgtctcacccctagaaaaaaccaccgcagccgcagcacaatcgcctcgccttcccttccccaccagcccccgtctctctctctctctttctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggctcctccgccttcgtcggcaagttcggcgacgacgagttcgggcacatgctggtgaacatcctgaagcagaacaacgtgaactcggaggggtgcctgttcgacaagcacgcgcggacggcgctggccttcgtgacgctcaagcacgacggggagcgcgagttcatgttctacaggaactcgagcgcggacatgctgctgacggagggcggagctggacctgggnctggtgccgcgcgcccagggtgtccactacgggttcattctggtcaatctcgagccgtgccgctcggggcacatggccgccatgcgcgcagcccaaggcggcgggggtgttctgctcttacgaccccaaggggggccttccggtttgggcgttccccgaagcccgcaggcgaagggattcttcggaatttggggggggggccgacttcttcaagggct

SEQ ID NO: 81647 - protein, 211 aa, Zea mays
  misc_feature: Ceres CLONE 1567194
  misc_feature: SWISSPROT Homolog: EC 2.7.1.4 Fructokinase
  misc_feature (139)..(139): Xaa is any aa, unknown, or other
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNSSADMLLTEGGAGPGXGAARPGCPLRVHSGQSRAVPLGAHGRHARSPRRRGCSALTTPRGAFRFGRSPKPAGEGILRNLGGGPTSSRA

SEQ ID NO: 81648 - DNA, 834 bp, Zea mays
  misc_feature: Ceres CLONE 1567196
  misc_feature: Encodes the peptide sequence at SEQ ID NO. 81649
  misc_feature (576)..(576): n is a, c, t, g, unknown, or other
  misc_feature (618)..(618): n is a, c, t, g, unknown, or other
ctccccgcggtggcggccgctctagaactagtggatcccccgggctgcaggaattcgtctcacccctagaaaaaagcgaggcctcttcgttcacctctgtctcgctttcctttcccgttcaccccaagcccccaacctgcgagctgcgacaagttcgtctctctcgtggccacgactggccgccgcccccgcctccgtcccctcgcagattcccaggtcttcgccgctcccttcgccgccaaagagcacccactaggttaaatccgccagggggaaatctccatcaagtggctcgtgctaattatgcgatcttcatgggctgactcagttgcgaacgccgaggaatcggcgcccgcgactgctgctgctaatggctctgttgcaactcatagcacctcgcgccctacgcgcagctcctacgtgcctccacatcttcgtggccgctcagctggtgctgctgttgaagctcaagcaggcttagtagcaccagcacaaggtggacccactgcattggctgctgcacacctttctggtcagggtgctgctgttggtggccctcgctgggctggcattgtnaaatgtgttgggtggttggtggcagccatgggtgctcctcgnccagggccattgtggccgaagcgggggcccttggtgcttggaacttccgtcctgggtggttggaaccggcaaagaccgggaacccagattccgtttgccaaaagcccggggctgaaagaaaattgatttcgaacggccaggaagaaaaacgtggccatcaatttttgaaggcccatgaagaaaattcccctgtgtgagaaccaggtgggcaattaa

SEQ ID NO: 81649 - protein, 146 aa, Zea mays
  misc_feature: Ceres CLONE 1567196
MRSSWADSVANAEESAPATAAANGSVATHSTSRPTRSSYVPPHLRGRSAGAAVEAQAGLVAPAQGGPTALAAAHLSGQGAAVGGPRWAGIVKCVGWLVAAMGAPRPGPLWPKRGPLVLGTSVLGGWNRQRPGTQIPFAKSPGLKEN

SEQ ID NO: 81650 - DNA, 786 bp, Zea mays
  misc_feature: Ceres CLONE 1567199
  misc_feature: Translation starting site: 176
  misc_feature (636)..(636): n is a, c, t, g, unknown, or other
  misc_feature (657)..(657): n is a, c, t, g, unknown, or other
  misc_feature (711)..(711): n is a, c, t, g, unknown, or other
  misc_feature (737)..(737): n is a, c, t, g, unknown, or other
ctccccgcggtggcggccgctctagaactagtggatcccccgggctgcaggaattcgtctcacccctagaaaaaaggtctcgctgttcccttcacgatacgcccccccaaagcggatcaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgatctctttgacttcgattatattccccgatctgaccgcttcaccgccgactccttcgatgacctctcccctaccataggtgttgacttcaaggtgaagatggttagcattggtggcaaaaaaactcaagcttgccatctgggacacagctggacaagagaggtttaggaccttgaccagctcttactacagaggggcacaggggatcattatggtgtatgatgtcagtcgacgagagacgttcaccaatctttctgatatatgggccaaggaaattgacctgtattcaaccaaccaggaaaagatgcttngtgggaaataagtagacaggnaaagtgagagggctgtcacgaaaaaggagggaaatttgatttgcagggaatacngtttgtttgtttctagaatgcagtgncgaaacaaaagtaaacggtagaacagtggttttgaggaaactggttcta

SEQ ID NO: 81651 - DNA, 847 bp, Zea mays
  misc_feature: Ceres CLONE 1567200
tggagctccccgcggtggcggccgctctagaactagtggatcccccgggctgcaggaattcgtctcacccctagaaaaagtctccgcctagtcgctcgccatactacctcctcagacaccggcggcggccatgccgcctccgcgtccgacgcaccccccacttccctctcctctgccgcccgggccgcctcccctaagcgcccgtcgtctccctctcccgcccaaccgcccggcccccacgtctctcctcctcgcgccgccctcctccccagcccgtgccctcgcgcttctcttccccgactcctccgcccatctcttcccgtccctaccctccgtctcccccttcgccacctcttatcccgctcacacccccgtcccatcaccactcgccgccgccgcctccttcgcgctcctcctgccgtcgtcacacctcatcttcctatccgcgcatccgtccccttccaactcctctgtccacctccgcgcctattccctcgctcccgcgcccgctttcccgcgctttgcgcccgcctcgctctccttcaagcgcatgcctcagctgcagggctgccgctccaggacctacccttcgggcatgggcgtccgcctgggcgggcggggtcaacgcccgtctcgctgctctcactgtccacccggccagatctggggtgctcttctctaaagctggccgcggaccggccggacagtgggagctgcacaagccccgcgggtcgttcgagctcgagacgggcgccggccccttgtacccccaatggaaagtccccaatggggaaagcctgctttcttcccgggaagggttgggccggtttttcgcgcggtctttccg

SEQ ID NO: 81652 - DNA, 835 bp, Zea mays
  misc_feature: Ceres CLONE 1567201
  misc_feature: Encodes the peptide sequence at SEQ ID NO. 81653
  misc_feature (835)..(835): n is a, c, t, g, unknown, or other
ggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtgggggacaaagtcggctcctgtcacgcgacctgctgctgctgccggcgacggcgaggatcctggggtcgcggcatggcgagcgagagatctcgacgaggccatctcgtcgctgttcctgttccccactggcaacgctaccgaagagagcttgagacgggggcgtcgccgcctgccacatgatggtggcgagcgcgggcgactttn

SEQ ID NO: 81653 - protein, 220 aa, Zea mays
  misc_feature: Ceres CLONE 1567201
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTKSAPVTRPAAAAGDGEDPGVAAWRARDLDEAISSLFLFPTGNATEESLRRGRRRLPHDGGERGRL

SEQ ID NO: 81654 - DNA, 1221 bp, Zea mays
  misc_feature: Ceres CLONE 1567202
  misc_feature: Encodes the peptide sequence at SEQ ID NO. 81655
  misc_feature (57)..(57): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
gggggggtgcggggtgggggtcaacatagcagctacacgttggaaaggccggcggcntgnttaannnnnnnnnccaaagctggagctccccgcggtggcggccgctctagaactagtggatcccccgggctgcaggaattcgtctcacccctagaaaaaaagcgccagagcagagagggagagatagaacacacaagggcgagaggggtgggagaagggaaggcgaagggaggcgcactcgtcccgtctggtgctctggtatcgtctccccccggcagggaaggagtagaaggaaggagagtacctaggaggaggaggggagaatgcgtgtcggcggcgggcgggacaacgacgacgaggtgtcccggaagcacatgagcatggacgtggacaagctggagaacggcggcggggaggagaacccgtggcccgacgtccagtaccaccggtggaaggccctgccgttcatcctccgcaacgagtagctccccaagctggcgacgctaggcacgtcggccaaacctgctggtgtgaccggacggcgggtgttccaactgccagaagtggtgacccctgcgaaccctacttcaaaagggctttagctaccaccccccaggcggtctcccccccttttcatgtgggcggcctttccgtaatgcagagcgaccattaacaatcggggggaccctatccataataccgccctccgggccaatgggggaatgcctttgatgcagccactattttatgttcatttaaggaaaaggtgtgggtcgcccctggcggtgggaacgcggtatttaaaacggtgtggcgcgacgggtaaagaactggaataaaataaaacgctgtgtggtataaacgacgccttctctaagaataaatagtggaacaataaccccagtgagcacacgcacaactaaaacttctgcgacgtgaaatgtaagagggtcgaatcgttccgtctgtaacacaatacaaatttaatagatgggggtgtgggctctcgttatttagcggggggcctattattatttagaacatagcaggtgtggagtgctcatcgggggaactattactggtggtgcggttaattactatgcgcgctgtaaagagaggagcagagtttgcgcatgtggaagggatgaccccggacacgagagaactttctcaagggtcgcgtagtccctagttggatgattctataatgacactagcttc

SEQ ID NO: 81655 - protein, 53 aa, Zea mays
  misc_feature: Ceres CLONE 1567202
MRVGGGRDNDDEVSRKHMSMDVDKLENGGGEENPWPDVQYHRWKALPFILRNE

SEQ ID NO: 81656 - DNA, 823 bp, Zea mays
  misc_feature: Ceres CLONE 1567204
  misc_feature: Encodes the peptide sequence at SEQ ID NO. 81657
ggagctccccgcggtggcggccgctctagaactagtggatcccccgggctgcaggaattcgtctcacccctagaaaaaaacgtaccactagaatgcagccatgatcgtctcctccttcctcccgctccgctcctccgtcttcgtcctcccctccagcgccgcctcccgctcccgtcccgccaccgccaccctccttccctttccaaggatcaccctcagccggcgccgccgcttggccgccgccgcgactgagagcagcagcagcagcagcgaagaaggagaaggagaagcggcgggcgggagtacgaacgggtccctcccgggcctgccccctgtggaggaggaggaggagctgtgccccgtggactgcgtgacggagttcaagacggacgaggagttccagcgccacctgaaccggtccagggccacgggcgctctggtggtggtggacttctaccggccctcctgcggcagctgcaagtacatcgagaaggccttcacgcgcctctgcaaggggtccggcgacgacggcgctcccgtcgtattcctcaagcacaacgtgatcgacgagtacgacgagcagtcggaggtggcggaacggctgcgcatcaagatcgtgccgctcttccatttctacgtggacgggggtgctggtggagtcgttcccaacgagggacaaggagaggatcattgccgtcatccggaagtacacctcggtcgagccagaactagaacctgaggaagaacagccagagtgattccatttccactccagtggtggacatcagttttcttcgagggtgcagataagcctgctgaatct

SEQ ID NO: 81657 - protein, 212 aa, Zea mays
  misc_feature: Ceres CLONE 1567204
  misc_feature (91)..(200): Pfam Name: Thioredoxin Pfam Description: Thioredoxin
MIVSSFLPLRSSVFVLPSSAASRSRPATATLLPFPRITLSRRRRLAAAATESSSSSSEEGEGEAAGGSTNGSLPGLPPVEEEEELCPVDCVTEFKTDEEFQRHLNRSRATGALVVVDFYRPSCGSCKYIEKAFTRLCKGSGDDGAPVVFLKHNVIDEYDEQSEVAERLRIKIVPLFHFYVDGGAGGVVPNEGQGEDHCRHPEVHLGRARTRT

SEQ ID NO: 81658 - DNA, 836 bp, Zea mays
  misc_feature: Ceres CLONE 1567207
  misc_feature: Encodes the peptide sequence at SEQ ID NO. 81659
  misc_feature (687)..(687): n is a, c, t, g, unknown, or other
  misc_feature (694)..(694): n is a, c, t, g, unknown, or other
  misc_feature (725)..(725): n is a, c, t, g, unknown, or other
  misc_feature (832)..(832): n is a, c, t, g, unknown, or other
tccccgcggtggcggccgctctagaactagtggatcccccgggctgcaggaattcgtctcacccctagaaaaaacggcgcccccgctcgcacgctccttcccactcagcagcagcacgcgctctgctccccacgccagcacgcccgagccccgaatcgagtcccctaccccatcgatccccgccgcccgcctttccccgccgcccgcctttcccctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgcagccgctggagtggcggtttgcgcaggtcttcggcgagcgcgccgcgggagaagatgtgcaagatgtggacataatatctgcaattgagtttgacaaatctgggaatcatcttgctactggagatagaggtggacgtgtggttttgttcgaaaaacagacattgctgataatgcttgtcgaggagaacttgagaggcaagaatatcttgtttctaggcatcctgagttccgttacaagaccgaatttcagagtcatgaacctgagtttgactacctaaaaagtttgggaatagaagagaagattancaggatncagtggtggcaaaacaaccaacaatgcactnctttctcttgtctacaaatgacaaaaacatccaggtattggaaagggtcaagagaaaaaggtgaacacgcggtttcagggatggaatttggaccacttccaaaagtncaga

SEQ ID NO: 81659 - protein, 115 aa, Zea mays
  misc_feature: Ceres CLONE 1567207
MEREPKSPDDRPEPAAAAAQPQPQPLEWRFAQVFGERAAGEDVQDVDIISAIEFDKSGNHLATGDRGGRVVLFEKQTLLIMLVEENLRGKNILFLGILSSVTRPNFRVMNLSLTT

SEQ ID NO: 81660 - DNA, 830 bp, Zea mays
  misc_feature: Ceres CLONE 1567209
  misc_feature: Encodes the peptide sequence at SEQ ID NO. 81661
ctccccgcggtggcggccgctctagaactagtggatcccccgggctgcaggaattcgtctcacccctagaaaaagcagcagcgccatgaacgccgtcgaaccctccgccgccgccatcgccgaagaccccattactccggccgcctccgcagccccgtaccctggccgcctccgcgaagcacttaccgccctttccgaggcttgcgagtccggcaacttcaatgcttccgaaaccgcctccttcaccatctccgacattcttgacaccgcagccggcgtaagtggcgagctcgatgacgggagcgacgacagccaagacgcgtcgaggtcaggggcctccgaagtgctgcttcgcgaggtgctcgagttcctctctcgcccgtcatcgatctcgaaccagatggcccttgacgcgctctcgcttgtgcttcccaaacccgtggcgaagctaggggctcgaatggggagatgccgggatgttgccgcagctatcctaaagttcttcgtgacgaattgcaatccgagggacatgctctccatcctctgtgaggcattagatgcaccaatggagctaccaaatggcttatccagttttgttcttctactcgatgcacttgctaaagtgtttacttttattcagaggcgacatatcgagcaagtaaaggtggcactgccccgttgtacttaaaagttatgcatgctactgtattcagatgtggttgaggaacatgggaagtgcctgctggttgatcttttcaatgccacccaatggtggttgggaaggccatttccaggaaatggtggcatatccaatgttcaaacaaaaaaca

SEQ ID NO: 81661 - protein, 200 aa, Zea mays
  misc_feature: Ceres CLONE 1567209
MNAVEPSAAAIAEDPITPAASAAPYPGRLREALTALSEACESGNFNASETASFTISDILDTAAGVSGELDDGSDDSQDASRSGASEVLLREVLEFLSRPSSISNQMALDALSLVLPKPVAKLGARMGRCRDVAAAILKFFVTNCNPRDMLSILCEALDAPMELPNGLSSFVLLLDALAKVFTFIQRRHIEQVKVALPRCT

SEQ ID NO: 81662 - DNA, 813 bp, Zea mays
  misc_feature: Ceres CLONE 1567210
  misc_feature: Encodes the peptide sequence at SEQ ID NO. 81663
  misc_feature (720)..(720): n is a, c, t, g, unknown, or other
acccgcggtggcggccgctctagaactagtggatcccccgggctgcaggaattcgtctcacccctagaaaaaatttcgagctcaagctcaatcacttcggattggcggcgggcacgcgccggacgaaatggaagcggcaccatccgcccgcgccttctccccgtcctcgtctccctccgcgggggctagacccagccttcccctcgcgggcctggcctcgcgctcgcggcgcgcccgggtgctcgcggcgccgcccccgccccgcgccgtcgcctcctcccgcgcgccgctggtggtctccagcccgccaccgccggaggactccggcacgcacaaccccgcgcacgccaaggtcgaccgctccggccgcttctgcagcccccgcgccgcacgggaactcgcgctgatgatttcctacgccgcgtgtctggagggaaccgatgtcgtccggctcttcgatcgcaggatcagcgcaagacgagaacccgggtttgttttcaacaaggcatgcctattgagttacaaccatatgagctttggcggggaaccgctcgaggttggaacggaggaggaggctgagaagctggccagtcagaacgataaggattcagccaacgatgtactttcaactcctccaaaacttgtttacaacaactatgtattacggctgtccagggaacttttagtggctgttgccagtggatgggataagcatgtggntatcatcgacaaaataattccccaggcttggaaggatgaaactgtggcaagggattctgagctctgcattctacatattgctatggctgagat

SEQ ID NO: 81663 - protein, 135 aa, Zea mays
  misc_feature: Ceres CLONE 1567210
  misc_feature (105)..(105): Xaa is any aa, unknown, or other
MISYAACLEGTDVVRLFDRRISARREPGFVFNKACLLSYNHMSFGGEPLEVGTEEEAEKLASQNDKDSANDVLSTPPKLVYNNYVLRLSRELLVAVASGWDKHVXIIDKIIPQAWKDETVARDSELCILHIAMAE

SEQ ID NO: 81664 - DNA, 2887 bp, Zea mays
  misc_feature: Ceres CLONE 1567212
  misc_feature: Encodes the peptide sequence at SEQ ID NO. 81665
agggcccgggaagagattgggtactgtagagagaccgggtagagatagagaggccaggatgagagtggcggtggtaggcgccggcgtgagcgggctggcggcggcgcacgagctggcgaggagcggcggctcccgggtgaccgtgtacgagaaggaggactacctcggtgggcacgccaggaccgtggccgtcgaggacgccgacgccgccagcaccgtgcagctcgacctcggcttcatggtcttcaaccgggtaacatacccaaacatgctggagtggtttgaagggctcggtgtagagatggagatatccgacatgtccttctcagtgagcacggaattgggggccagcggcagcagatgcgagtggggcagccgcaatggcatctcaggactcttggcacagaaaagcaatgcactcagccctagtttctggcgcatgattcgggagatactcaagttcaagaacgatgctctcaggtacttggaggaccatgaaaacaaccctgatatggaccggaatgagactctcgggcaattcattcggtctcatggatattcacagttcttccaagaggcttaccttaccccgatctgtgcgtgtatatggtcatgcccatcgcaaggagtgttgggattctctgctttctttgtgctctctttctgccgtaaccatcatcttcttcagttgttcggtcgcccccagtggctcaccgtgaagggtcgttcgcactcctatgtacacaaggtaagggaggagttggaaagtatgggttgccaaattaaaaccagctgtgaaatcaaatctgtttcaagttctgagggaggtttcagggttacagtgtttgatggttcagaggagacgtatgacagaatcatatttggtgtccatgcacctgatgctctaaagattctaggagctgaagcaacacatgaagaattgaggatcctaggagcttttcagtacgtctacagtgatatatacctccactccgataaaagtttgatgccacggagtttgtctgcttggagttcctggaacttcctggggacgacaagcaagggggtttgtgtaacctactggctaaatctgcttcagaacatagaatctacaagcagaccttttctggtgacgctgaatcctcctcatgtcccagaccacgtctttcttaaatggtacactagccaccctgtcccatctgtggctgccgcaaaggcttctcttgagcttcatcacattcaaggaaacagaggaatttggttttgtggggcataccaaggttatggtttccatgaagatggactcaaggctgggaaagctgcagctcaagatttgcttggtaaggagagtgaccttttggtgaacccaaaacagatgatcccatcgtggtctgaggctggggcgcgtcttctggtaacaagatttcttggtcaatatgtgtctgtcggcaacttggtcttgcttgaagaaggaggcactatgttcagttttggtgaagtaggcaaaaaatgccatgtgaaatctgtcctgcgagtacatgaccccatgttttactggaaggttgcaactgaagcagaccttggcttggcagatgcctacattaacggttatttctcatttgtagacaagagagaaggtcttctaaatcttttcctgattctcattgcgaacagggacgcaaacaagagtagtagcagcgctgctggtaaaaggggttggtggacacccctgctattgacagctggggttgcctccgctaaatacttcctgcgtcacatagcaaggaggaattctgtctcacaaacacgtcaaaacatctctcaacactatgatctgagtaatgaattcttctctcttttcctggatccatcgatgacttactcttgtgccatcttcaagacggaggatcaaagcttagaggcagcccagctacagaaagtttgcctcctaatcgataaggctaaagtggagcgagatcaccatgttcttgagattggctgtggttggggcagcttagcaatccaattggtgaagcaaactggttgcaaatacactgggatcacattatcagtggagcaattgaaatatgcacagagaaaggtgaaagaagctggattagaggaccacataagcttcatgttgtgtgattaccgtcaaataccaactcagcgcaaatacgacaggatcatctcttgcgagatgatcgaaggtgttgggcacgaatacatggacgatttcttcggctgctgcgagtcccttttggctcaagacggcatatttgtcctgcagttcatctcaatcccagaagaacggtatgaggaatacaggcgcagctcagacttcatcaaggaatacatcttccctgggggttgcctgccttcgttagcccggatcacgtctgccatgtctgcagcatcaaggctctgcatcgagcaccttgagaatattgggtaccattactacccaacgctgatacagtggagggacaacttcatggccaataaggatgcaattttggccctgggcttcgatgagaaattcatccgtatatgggaatactacttcatatactgcgccgctggtttcaagtcacggacacttgggaactaccagattgtgttttctcgccctggcaacgacaaattaggtgacagcggtatacactccttaagcaagctttctggcagctaataatgcgaggatctatatatatgtggtggtagctggatcagtcggagcctacacacctgaacttgagcctttttatttgtgatcgaattggacacgcagtgctgtgtacacgtcgctaactaactgtacttgcagcggcggatcattccattgcttcgatccaatttgacgtttcatcaaaaaaaaaaaaaaaaa

SEQ ID NO: 81665 - protein, 877 aa, Zea mays
  misc_feature: Ceres CLONE 1567212
  misc_feature (578)..(857): Pfam Name: CMAS Pfam Description: Cyclopropane-fatty-acyl-phospholipid synthase
  misc_feature (644)..(741): Pfam Name: Methyltransf_12 Pfam Description: Methyltransferase domain
  misc_feature (10)..(427): Pfam Name: Amino_oxidase Pfam Description: Flavin containing amine oxidoreductase
  misc_feature: SWISSPROT Homolog: EC 2.1.1.79 Cyclopropane-fatty-acyl-phospholipid synthase
MRVAVVGAGVSGLAAAHELARSGGSRVTVYEKEDYLGGHARTVAVEDADAASTVQLDLGFMVFNRVTYPNMLEWFEGLGVEMEISDMSFSVSTELGASGSRCEWGSRNGISGLLAQKSNALSPSFWRMIREILKFKNDALRYLEDHENNPDMDRNETLGQFIRSHGYSQFFQEAYLTPICACIWSCPSQGVLGFSAFFVLSFCRNHHLLQLFGRPQWLTVKGRSHSYVHKVREELESMGCQIKTSCEIKSVSSSEGGFRVTVFDGSEETYDRIIFGVHAPDALKILGAEATHEELRILGAFQYVYSDIYLHSDKSLMPRSLSAWSSWNFLGTTSKGVCVTYWLNLLQNIESTSRPFLVTLNPPHVPDHVFLKWYTSHPVPSVAAAKASLELHHIQGNRGIWFCGAYQGYGFHEDGLKAGKAAAQDLLGKESDLLVNPKQMIPSWSEAGARLLVTRFLGQYVSVGNLVLLEEGGTMFSFGEVGKKCHVKSVLRVHDPMFYWKVATEADLGLADAYINGYFSFVDKREGLLNLFLILIANRDANKSSSSAAGKRGWWTPLLLTAGVASAKYFLRHIARRNSVSQTRQNISQHYDLSNEFFSLFLDPSMTYSCAIFKTEDQSLEAAQLQKVCLLIDKAKVERDHHVLEIGCGWGSLAIQLVKQTGCKYTGITLSVEQLKYAQRKVKEAGLEDHISFMLCDYRQIPTQRKYDRIISCEMIEGVGHEYMDDFFGCCESLLAQDGIFVLQFISIPEERYEEYRRSSDFIKEYIFPGGCLPSLARITSAMSAASRLCIEHLENIGYHYYPTLIQWRDNFMANKDAILALGFDEKFIRIWEYYFIYCAAGFKSRTLGNYQIVFSRPGNDKLGDSGIHSLSKLSGS

SEQ ID NO: 81666 - DNA, 977 bp, Zea mays
  misc_feature: Ceres CLONE 1567213
  misc_feature: Encodes the peptide sequence at SEQ ID NO. 81667
  misc_feature (70)..(70): n is a, c, t, g, unknown, or other
  misc_feature (154)..(154): n is a, c, t, g, unknown, or other
  misc_feature (163)..(163): n is a, c, t, g, unknown, or other
  misc_feature (193)..(193): n is a, c, t, g, unknown, or other
  misc_feature (207)..(207): n is a, c, t, g, unknown, or other
  misc_feature (972)..(972): n is a, c, t, g, unknown, or other
tcacccgcggtggcggccgctctagaactagtggatcccccggggctgcaggaattctgtctcacccctnagaaaaaaaaaaaaaaaaaaaatcttgctccgggcacctatggagagggatcagtggccctgcgcctctgctgtcctgctcgcntctcgccgntcctcaccgcgcgtcgccgcagcgaccacnggacgaggtgcgcngcgcagtccacctacatcatccacctcgccccaggccacccggcgctgtccgcagcgcgcgacaacggcggcgacgaggcggccctccgccgcctcctcccgcgccgcctgcgcgcgccgaggccgcgcgtgctctactcctaccagcacgctgccaccggcatcggggggggggggggggcccaacaggcggcgcaacccctcggccggggaggggcgtcctggcccctgtaccccgaacaggcggcgggagggtgcacagccacccacaccgccggggtggcctcccgccaaagggaaggcggccagggtaccccccgtgttgcccacgggggggcggcaacgatatgaggggccgacgagcagggggggcagggaccaccggggctctccgcccccgcgggccgggggacccgggcagcgccggcggccgagggtggggctcggtgccctggcgtcccccgcaccgtattcgtcaggcgggcggcgggctatctctgcccggggcctccccgtccggccttttcgccgcccgcctagcaccatgtttgtcgccgcgccctgtgcgctggatgttcctgcccgcgtcggcgcggagtggagaacgcggcgcgcgtgcggccggcgcccctctcgtgtggcagtttgccggcgacccggcgagttgtgtcggaccggggtcaagcatagagcgggctcagtgtatatagtactagatccacctccctgtcgcacgcgtaagagcgccggattgacacgagcgcncatag

SEQ ID NO: 81667 - protein, 185 aa, Zea mays
  misc_feature: Ceres CLONE 1567213
  misc_feature (24)..(24): Xaa is any aa, unknown, or other
  misc_feature (52)..(52): Xaa is any aa, unknown, or other
  misc_feature (55)..(55): Xaa is any aa, unknown, or other
  misc_feature (65)..(65): Xaa is any aa, unknown, or other
SPAVAAALELVDPPGLQEFCLTPXKKKKKKNLAPGTYGEGSVALRLCCPARXSPXLTARRRSDHXTRCAAQSTYIIHLAPGHPALSAARDNGGDEAALRRLLPRRLRAPRPRVLYSYQHAATGIGGGGGAQQAAQPLGRGGASWPLYPEQAAGGCTATHTAGVASRQREGGQGTPRVAHGGAATI

SEQ ID NO: 81668 - DNA, 1160 bp, Zea mays
  misc_feature: Ceres CLONE 1567215
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (524)..(524): n is a, c, t, g, unknown, or other
  misc_feature (693)..(693): n is a, c, t, g, unknown, or other
  misc_feature (739)..(739): n is a, c, t, g, unknown, or other
ttttttgttcctcccccccccacccacgtgaacgagactcgcagccacgacaaangannntttttgtnnnncaaactgggactccccgcggtggcggccgctctagaatagtggatcccccgggctgcaggaattcgtctcacccctagaaaaatccttcgaccaaaacggcagctcctttctcccgcggcgttgccgtcgcactcgcacgcacgcactcaccgccggcctgagcctaatcctaatcctaatccacataccgggacaatccagacgaacgagcgaaccaacgcacggacggccaccagccgctgcgtgcgttcgctttcccccgaaacgtgacccgagccaagcttcagagagagaaaggagaagccgccatgaagcagcagcagctgcagctgcctcctagtcgtcccagttaaatccgtgctcgccaagccacgactacgagcacctgccccggtttttctcctcccgcccccgtttccccgtcccgaactccccgaccgaccccaccccantatccagagattcccttccctttggtgggcgcctggccgttccccgttgaaggcggcccccgccgcccgcgaaagggccggcccgttgaacccggaccccgtcccgggaaggctttccattggccgccccaagggagggcggggcgggggccttccaaaccccccccgntctcgttttttggaaatggggggccaaaaaccgccaaatggcccgngcgcgcgggcgcgcccccccctcttttataagaaattctcccacaaagggtgtccccccagatgcccacccagaggccctctttcctaaaagtccaacacacgcccccggcgggttttccgattctcccaaaagagggggcaccaagaggcccctttccccttctccgaaaagtatacaaaagggccgcctcagagccgcccgccggtgtggggcccagaaaaagaaaaactcctcccccccagagaaaaagaccccccccacacaggggggcgccccccccccccacccctccgggaaaagtgccctaaaagggtggccggctgcttccccggccaaaacaggtaaaacacagtggaccaggaggttcaaatataaaaagcccaccgcgaagggcgccccggcctccaccccctcaaata

SEQ ID NO: 81669 - DNA, 811 bp, Zea mays
  misc_feature: Ceres CLONE 1567216
  misc_feature: Encodes the peptide sequence at SEQ ID NO. 81670
ccccgcggtggcggccgctctagaactagtggatcccccgggctgcaggaattcgtctcacccctagaaaaagctacacgttcgcttgatctttacggccgccgctactcgttcgccatggctgcctgctcctccaggctcctatacctcactctgagctcctctttcctccgctcctgccgcctcgcgtccagctccctacttcccaccgcctcccgctgccacccggggtcgctccactccctccgcttctgctctgctgtccccgagtttgtcgatgtcgccgccgaccctgccgaggcggctgtatcctccggacacccgtggccggagtggggcaacttccttgataagctgcgggccaaggggtacttcaagcaaagtttgccctccagcgtgagttctggcgagggagccgccggagatggggatccagcaactgcatctgagaacgcagcaacggctgcttccggtaatacggtggtggatgcggaggatagcgcggtgacctcggaagatatctatcattctctcaaggacgagaacagggtgaagaatgcgtgcctcatatttgggcgagaccgcttcgatctcctcaggtggaagaaacattgcgactcttttcctctttccctctatagaggaatcaaattgctcggtcgcgtactttactatgcaatatttagcatacatgcatctcagatttcagtttttcggatgctgcacgaataatcatgcccactatttagtggagatgcagccgcaaattgctaactaggcctttatggtgtctcatgaaacacgaatctgg

SEQ ID NO: 81670 - protein, 204 aa, Zea mays
  misc_feature: Ceres CLONE 1567216
MAACSSRLLYLTLSSSFLRSCRLASSSLLPTASRCHPGSLHSLRFCSAVPEFVDVAADPAEAAVSSGHPWPEWGNFLDKLRAKGYFKQSLPSSVSSGEGAAGDGDPATASENAATAASGNTVVDAEDSAVTSEDIYHSLKDENRVKNACLIFGRDRFDLLRWKKHCDSFPLSLYRGIKLLGRVLYYAIFSIHASQISVFRMLHE

SEQ ID NO: 81671 - DNA, 1091 bp, Zea mays
  misc_feature: Ceres CLONE 1567218
  misc_feature: Encodes the peptide sequence at SEQ ID NO. 81672
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (50)..(50): n is a, c, t, g, unknown, or other
  misc_feature (53)..(53): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
nnnnnnnncccttctccctattttttggggcggtaaccaacccgcgggtntcntcannnnnggggaannnnnnaaaagctggaactccccgcggtggcggccgctctagaactagtggatcccccgggctgcaggaattcgtctcacccctagaaaaaagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccgcgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttggcacggaggagttccggcttgaaggaaaagcccagaatgacccagctcaagggcgggatgcccaagggcccgcgggttgaggttgattcaagccaccaaagaaggcaccccttgtggggaaccccaaaaccctggggcttttaaggggtaggaaaggggggggcctaccaccttccgaaggaacagggccccccctccccctaatgtcccccctttaactagaaaggagtgcggtctctcaaacccgaagtcctttaaaagggcgggcccgggtttctccccgcggcagaaggaaaaccttttatttgtgaaaccgctttccggcccgatttttcgaaaaccgagaggcggtgggaaaaaacctatttccccgaaaactctttttttaggaaaacattggggggaaggatccctcaccggccctccggaggagttcatggaaagataaccgggcggggcaagtgtgctgcgtgaggcgcaaaaacaaaaaacagagcttccgtgcccccaaatatggtctcccggagactacgccggaggcccggggacctttaaacccccgcgga

SEQ ID NO: 81672 - protein, 107 aa, Zea mays
  misc_feature: Ceres CLONE 1567218
  misc_feature (2)..(100): Pfam Name: Ribosomal_L21e Pfam Description: Ribosomal protein L21e
MPAGHGLRSRTRDLFARPFRKKGYIPLTAYLRTYKIGDYVDVKVNGAVHKGMPHKFYHGRTGSVWNVTKRAIGVEINKQVNGRIIRKRIHVRVEHVQPSRWHGGVPA

SEQ ID NO: 81673 - DNA, 1139 bp, Zea mays
  misc_feature: Ceres CLONE 1567220
  misc_feature (58)..(58): n is a, c, t, g, unknown, or other
  misc_feature (65)..(65): n is a, c, t, g, unknown, or other
  misc_feature (67)..(67): n is a, c, t, g, unknown, or other
  misc_feature (1096)..(1096): n is a, c, t, g, unknown, or other
aaaaaaaaaatggcccccctggccccagagcgcctctctccatttttaaaaacacaanaaaaaananacaaaactggactcccgcggggcggcgctctgaatagtggacccccgggctgcagattcgtctcacccctagaaaaatgatggttcggtggagcggatagaatggaatggaatagtatacatacacatggttgctgcctctgctctgggccatgcatcatgcatctggacaggacggctatcctggcttgcagttgccctatgcagttttgagtgcaatggtcaccatctgtgaagcacggataccacagagatcctggcccccaacccctcttttttccaaaatggaactgaagaaccttttggagtttctacccaaaagtgaacttaaaatctttgttcctttgactttcccctttttttgaaacgggaagggccccccttcgggctaagaatggaattgcgtggacccccccctttttccccttggaacctggacctgaaaactgtttcaatacaaaaaacttcttttcaaacagggcaaaaaaaatgcccccccccggggggggccctttctataaaaggggccttctcttttataaccccctcccccaaagagccccccttccaaaaaaaatttgtgtttttttttttttttaaaaaaaaatatttgtggggacaccacacccccccccttttaaaggggggaaaaaaatataaaggtgccccaccattttatttgttaggttacttgggtgttcccccccgcgcatttctaagggggtgtggttaaaacaccccactattgtagcgcccattctcttttctttctacacgacaaaaggtgggggagagagtgctctttgctcacccgggcgagccaagcaagttaacccccactgagtttttttcttcccaagccgactatttataataaattatcctcgctgctggttcttttttatagcgcaaaaaaaaaaaaaaaacaaactcgcgcgacaaaatttctacccggatggtgtcgtaaataacaattcttttctcgacaaagtaggcgcttctatactcccaaaacatctttgaacgagcncgccgggttctcctcctccgctatgatatcgtgagacgccgtg

SEQ ID NO: 81674 - DNA, 832 bp, Zea mays
  misc_feature: Ceres CLONE 1567221
agctccccgcggtggcggccgctctagaactagtggatcccccgggctgcaggaattcgtctcacccctagaaaaaattaaatgaactgcaccagcagcctcaccatttgcaaaggcagcatgatgcagctattgaacagctcattcaagcaaaatttggtcatgggcttcatagggagcaccataatgatatgttggatgttctctcgcgttcaaatcagagacagatgcttcctttagagcagcaacttcttttaggccttcaacacgagcagcaacttaagtctcaacaattggcaaatgctctgcggcaacattcaggccaggaagaagaaaggcacttaagtggggtctggccaatggatgctgctgcccagtttatccgctcaggaaccagtccaaatcagatacacagtcgtttcgatctccttgagaaccttcagagatcgtcatcgtttgatcatcatgaacatctagaccgcagcttatccttacacgaacagttgcatatggggaggtcaaggtattcgctccctagagcggactggttctttgcctggtgggggtcctggaccaaaccagatgtcataaatgccctaacacgtcatcatggacttagtcagttggaaacacatgggggatgtatacccttttaggtcaaatgcctatgctttccttcagggggtcattccccagcaacttaggcatcaggatccagcttcctggtttcccacctaagaaaggtttaaaagggactggtcggaagccaataggaaaatttaccaaaacagccttaagggaaatcttcccccctcaacccggttagaaattg

SEQ ID NO: 81675 - DNA, 798 bp, Zea mays
  misc_feature: Ceres CLONE 1567223
  misc_feature: Encodes the peptide sequence at SEQ ID NO. 81676
ggagctcaccgcggtggcggccgctctagaactagtggatcccccgggctgcaggaattcgtctcacccccccctagaaaaaagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccatccctggcaccaggcgcctctggtggaggggaaacccgcaccagaggcaggctgcgcggtcagcgatggcgggacggacgtcatcatcgtcggcgccggggtagctggatctgcgctggcatacacgctcagaaaggatggccgtcgggtgcatgtcatcgagagggatctgacagaacctgacagaattgtgggcgagctgttgcaacctggggggtacttgaaataaattgagctggggctccaagattgtgtcgaagaaattgatggccaacgcgtgcttggttacgcattattcaaagatggaaggaacacaaagcttgcttatcccccggaagaagttcattctggatgttgctggtaaggaactttcccaatggggaggtttaatacaaaggatggcgtaaaaaagcctgcgtccttggccccatggtcccaatttaagccaagggaactgtttcccc

SEQ ID NO: 81676 - protein, 112 aa, Zea mays
  misc_feature: Ceres CLONE 1567223
  misc_feature: SWISSPROT Homolog: EC 1.14.99.7 Squalene monooxygenase
MAATAAAAGVEFPLIGVAVATLIVTVLVAAVMRRRRHPWHQAPLVEGKPAPEAGCAVSDGGTDVIIVGAGVAGSALAYTLRKDGRRVHVIERDLTEPDRIVGELLQPGGYLK

SEQ ID NO: 81677 - DNA, 813 bp, Zea mays
  misc_feature: Ceres CLONE 1567224
  misc_feature: Encodes the peptide sequence at SEQ ID NO. 81678
ggagctccccgcggtggcggccgctctagaactagtggatcccccgggctgcaggaattcgtctcacccctagaaaatcgcgcacctgcctgcttgcctgcctacctacctgcgttgttgccttcttcgcctcctccccctgtggccgcaccgcagctgctgcggcggcggcagaggtgaacagcttcccgcggccttgtcctgtccggactccggggccgggaccggcagcgcagcgggctcgcgggatctcccgacccccatgcgtcggcctcggtgacagcgtcgcagcttttcaaaagtgctcctctttggggccttgggggtctgtaactctaactgctgggtggcctctcttttcttgcctccccgctttcttttccgtgggtttgctagcggagtccatccaactataatgaattaggcacccagtacgtaatggcaacggaagtcaaacaaacttatttttcatggtcacaaggagagtcaactgaacgggatggtcctcaaggagtatctgtatcccagacacttgatcatggttccatttccttcggaagatttgaattagagtcactatcatgggagaagtggtccgtatttactaatgacaggcgcaatgaagaatttggaaaattcaatggtttagtcgctcagaaaaaggcttatttttgaagagttttccaggaagatcgggggacttaagggtttcccggcagcaaaacccgcaaacttgaacctaattctggaatcccagggtggatggggagtggacttcacgcccaaaccgccaaaaaaagaagccgggttgca

SEQ ID NO: 81678 - protein, 78 aa, Zea mays
  misc_feature: Ceres CLONE 1567224
MATEVKQTYFSWSQGESTERDGPQGVSVSQTLDHGSISFGRFELESLSWEKWSVFTNDRRNEEFGKFNGLVAQKKAYF

SEQ ID NO: 81679 - DNA, 814 bp, Zea mays
  misc_feature: Ceres CLONE 1567225
  misc_feature: Encodes the peptide sequence at SEQ ID NO. 81680
  misc_feature (647)..(647): n is a, c, t, g, unknown, or other
tccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgaagatggtgtcccaccccaacatcgtggagctgcacgaggtgatggccacccgctccaagatctacctcgcgctcaagctcgtccgcggggggggagctcttctcccgcatcncgcgcgcggggcgggtcccggaaggacctggccccctttttacttccggcagctccgtcccccgcggtcgactttctgcccagggccgccggggggttcccccccaaacctggaaactccgaaaacctgtttccctcgacaagggggggggacccctccaagggggg

SEQ ID NO: 81680 - protein, 162 aa, Zea mays
  misc_feature: Ceres CLONE 1567225
  misc_feature: SWISSPROT Homolog: EC 2.7.11.1 Non-specific serine/threonine protein kinase
  misc_feature (107)..(107): Xaa is any aa, unknown, or other
MEDAMAADGKSVLQGRYELGRVLGHGNFGRVHAARDLRTGRSVAVKVVAKDKLERAGMAEQIKREIAVMKMVSHPNIVELHEVMATRSKIYLALKLVRGGGALLPHXARGAGPGRTWPPFYFRQLRPPRSTFCPGPPGGSPPNLETPKTCFPRQGGGTPPRG

SEQ ID NO: 81681 - DNA, 811 bp, Zea mays
  misc_feature: Ceres CLONE 1567228
  misc_feature: Encodes the peptide sequence at SEQ ID NO. 81682
  misc_feature (642)..(642): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaagtgtcatccactccgccgcacaggcgctcagctccgcaacgccgccggaaatggtcgccgccaccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctctgggaggagggtcccaacagcttccagccctccgaccccgttctcaccatggccgtggacagcggactgaaggatgacttggtttttggggacccaaacgcgccgcgtttcgtgctgtgggaggggaagctgaggcccgtgccatccaagcccgccgacctcccgttcttcgatctcatgagcatcccagggaagctcanggccggtctaggcgcgcttggcatccgcccgcctcctccagccgcgaagagtcagtggaagaagtcgtgcgccgcaacctcggtgctgaggtctttgagcgcctcattgagcctttctgctcaggtgtctatgctggtgatccntctagctcagcatgaagctgccatt

SEQ ID NO: 81682 - protein, 229 aa, Zea mays
  misc_feature: Ceres CLONE 1567228
  misc_feature: SWISSPROT Homolog: EC 1.3.3.4 Protoporphyrinogen oxidase
  misc_feature (173)..(173): Xaa is any aa, unknown, or other
  misc_feature (221)..(221): Xaa is any aa, unknown, or other
MVAATATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNSFQPSDPVLTMAVDSGLKDDLVFGDPNAPRFVLWEGKLRPVPSKPADLPFFDLMSIPGKLXAGLGALGIRPPPPAAKSQWKKSCAATSVLRSLSASLSLSAQVSMLVIXLAQHEAAI

SEQ ID NO: 81683 - DNA, 763 bp, Zea mays
  misc_feature: Ceres CLONE 1567229
  misc_feature: Encodes the peptide sequence at SEQ ID NO. 81684
ggagctcaccgcggtggcggccgctctagaactagtggatcccccgggctgcaggaattcgtctcacccctagaaaaagcgcaccaccaccacctactgtgtctcctctcctccctccccgtctccctccgctgcccctgcaccgcctgccgggaagagaccgcaccagccaccagcgcctccgcgagttcgacccccaatccccacagcttcccgcaccaacaaatccgcccaatttgcgggccactcccggcggaaattcgtgacaaagccgcggggggttttttttttcccttttttctttcgctcccccgcccccgttttcccttttgactccgccgccgggtctgctcctttattgctgcgcctgcctgattgtcttttctcgtcggaacgcgcggtatcccgagggcggcgatcgcggattcgcctccggaagcggcgatttggtccccagtacagtccgccatgattaagcaaatcctcggccggcttcccaagaagccgaccaaggccggcgagaaggagctggccggcgcgggcccgtcgctgcccagcccgacgttcgacgcaagaaccaccccccaatctgaccgcgttctagcagggcttgtcagcccccagaaaactacgccctccggggggaaacaaaatcccggggcccaaaaacttaccccccccccaggggcccccccggggtttcggggccccggggccccaaaaaaaggggtgtttccggggtgttccggggggccgggggaat

SEQ ID NO: 81684 - protein, 98 aa, Zea mays
  misc_feature: Ceres CLONE 1567229
MIKQILGRLPKKPTKAGEKELAGAGPSLPSPTFDARTTPQSDRVLAGLVSPQKTTPSGGKQNPGAQKLTPPPGAPPGFRGPGAPKKGVFPGCSGGPGE

SEQ ID NO: 81685 - DNA, 1014 bp, Zea mays
  misc_feature: Ceres CLONE 1567230
  misc_feature: Translation starting site: 184
tccccgcggtggcggccgctctagaactagtggatcccccgggctgcaggaattcgtctcacccctagaaaaagctttcccctcctcgcctcgggggtgcgcgaatttcgactagggtttcgcggaccgagagggaagcggggagaggagagggcgggtagggtttccgcgggcgggccccgcatggcctcggcggcagcggcggcggtggcgccggccgcggaggagaagaagggcgcgggcgggccggtcacgggggacatggtcagcgcgggcttcgcggagctggagcggctgcagcggctgctcgccgcctgcacgcgcctctgccagcaccttgttggaccacctccggctcgctcgggcggggggggtggccgcgcggctccccacgcggcttcgtggtgcgctggggggggagtttgggacggggtggcaccgtgcgggggcgggtgcaggattggttctgccgggcccggggggggcctgccggtcgggggggggtgccgggggtgcggggtggggccgtccggccgcccggtctggggtgcgagtggtccgcgcgcggggggggcggtgcgctctgttgccggggcgtggcgggaggtgtcgggggggcggcgggtccgctttgcggggggggctgggtggtgggggcgggcccgcggtgtgcgcgggcgtggtggcggcggggctgttctgctcgttgtgtgggctgggcgggggggtggcgagttcgtggcgcgcgcccggcgtgggccgcgttggggggttggtgtttgcgtgaggggagggggtgcggtgtgctcgtcggtcgggaggtaggggagctccctggggcgcgccgggcgtggtggttggtctcgggtgtagtggtgggcactcgtggggcgcggggggggtgcgatgagtgggtgtctgttgtcggggggcgcgcgttcggcgggagctgggtgcggagggatcttcgcccgcgcgtctgggtaggcgcggcgtgcggttgtgagcgcggcg

SEQ ID NO: 81686 - DNA, 832 bp, Zea mays
  misc_feature: Ceres CLONE 1567233
  misc_feature: Encodes the peptide sequence at SEQ ID NO. 81687
ggagctccccgcggtggcggccgctctagaactagtggatcccccgggctgcaggaattcgtctcacccctagaaaaactcacgcctcctgttcgaagctcgaactcttcgtcgcctcacactggtgctcctcctctccccatcgctccgtcgctcccatggcgtccctcttcggggctggccgccggcgatcaccggagtacgacggagaggacgatagatccggcagagggaggaccaagcgcttccgcctctccccggaggaggacgcagcgtcgccggcggaggcgggccccggcgcggcgacggagaccggctggctttccggcttcgtctacggagcgaagagggtcatttcttccgttttactgttctcctcgcccgaggagaccggctcaggggaggacgaggaagaggaggacgacgacgacgaagagggcatccacttgaatgaacatgaagctactcatgacactcatggagcaatagttccttatagcgagccaaagcttactattgagcaaatggttatgaaggaaacattctcaagggatgaatgtgataggatggtagagctaataaaatcaagagttagagattctacttttcctgaagcccatgagtatgtaaagccagaagaaatcccaagtaggaatgcaggcattacacatgacttcacaggaacatggcgctccttgagccgtgatcggaatgtccctgaatcagctccactctctagtatgagaacaagacctggtagtttttctcagggctctccactccaagcatcacctgagctatgcactgcagcagttacggaagcaaaaaatgg

SEQ ID NO: 81687 - protein, 224 aa, Zea mays
  misc_feature: Ceres CLONE 1567233
MASLFGAGRRRSPEYDGEDDRSGRGRTKRFRLSPEEDAASPAEAGPGAATETGWLSGFVYGAKRVISSVLLFSSPEETGSGEDEEEEDDDDEEGIHLNEHEATHDTHGAIVPYSEPKLTIEQMVMKETFSRDECDRMVELIKSRVRDSTFPEAHEYVKPEEIPSRNAGITHDFTGTWRSLSRDRNVPESAPLSSMRTRPGSFSQGSPLQASPELCTAAVTEAKN

SEQ ID NO: 81688 - DNA, 649 bp, Zea mays
  misc_feature: Ceres CLONE 1567235
  misc_feature: Encodes the peptide sequence at SEQ ID NO. 81689
  misc_feature (524)..(524): n is a, c, t, g, unknown, or other
ctcaccgcggtggcggccgctctagaactagtggatcccccgggctgcaggaattcgtctcacccctagaaaaaagggtttccggatctgctctgcgtcgccgccgaccaacctccgccgcgcgacgccatggacttcgacgagtacgagtatctggagaagacggtggaagcgtccgcagcgccggccaacggttcgtcgccgcccgggtcggggtacaaggacaaggagcgcagctcacgccgccgctcaacgggcggtgacgaagagcgcgacaacgtagaacgcagatcgaagcgttctcgccccgaggaaggctgcgaccgcgatagagagcggcacagggaccgcgacggcgaccggcaccgcagcagtcgggagcggcgggaccgtgaccgtgacgtcaaggagaaagagcagggcagggaagacgacaaggacaggagagcgcgaccgcgacgggagaagaggagagaggataggatagcagctcagagtcgagccgtccgacgccccctgatacnaaaaagtgatcgctccgtgaaccgatgtgcgactaggaaaaaggaattgcttaacccgaagttgatcccgaagagattcgaggactgtttttgccttcccagttaactttgaagggcaataaaaa

SEQ ID NO: 81689 - protein, 166 aa, Zea mays
  misc_feature: Ceres CLONE 1567235
  misc_feature (132)..(132): Xaa is any aa, unknown, or other
MDFDEYEYLEKTVEASAAPANGSSPPGSGYKDKERSSRRRSTGGDEERDNVERRSKRSRPEEGCDRDRERHRDRDGDRHRSSRERRDRDRDVKEKEQGREDDKDRRARPRREKRREDRIAAQSRAVRRPLIXKSDRSVNRCATRKKELLNPKLIPKRFEDCFCLPS

SEQ ID NO: 81690 - DNA, 810 bp, Zea mays
  misc_feature: Ceres CLONE 1567236
  misc_feature: Encodes the peptide sequence at SEQ ID NO. 81691
  misc_feature (716)..(716): n is a, c, t, g, unknown, or other
ggagctccccgcggtggcggccgctctagaactagtggatcccccgggctgcaggaattcgtctcacccctagaaaaacatttttttctgcacaattgtacatggaagcattagtcataggatatcggttgttgaagtacgtcgtcaagtgtacatggaagcattagtgcattgaacggccgaagaatcaccgcaggtacatggctgatgtgttcatcttctagaggatatcttgcaccagagtacaccattcaagggcagctgaacaaaaagagcgacgtctacagctttggtgtgctgctgttggagattgtcagtggcagatgccacactgatcctagattacccgttgacgagcagttcctcctagaaaaggtctggacactctatgagttcgatgatctcgagagcatcattgataggacactaaagcgcgattttgacaccgaggaagcactctggttgcttaaggtaagtcttgtgtgcatcccggatagccctaagatcaagtcctccatgtcaatggttgccaagatgctgcaaggtgagtgtgttgtgggtgataggatcatgaggctggcctgatcacagacgtcatggaactgaaagtcaggatggaagaagccgttcaagtcagcttgacatcatggtcgagcactatcgcggttggggcctgggggcgcaaagcccccactctttggtgggggaatttccanttcgcctactacaaagtattccccggtgagggcccccggaagggaccccaaatcggccccccctggttctgggaaaaaaactttctgaatgtga

SEQ ID NO: 81691 - protein, 125 aa, Zea mays
  misc_feature: Ceres CLONE 1567236
  misc_feature: SWISSPROT Homolog: EC 2.7.11.1 Non-specific serine/threonine protein kinase
MCSSSRGYLAPEYTIQGQLNKKSDVYSFGVLLLEIVSGRCHTDPRLPVDEQFLLEKVWTLYEFDDLESIIDRTLKRDFDTEEALWLLKVSLVCIPDSPKIKSSMSMVAKMLQGECVVGDRIMRLA

SEQ ID NO: 81692 - DNA, 812 bp, Zea mays
  misc_feature: Ceres CLONE 1567237
  misc_feature (422)..(422): n is a, c, t, g, unknown, or other
tccccgcggtggcggccgctctagaactagtggatcccccgggctgcaggaattcgtctcacccctagaaaaaatcggcaggggcggagagtccagaccttctaacgaggacgctgccgcgtctatggtaactcctacacacgacccatagtgcggtagcgctactcggtccattagtctgttccaccgctatgtacactgtcgtgctcgcgggctctccagctcttccacggaagacggtatccaatccctgtccaaaatcaccggacatacggagctccgcgcgaatgttgccgttgaattgtgaacagacgatgtgcgcactgctgctgcagctggtacaacatcttcaacgcgtgcgtgcgagcttctggatgctgcagacctcccagtgactattggatctccgctctgctcgccancgataaatcaagctctggttgctccttgtgtcaacccatggctagcagatgatagctcttcttggttgatctctagctgagactccgatcacaatgtactctgcaagatacacatgctgaggtaagcgcctcaccagatccgactgatgagcgagcggtcttgatcgacctatcgctgctcactggatggactcatgaccttgcgatcactgacaatgtggtgcctcgtatgcatcacgtaccacaacgttctgggtgctcgcccgtcttcccctcagggaccgttcatcccccgaggtgcccggaccacggggcatccattcggggacgcccatgcatcaagggggcttctttcctccctgaaaaaccccccggacgaggcctcaaggg

SEQ ID NO: 81693 - DNA, 1955 bp, Zea mays
  misc_feature: Ceres CLONE 1567238
  misc_feature: Encodes the peptide sequence at SEQ ID NO. 81694
aaccgtgtgccattcgtgacagtgacagactttcgtgtctgtgtgtctcttgggctcgcaatcccattggtcgcttcatgccgctcacgaactcccctcggagcccggccgtccaattatgatccacttggttaactaggaataggataattaatcgcagatgaagcagcagttcatgaaggcaggaagcagctaaatgacccatataaatggtcgcgcgcgctagcataagcatagcatagtagcgatagccaccaccgatcgaagcatgatggcggcgtcgggcgcgtacgcggcgcaactcccggcggtgccggagtggctaaacaagggcgacaacgcgtggcagctgacggcggcgacgctggtgggcatccagtcgatgccggggctggtggtgctgtacggcagcatcgtgaagaagaagtgggcggtgaactcggcgttcatggcgctgtacgcctacgcgtcgtcgctgctggtgtgggtgctggcggggttccgcatggcgttcggggagcggctgctcccgttctggggcaaggccggggtggcgctctcccagggctacctggtccggcgcgcctcgctctcggcgaccgcgcacggggccacgccccgcaccgagcccctgtacccggaggcgacgctggtgctgttccagttcgagttcgccgccatcacgctggtgctcctggccggctccgtgctgggccgcatgaacatcaaggcctggatggccttcaccccgctctggctcctcttctcctacaccgtcggcgccttcagcatctggggcggcggcttcctctaccactggggcgtcatcgactactccggcggatacgtcatccacctctcctccggtgtcgccggcttcaccgccgcatactgggtgggcccgaggctgaagagcgaccgggagcgcttctccccgaacaacatcctgctgatgatcgcgggcggcgggctgctgtggatgggctgggccgggttcaacggcggcgcgccctacgccgccaacatcgcggcgtccgtggccgtgctcaacaccaacgtctccgccgccaccagcctcctcacctggacctgcctcgacgtcatcttcttcggcaagccgtccgtgatcggcgccgtgcagggcatgatgacggggctcgtctgcatcacccccggagcagggctggtgcagacctgggcggcggtgatcatgggcgtgttcgcgggcagcgtgccgtggttcaccatgatgatcctgcacaagaaggtggcgctgctgacgagggtggacgacacgctgggcgtcttccacacgcacgccgtcgcgggcctgctgggcggcgtcctcacggggctgctggccacgccggagctgctggagatcgagtcccccgtgccgggcctccgcggcgcgttctacggcggagggatccgccaggtcgggaagcagctggcgggggccgccttcgtggtggcgtggaacgtcgtcgccacgtcgctcatcctgctggccatcggcctgctggtgccgctgcggatgcccgaggaccagctcatgatcggcgacgacgccgcgcacggggaggaggcctacgcgctctggggcgacggggagaagttcgatgccaccaggcacgacgcggtcagggtcgccggcggcatggatagggaagggtccgcggagcagcggctatcaggcatgggagctaggggcgtcaccattcagctgtaggcgcacgcccgagtcccgactgtccataggacacgactttttagtggactttttttttcatgggagaagagcagtgttttaggcttttgtccatgtatcatatttggcacagagcacgtagtctctgctcgtttaaaaagaaattaggtcatgtatttttcctcttaagctagtctacccgtaacatgtactaacaccgttccgtcaaaaaaaaaaaaaaaaa

SEQ ID NO: 81694 - protein, 487 aa, Zea mays
  misc_feature: Ceres CLONE 1567238
  misc_feature (25)..(442): Pfam Name: Ammonium_transp Pfam Description: Ammonium Transporter Family
MMAASGAYAAQLPAVPEWLNKGDNAWQLTAATLVGIQSMPGLVVLYGSIVKKKWAVNSAFMALYAYASSLLVWVLAGFRMAFGERLLPFWGKAGVALSQGYLVRRASLSATAHGATPRTEPLYPEATLVLFQFEFAAITLVLLAGSVLGRMNIKAWMAFTPLWLLFSYTVGAFSIWGGGFLYHWGVIDYSGGYVIHLSSGVAGFTAAYWVGPRLKSDRERFSPNNILLMIAGGGLLWMGWAGFNGGAPYAANIAASVAVLNTNVSAATSLLTWTCLDVIFFGKPSVIGAVQGMMTGLVCITPGAGLVQTWAAVIMGVFAGSVPWFTMMILHKKVALLTRVDDTLGVFHTHAVAGLLGGVLTGLLATPELLEIESPVPGLRGAFYGGGIRQVGKQLAGAAFVVAWNVVATSLILLAIGLLVPLRMPEDQLMIGDDAAHGEEAYALWGDGEKFDATRHDAVRVAGGMDREGSAEQRLSGMGARGVTIQL

SEQ ID NO: 81695 - DNA, 837 bp, Zea mays
  misc_feature: Ceres CLONE 1567242
  misc_feature: Encodes the peptide sequence at SEQ ID NO. 81696
ctccccgcggtggcggccgctctagaactagtggatcccccgggctgcaggaattcgtctcacccctagaaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgcccgtgggcaacgaggtggtcgcgtcggcccaggaacgtgacggccgcagctgggtccgggccatggccaacgtgccccgccgcgctgggcagggctcgggcttcgagcggggcccgtccaggtggttcttccccccctttgggcttccacgggggttttgggtttggttcctaaccccggtcccttcgggggggggggggcttttccccgggggggggaccctctccccggcaggggcccctttcttgggaagagccccaaggtgcctccgaatcttttcccgggggggcgccagaaaacccggggggggtccgagtccccccccccagggggggggggagacacacgccccctc

SEQ ID NO: 81696 - protein, 130 aa, Zea mays
  misc_feature: Ceres CLONE 1567242
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNEQVAAAASRASYALLWVRRNVAAYHPATQIQGIARGQRGGRVGPGT

SEQ ID NO: 81697 - DNA, 851 bp, Zea mays
  misc_feature: Ceres CLONE 1567245
  misc_feature: Encodes the peptide sequence at SEQ ID NO. 81698
  misc_feature (755)..(755): n is a, c, t, g, unknown, or other
ccgctctagaactagtggatcccccgggctgcaggaattcgtctcacccctagagtccccaacccgaagagagcacccaatcgagtatcgcgagaagcgctacgcggccggcgaggcgctccccccatatggtgcgcgtcgtcgtctccaccctccccgccctccgtccgcttctccgtcgtggctctctgctaaaccataaacccctgccccgctcgcgccttcagccgtggccgttccgcacgctctcgtcctcgcccgccgccggcgcgcccagcgccgcggtgaagggggaggaggttgcgttggacaagcaccttacccggtgcgcggcggcgggcatagcaccgttgcgggtggcggtgctggtgagcggcggggtggatagcagcgtggcgcttcgcctcctccacgccgccggccatcgctgcaccgcgttctacctgaagatttggttccaggaagatttcaggaacttctggtccgagtgcccatgggacgaggatttgaagtatgcacaagctgtttgtgacaagattgatgtgccattggaggtgggccacctatccgatgaatactggaaaccatgtggtatcacatatgatcaatgagtattgcctggggtcgtacaccaaatccctgaaggtctgtgcaacaacaaaaataaagttcgggggcttttcttaaaaacccattggaaaaattttagaattttaactacctaagctttcagggacactatttggacaccgtangaacattcccttccggcgtgaaaaaatactgaaagggcccctcccggtttctacaaattttttcacaaggggccaagagatccagggggttccacc

SEQ ID NO: 81698 - protein, 160 aa, Zea mays
  misc_feature: Ceres CLONE 1567245
  misc_feature: SWISSPROT Homolog: EC 2.1.1.61 tRNA (5-methylaminomethyl-2-thiouridylate)-methyltransferase
MVRVVVSTLPALRPLLRRGSLLNHKPLPRSRLQPWPFRTLSSSPAAGAPSAAVKGEEVALDKHLTRCAAAGIAPLRVAVLVSGGVDSSVALRLLHAAGHRCTAFYLKIWFQEDFRNFWSECPWDEDLKYAQAVCDKIDVPLEVGHLSDEYWKPCGITYDQ

SEQ ID NO: 81699 - DNA, 826 bp, Zea mays
  misc_feature: Ceres CLONE 1567246
  misc_feature: Encodes the peptide sequence at SEQ ID NO. 81700
  misc_feature (624)..(624): n is a, c, t, g, unknown, or other
  misc_feature (625)..(625): n is a, c, t, g, unknown, or other
  misc_feature (701)..(701): n is a, c, t, g, unknown, or other
ctccccgcggtggcggccgctctagaactagtggatcccccgggctgcaggaattcgtctcacccctagaaaaagtccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgaagtgatggtggtgtccactcccgccttgaccaactacagttacttctgaaaggtgtcagtgagagaggagcaaannaaattcgtgtgcacatccttaccgatgggcgtgacgttttggatggaagcagtgttggtttcgtggagacctagangatgatctttttgagcttcgagggcagggtattgatgcacagattgcatctgggtggtgggaaggatgtatgttacccatggaccgttatgagaatgactggggatgtggttaacccgtggctgg

SEQ ID NO: 81700 - protein, 132 aa, Zea mays
  misc_feature: Ceres CLONE 1567246
  misc_feature (15)..(133): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLK

SEQ ID NO: 81701 - DNA, 777 bp, Zea mays
  misc_feature: Ceres CLONE 1567247
gagctcaccgcggtggcggccgctctagaactagtggatcccccgggctgcaggaattcgtctcacccctagaaaaattacaaatgtaccttcggtcttgaagaatacaagtgtgatgtgaaggcaaatgacaggttcgtgtgaacagtacagaggtactgttcatctattatagacacaggtcgcagcctgtgacaaattacaattatgccccttgcggaagtttacaacattgactcggacatacatgtataaaaaggtcattctgcctctatgtcggtttaaaacgccgaagctccatgaaaagggaccttcggccatctcttagaaacgactttggccgaagctgcttcttcgtgtgagaccttcggcgtaccgaagcacgaccccaacactaacatatatccattaaagtatccaagtgtagtcatggtgctaacataaactgtatgattatttatactgatgaaatgttgatatggtatgtattattatcgttgcatcatttttgcattttataggatctggatgtttgtcaggactcaggaataccctcgtgaatttcatgacttaagaatgaaagtatggcatgtttgtagtgagtacagtagtgtgcattcaattcatgaccaaaaacacaagttatgccagcataccaatgtgccacatttctatggccagttggccactgcttggcatgcgactccagtttttggatgagcggatgccatgtgaatggggttgtcatttggggccacttctctatatgaaaatatg

SEQ ID NO: 81702 - DNA, 1142 bp, Zea mays
  misc_feature: Ceres CLONE 1567249
  misc_feature: Encodes the peptide sequence at SEQ ID NO. 81703
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (1142)..(1142): n is a, c, t, g, unknown, or other
atagtaatcctttttttaaaatggggtttttgtcgtggtggccctgtgannnnaaaaannnnngtcnnnnnnacaagctggaactccccgcggtggcggccgctctagaactagtggatcccccgggctgcaggaattcgtctcacccctagaaaaatcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctgtcgcggaagcacgtgcgggcgccgctctgcgcggggtgcgccgcgcgcccggccgccgcgcgcgtctcccccaccccgtccccgggcggcgccgacccggcgttcctctgcgcggactgctgcgagggctgcgccgccgcttccgcggcgcgcgtgcccgtcgagggcttcctcggggtgccccttcggcgggcgagcttcgccgcgtcatgggggggctctaacctcctcccacaccggccgtgggccgtgggggcgaacaaccggggaaacggctgggggaactaaacaaccggaccccctttccttccttcggggggcctccgaaacataccctccccaatgccctgggggaggttggggggaattgtgatccccaaacccccggaaacccctgtgcccgcgagaaccatcctcaaacacatgtgtgcccgaggaaggagaaaaacccccacacccgtactcgcggggatgtgtccacacggccaccatctcccttaaattacgcccgggggaacatcgcagtaatcccgacgtttaaaaagggggggggagaaagggggccttctgattcgtcgctaaacccagggttatttgggcgataaaaacaatggcgcaccgggacgccccccaccaaagtggccgtggaaacacagttttctttaaggaggggaaataccgccataacagggggagagatctgaagaacacccgtgtagaacgcgtttttgtactcacacccacttttcgcggggtgttcacacggagggaaaacctctttctcacatacggaggacatatcaagcccccn

SEQ ID NO: 81703 - protein, 144 aa, Zea mays
  misc_feature: Ceres CLONE 1567249
  misc_feature (11)..(58): Pfam Name: zf-B_box Pfam Description: B-box zinc finger
MKSCGGGGADGQQCPCDYCGEAAAALHCRADAARLCVACDRHVHAANALSRKHVRAPLCAGCAARPAAARVSPTPSPGGADPAFLCADCCEGCAAASAARVPVEGFLGVPLRRASFAASWGGSNLLPHRPWAVGANNRGNGWGN

SEQ ID NO: 81704 - DNA, 808 bp, Zea mays
  misc_feature: Ceres CLONE 1567252
  misc_feature: Pfam Name: Kelch_2 Pfam Description: Kelch motif
ctccccgcggtggcggccgctctagaactagtggatcccccgggctgcaggaattcgtctcacccctagaaaaaatttttatctattgctgggcatacaaaagatccatctgaaggcgttacagtgaaggaatttgatccacatacttgtacttggtcgattgtcaggacttatgggaaaccaccggtttctcgtggaggtcaaacagtgactcttgttggaacgacgctagttttgtttggtggtgaagatgcagaacggtgtctcttgaatgacttgcacatccttgatcttgaaaccatgacatgggatgatgtggatgcaatgtgagtagcaacctgatggccttaatgcacagtttttcacctagtgagaagaaaagaaaattgctgttagcttcatgtatctttcctatgtgtgctcaaaagttaaaatattactttcaaaagttcctggatgtgatgtgattggcacacttgtctccaacataatcgagatgcatgttaactgttacacatatagtaagttaaacacttctcagtaattttctcttcaacatactaggtttcaccccctttccctgctatttttgaaaggcccccccggggtaaaatttataataattttcccccacaaaaaaacccttttaaaaaaaaaacatctctccctccaaaaaaaaaaaaagggggggggggggtgttttttaaaaacacacacccccttcttttatataaaggagggggggagaaaattattattttttttttttccccccccccccccaaaaaaaaaaaaaaaaaaaaaaaaa

SEQ ID NO: 81705 - DNA, 825 bp, Zea mays
  misc_feature: Ceres CLONE 1567254
  misc_feature: Encodes the peptide sequence at SEQ ID NO. 81706
ccgcggtggcggccgctctagaactagtggatcccccgggctgcaggaattcgtctcacccctagaaaaacgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgttcagattactcgtggtattgagaaaacagctaaagcactagttgaagaactacggaagttgtctagggaggttgaagatagtgagcttgcagatgttgctgcagttagtgctgggcaacactatgaaaattggtaacatgatagcagaggccatgaggcaggtcggtcgggaagggcgttgtcacccttgaaggaggggaagagttctgagaaactttctctatgttgtggagggaatggcatttgaaccggggttccctcctcctcgtactttgtaaacga

SEQ ID NO: 81706 - protein, 192 aa, Zea mays
  misc_feature: Ceres CLONE 1567254
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSREVEDSELADVAAVSAGQHYENW

SEQ ID NO: 81707 - DNA, 1183 bp, Zea mays
  misc_feature: Ceres CLONE 1567260
  misc_feature: Encodes the peptide sequence at SEQ ID NO. 81708
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
naattttnnnntttcccnctactactacccacatataaccacatctccctcaacacaaaanataaaaannnntaaagctggagctccccgcggtggcggccgctctagaactagtggatcccccgggctgcaggaattcgtctcacccctagaaaaattccggaccaccccaagctccccaaggggaaaccggtggctgtcgtcgtgctggacggatggggcgaggccaaccccgatcagtacaactgtatccatgtcgctcagactcctgtcatggactcgctaaagaatggcgctcctgagaaatggagactagtgaaggctcatggaacagctgtgggtctcccatctgatgatgacatgggcaacagtgaagttggtcacaatgcacttggtgctggtcgaattttcgcccaaggtgctaagcttgtcgatcaagctcttgcctccggaaagatttatgatggagatgggttcaactacatcaaagaatcttttgaaagtggtactcttcaccttattgggtttgttgagtgatgggtggtgtcccactccccgtctttgatcaactgcaggttccttcttgaaaaggtgttccctgcagaaggggggggcggaaaaaaaaattccgtggtgccaccatcccctttacccgaatggggccccttgataggtttttttgggaaatgggaaaagcccaaccaaatttggggttcttccaatgggggaacaaaccccccttaatgcatcgaaaaagggatacctctttttttattgtgggaaatccctctttaaccaaaaggcccggtaaaagtggggggggggttattggaaatatgccccacacagaaaatattgggtaccacatctcctgcggttggcgctctggctaaaaaaggaaatattttacaatgtgtttaacccgacaagtctgcacacccggtgtttactcgataaccaacctgctacccaggggggaaaatgacgggcgtcttacaaaacaaatgggtatcttgggagaataattcccccacacatctggtctcttgtggcaagaaaaaaccccccccttttataaaatatgttcaaaaaatagtgctcatctcttaagaggctctttttgtaaaaacaccaccttgaatgaaagtcccaacctcacacaaagtgtcttattgttttcaag

SEQ ID NO: 81708 - protein, 87 aa, Zea mays
  misc_feature: Ceres CLONE 1567260
  misc_feature: SWISSPROT Homolog: EC 5.4.2.1 Phosphoglycerate mutase
MDSLKNGAPEKWRLVKAHGTAVGLPSDDDMGNSEVGHNALGAGRIFAQGAKLVDQALASGKIYDGDGFNYIKESFESGTLHLIGFVE

SEQ ID NO: 81709 - DNA, 813 bp, Zea mays
  misc_feature: Ceres CLONE 1567264
  misc_feature: Encodes the peptide sequence at SEQ ID NO. 81710
ctccccgcggtggcggccgctctagaactagtggatcccccgggctgcaggaattcgtctcacccctagaaaaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctcggcgttcctggtcgtcttcgtcggcaccgtgtacgtgatgtcgcggcccaggccggtgtacctggtggactacggctgctacaagccccccgccagctgccgcgtgcccttcgccacttcatggagcacacgcggctcatcagcgaacaagaaaagagcgtggcgcttccagaccaagatccttggaacgcttcggggcttcggcaaggaaccgtggccttccggcccgccaaccaattaaattcccgggcaaaaccccaaaaatgggaaggccctccccgcgcccaagggggcaaatttttttaatttttttttcccgccaataaaaaaaaaaaatttttttccccccccaaagaggggggggtttttttctcccccccccagaggaggaa

SEQ ID NO: 81710 - protein, 147 aa, Zea mays
  misc_feature: Ceres CLONE 1567264
  misc_feature: SWISSPROT Homolog: EC 2.3.1.119 Icosanoyl-CoA synthase
MPSGSAFSGSVNLKHVKLGYQYLVNHFLTLLLVPVMAATALELARLGPGELLSLWRSLELDLVHILCSAFLVVFVGTVYVMSRPRPVYLVDYGCYKPPASCRVPFATSWSTRGSSANKKRAWRFQTKILGTLRGFGKEPWPSGPPTN

SEQ ID NO: 81711 - DNA, 834 bp, Zea mays
  misc_feature: Ceres CLONE 1567268
  misc_feature: Translation starting site: 76
  misc_feature: SWISSPROT Homolog: EC 3.4.21.25 Cucumisin
  misc_feature (499)..(499): n is a, c, t, g, unknown, or other
agctcaccgcggtggcggccgctctagaactagtggatcccccgggctgcaggaattcgtctcacccctagaaacatggggagcccgtcgggcggcggcgacccggaggcggtgcaggcggctcacctgcagatgctgtcgtccatcgtcccgagcgacgagcaggggagggtggcgctgacgcatagctaccaccacgcgttcgagggcttcgccgccgcgctcaccgacaaggaggccgccgcgctctccgggcacgagagggtggtgtccgtgttcaaggaccgagccctgcagctgcacacgacgcggtcgtgggacttcctggaggtgcagtccgggctccagtccggccgcctcggccgacgggcgtcgggggacgtcatcatgggcatcgtcgacacgggcgtctggcccggagtcgccgagcttcaacgacgccgggatgcgggacgtgccggcgcggtgggcgcgcgtgtgcatggaaggacccgacttncagaaagagcactgcaacaagaagctcataggcgcccggtttctacggcgtccaggcccgagtcgtcggcatcgaacgcctccagcagcgccgtggcgacgccggccgcaaacggatcgccgcgggacaccgtggggcacggcacgcacaccgcggtcacggcgggcgggcgcggttcgtgtcggacgcccgactactacgggctcgcccgggggcgcggcccaggggcggggcgcccgtccagccgggttggcctttttacccccccctgcttccctgggcggggggctcccgccgtcggccgttgcttaagggcatttaacaacccgggtggg

SEQ ID NO: 81712 - DNA, 785 bp, Zea mays
  misc_feature: Ceres CLONE 1567270
  misc_feature (393)..(393): n is a, c, t, g, unknown, or other
  misc_feature (444)..(444): n is a, c, t, g, unknown, or other
  misc_feature (784)..(784): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaaagaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaagccgcgtcgtcactggagagatacctctcggcgacggtgacgggagcggtgatggaaacggggggcgccccaccagntttgggccccgcgggcgcccccgcgggcaatgaaggggggacggaaaacantataacccgtttggggggctttcccccctcgaaaaaagccaaagttcgaattttttcccaggggccccaaagaaaattcatgcccccaaaattgggcaaaagggggggggggggggggaaaaaaatttgaaaaaaaagattccgcccgggggggggggggggaaaaaaaatgttaaaaaaaaaaaaaaagggggccaaaaaaaaaaaaccccccccttggggaagatttttttgtgggggggggggagaaagaaaaaaaaggggggggggtttttttttttgggggggggggggtaatttgttttttttaaaaaaaaaaatttttttttttatatttttnn

SEQ ID NO: 81713 - DNA, 891 bp, Zea mays
  misc_feature: Ceres CLONE 1567271
  misc_feature: Encodes the peptide sequence at SEQ ID NO. 81714
tccccgcggtggcggccgctctagaactagtggatcccccgggctgcaggaattcgtctcacccctagaaaaaaccgggcagagcggaggggtgccggtgtccggactccggagagaatggcggccactcttctcccgaccttatcgccgcccgtttcgcgcgccgccgccgctttcctcctccgacgagccccactgaagccctcccattatgtgcacccaccttctactctgcgccgcttactcatctcctcctatccagcaatccctgccatgtgccccctctccaccatgtcgtcgaccactgccgctcgcgccgtcccggtccgccgtgacctcctcatgctcggcatcgagaccagctgcgacgacactgcgggctgctgtgggtgagacgtgaatggcgagatcccttaggtcaagtaggtatccttcccaaggcgggatttgcttccccaagggtatgggggggtgcttgcccccttaaggaggggcccaaggaaggccacccgcccctttggggatttgaaccgagggtttgttttcaaaaaggggtttttgggaccaagggcaaaaaagggggaaaaaaaggggggacttttttggggggagaccccgggggggccccctttggggcccccggggactttttttttccctggggccccttaaaaagtttgggggggttccaaaacaaccttttggacacggggaaaccaaaaaaacctcttttgggggttagggcccttatgggggtgggggggggttctcccctcccttcagggggaaaaaaacccccccgccccgtttttgtattttttccccggggggggtgccccgcccattttattgggggagcccaccttgttttttttctccccccattttggg

SEQ ID NO: 81714 - protein, 91 aa, Zea mays
  misc_feature: Ceres CLONE 1567271
MAATLLPTLSPPVSRAAAAFLLRRAPLKPSHYVHPPSTLRRLLISSYPAIPAMCPLSTMSSTTAARAVPVRRDLLMLGIETSCDDTAGCCG

SEQ ID NO: 81715 - DNA, 823 bp, Zea mays
  misc_feature: Ceres CLONE 1567275
  misc_feature: Encodes the peptide sequence at SEQ ID NO. 81716
  misc_feature (414)..(414): n is a, c, t, g, unknown, or other
  misc_feature (653)..(653): n is a, c, t, g, unknown, or other
  misc_feature (795)..(795): n is a, c, t, g, unknown, or other
  misc_feature (798)..(798): n is a, c, t, g, unknown, or other
ctccccgcggtggcggccgctctagaactagtggatcccccgggctgcaggaattcgtctcacccctagaaaaaaaaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaaaacgnagggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaacacgtnttttctctccgcccgcggctcctggtgtccgacatcatcatgtacggcgccaccgactcgtggctcgcgccctacggcgacactttcgcaaggcgcggaagctggtcaccgtgcacctgctcaacgcagcaaagtgcgttcncancgtcgccggaaaaaaaaaaagaggc

SEQ ID NO: 81716 - protein, 188 aa, Zea mays
  misc_feature: Ceres CLONE 1567275
  misc_feature: SWISSPROT Homolog: EC 1.14.13.88 Flavonoid 3',5'-hydroxylase
  misc_feature (53)..(53): Xaa is any aa, unknown, or other
  misc_feature (180)..(180): Xaa is any aa, unknown, or other
  misc_feature (181)..(181): Xaa is any aa, unknown, or other
MAAQLHHALYELLHEAAAAQRALLLAIPFSLLLLPLLLRYLAASASASATKTXGAAPASDPDKLLSLLPSPPMKLPIIGHLHLMGDIPYVSLAALATRYGPDLMLLRLGAVPTVVVSSPRVAEAVLRTYEHVFSLRPRLLVSDIIMYGATDSWLAPYGDTFARRGSWSPCTCSTQQSAFXXSPEKKKE

SEQ ID NO: 81717 - DNA, 883 bp, Zea mays
  misc_feature: Ceres CLONE 1567277
  misc_feature: Encodes the peptide sequence at SEQ ID NO. 81718
gagctccccgcggtggcggccgctctagaactagtggatcccccgggctgcaggaattcgtctcacccctagaaaaaatcggctccggcaacttcggcgttgcccgcctcatgcgcgaccgccgcaccaccgaactcgtcgccgtcaagtacatcgagcgtggcgagaagatagatgagaatgtccagcgcgaaataattaaccatagatcattgaaacaccctaacattattaggtttaaagaggttattttaacaccgacccatcttgctattgtcatggaatatgcctctggcggtgagctttttgagagaatatgtaagaacgtgcgattcagtgaagatgaggctcgctccttcttccaagggggggggggggggaggaagctactgccattcaatgcaagtatgccaccgtgatttgaagctggagaacacactttctggatgggagtgatgctcctccgcttgaagaattgtgactttcggtttatccaagtccacctgttcttccttccccacccgaagtcaaactgttgggaacacctgctttatattggccccggaagtccctgtttgaaaaaaaaatatgaaggggaagaattgcctgatgtttgggttaccggggtgaacccccccccatataaagggctggggggggccactttctttttttaaacaccccagaaaagccccaagaatccttcgctccgggaggttttccgcggcttctttgaactgttttcgtattcccgctcttacccgggaagcgtgggaaaattttctctcgcgggggggtggagctcgcatcgattctcccggggatgtctctcgttcgggggtgcccccccccgcctgtggcaaagcgacccccggcggaatcg

SEQ ID NO: 81718 - protein, 138 aa, Zea mays
  misc_feature: Ceres CLONE 1567277
  misc_feature: SWISSPROT Homolog: EC 2.7.11.1 Non-specific serine/threonine protein kinase
APRGGGRSRTSGSPGLQEFVSPLEKIGSGNFGVARLMRDRRTTELVAVKYIERGEKIDENVQREIINHRSLKHPNIIRFKEVILTPTHLAIVMEYASGGELFERICKNVRFSEDEARSFFQGGGGGRKLLPFNASMPP

SEQ ID NO: 81719 - DNA, 845 bp, Zea mays
  misc_feature: Ceres CLONE 1567279
  misc_feature: Encodes the peptide sequence at SEQ ID NO. 81720
ggagctccccgcggtggcggccgctctagaactagtggatcccccgggctgcaggaattcgtctcacccctagaaaaaagccgagtggtcttccactcctcccagctgagctctccctctccacgcagctccctcgcggtgctccctccatagcgcctgagcgctctgtcctcggatcggagcttctctgcgtgtcgcagccaagcttccttccccatggcgcccggcgcccaagtccccagccgtgaccctgccgagctccgccccgactccacgtctcctggtcgggctctcgttctatgcctgatgccgctgttccctggtgctccctgctcggtccctgcccagcgcctgactacagctccagctcgcggcgtcccctctgcttagccaggattgtcgtgcctctgctccctggttttccctacgcgcgagctcgctggtgttgcccctgctccgcttggccgcgtccccctcagtccaccactctgctcggccatggaagacacgccgcaccctggttccagctcgcgatactccctgcacgccggagtcgcccagctcggccacctacctccctatgcgcgacctcctctagctccctgtttctccagagtggcttcctctgttggctcgccgggcttctggctcctgctcacccagcgcacgctttctccttgtgggctgtgcccggcgtggctgctcgcccctagctcccagccatgggcggcgggcaaagcttcctggcgcggtaaggggccccagcttcccttttcccgcggagggcccgctttagcttgcgcttttcctggcgcacccaagggtttctgcttccccggttcggc

SEQ ID NO: 81720 - protein, 137 aa, Zea mays
  misc_feature: Ceres CLONE 1567279
MPDAAVPWCSLLGPCPAPDYSSSSRRPLCLARIVVPLLPGFPYARARWCCPCSAWPRPPQSTTLLGHGRHAAPWFQLAILPARRSRPARPPTSLCATSSSSLFLQSGFLCWLAGLLAPAHPAHAFSLWAVPGVAARP

SEQ ID NO: 81721 - DNA, 823 bp, Zea mays
  misc_feature: Ceres CLONE 1567280
  misc_feature: Translation starting site: 160
  misc_feature (618)..(618): n is a, c, t, g, unknown, or other
ccccgcggtggcggccgctctagaactagtggatcccccgggctgcaggaattcgtctcaccccctagaaaaaagcaagccccacgcaacattagcagcaggagaccaccccaatcccccacggacattcgtcgcgaacccttatctgcacgccgcgccatggccgcagccgccgcggtcgcccacctctccatccacggccgcctccgccgctcaccggagcatcggccgtccatcaccaccaccaccacctcctcctcttcctcgtccgctcaccgcccgtccctcctgcggtgccgcgcgttcaagcaggaggccggcgacggcgacccggctgaggccgacgcgcggaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatcttcttctcggttgctactcagctaggcagatatgttatcactatgatgagcagcggtgttgtacttggggttggattccagctgtcaggcggagacagccaaatgaacgaactaatttggtatagctggcttggntggggtgattatcggcacaatgataggtgcaaacagtgtcctagaagaacactgcaaagctggacctcgcaatgtcgtcataactggaagcacaagagggttaggaaaagcgctggctcgtgagtttcttctttctggaaaccgtggttgtaattacttcacgaagtcctggatcagtcccttccgactataaaagacttgaagc

SEQ ID NO: 81722 - DNA, 844 bp, Zea mays
  misc_feature: Ceres CLONE 1567282
  misc_feature: Encodes the peptide sequence at SEQ ID NO. 81723
  misc_feature (765)..(765): n is a, c, t, g, unknown, or other
ggagctccccgcggtggcggccgctctagaactagtggatcccccgggctgcaggaattcgtctcacccctagaaaaagtggcgacttgctcgtccggttcagttcagtggcgccgtcgtgcctcgacgacggcgggagacgccgcaagcaggtgagagtgagacgggcggtgactagcgggcgcttaggccgacatcggccccgcagcggcggggtagggtgcgtcgacacgcgggactgcgacttgggggggattgattcccttcgctgttctctcttctccggcgcgtgcgcgcgggatcgaaggtagggtttgggccccaaagttcgtgtctttggggacagcggcggcgatggactacaccaacgccatccacatcatcccggacgccgcgggccccgacgcctgggccaacgcggcgtcggccgcgggcgccgacgccagcatctgggccaccgaggacgactaccgccagtggagcgccgaaccaggctacggcgaccggaacccctcgtcgcgggcggggagcgagcagccgccgccgggcaagaaggctcgcggcgggggcggcggcagcgatagcggcggcggtggcagcacgagcaagtcgcgcgccattggcaagatgttcttcaagaccaagctctgctgcaagttccgggccgggacctgtccctacgtcaccaactgcaacttcgcgcatggcatggaggagctccggaagccaccgcccaactggcaggagatcgtggccgcccacgangaggccaccggagccaccgggaggagcaccagatcccccatcatgacctcctgggagtgtttgtacctgggaaaccgca

SEQ ID NO: 81723 - protein, 163 aa, Zea mays
  misc_feature: Ceres CLONE 1567282
  misc_feature (94)..(119): Pfam Name: zf-CCCH Pfam Description: Zinc finger C-x8-C-x5-C-x3-H type (and similar)
  misc_feature: The sequence is a functional homolog of SEQ ID NO 644 in the 10/666,642 US patent application
  misc_feature (137)..(137): Xaa is any aa, unknown, or other
MDYTNAIHIIPDAAGPDAWANAASAAGADASIWATEDDYRQWSAEPGYGDRNPSSRAGSEQPPPGKKARGGGGGSDSGGGGSTSKSRAIGKMFFKTKLCCKFRAGTCPYVTNCNFAHGMEELRKPPPNWQEIVAAHXEATGATGRSTRSPIMTSWECLYLGNR

SEQ ID NO: 81724 - DNA, 828 bp, Zea mays
  misc_feature: Ceres CLONE 1567284
  misc_feature: Encodes the peptide sequence at SEQ ID NO. 81725
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (381)..(381): n is a, c, t, g, unknown, or other
  misc_feature (386)..(386): n is a, c, t, g, unknown, or other
  misc_feature (757)..(757): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttnnnnnaaaagctggagctccaccgcggtggcggccgctctagaactagtggatcccccgggctgcaggattcgtctcacccctagaaaaaaaataggtgctgagctccaggttttggttctctttttttttggcatgatttgttttctgcaggagcggaatgtagttccctctttgaaaaaaaacttgaatgacatttctttggagaaagatgctgctgtagttgctaaggagatgctctagctcactcagagcatgaagaacgctcagggagcagaagaagaccngtttnaggggcagaagaagaactccacccttccttgaaaagcacagtttaaaccacccctggaagcaagcaaggtaaatggggaacccccccttaacccgggggaaaaatcccaaatggggaaaatttcccggggtgggagggaaaattcttttcgcccctgggggaaaaaggggggaattcccccggttttttcccggggcccccccttttaaaaacaaaaaaatccccccctgttttaaaaaacacccgggggggccccacaaaaaaaaattttctccttaaaaaaaatctccccccccctttggggggccccccccgggggggccaagaaaaaaaaacctctccccccaaaaaaaaaaaaaataccccccccntgtgggccccccccccccgcggggggggggggtaaaaaaaaaaaacacccccctcgttgggaaaaaaaaaa

SEQ ID NO: 81725 - protein, 81 aa, Zea mays
  misc_feature: Ceres CLONE 1567284
  misc_feature (2)..(2): Xaa is any aa, unknown, or other
  misc_feature (3)..(3): Xaa is any aa, unknown, or other
FXXKSWSSTAVAAALELVDPPGCRIRLTPRKKIGAELQVLVLFFFGMICFLQERNVVPSLKKNLNDISLEKDAAVVAKEML

SEQ ID NO: 81726 - DNA, 854 bp, Zea mays
  misc_feature: Ceres CLONE 1567286
  misc_feature: Encodes the peptide sequence at SEQ ID NO. 81727
ctccccgcggtggcggccgctctagaactagtggatcccccgggctgcaggaattcgtctcacccctagaaaaattcctccccgtcccgcgtcgcgtcccacgccgccgcacctccgcggcagcgctactcctcgccgtgacgtcggggaggcctcgctcgggggagggctgcctgcctgcctggctgggtgtcagtcggccgtagaggaggaggggggcggaggagcttgatctggggcacctgccccccctcccctgcgccgtcgggatgtacatgccgccgccgccgcccaccggcggcgccggcgagcagcctaggctttaccaggtctggcggggaagcaacgaattcttcttgcagggaagatttatatttgggcctgatgtgagatctgtgtttctcactatgatcctcatcatcgcaccagtggttgtcttctgtctgtttgttgcaaggcatctcataaatgatttccccgatagctggggaatctcagtgatggtagtagtggttgtcttcactatttatgatttgacgttgcttctttgtacctctggtagagatcctggtataataccccgggaattctcatcctcttgaacctgaatcctttgatggggatcaacgacccgggtgtttcggactcccacaacaatttcctttggccctcgcacaaagggaagtactttgtaaatggggaaccgtggtccgggggcaaatacaggggaaaccttggatggcggtacccgaccacccttcatgggtccaccctgggtcccatttggcaaaaaacgtttggtggaaacgggtttgaatcattcccctgtccccaggggggtccggccccagttc

SEQ ID NO: 81727 - protein, 110 aa, Zea mays
  misc_feature: Ceres CLONE 1567286
MYMPPPPPTGGAGEQPRLYQVWRGSNEFFLQGRFIFGPDVRSVFLTMILIIAPVVVFCLFVARHLINDFPDSWGISVMVVVVVFTIYDLTLLLCTSGRDPGIIPREFSSS

SEQ ID NO: 81728 - DNA, 869 bp, Zea mays
  misc_feature: Ceres CLONE 1567288
  misc_feature: Encodes the peptide sequence at SEQ ID NO. 81729
tccccgcggtggcggccgctctagaactagtggatcccccgggctgcaggaattcgtctcacccctagaaaaaacctcgtgttcgttcggagcgcacacacacacaaccagatctctcccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttggagacgggcgcacgcttgccgaactacacatccaaaaggagagcaccctccacttggggctgcgcctcagggggagcatgcaaatcttcgtgaaaaccctgaccggcaaaatttaaccctccgagggggaagcttctaaccccatcgaaaacgtcaagggccaaaatcccggacaaggagggggtttccccacaaaccagaaggggtttatttttttgctgaaaaacaccttttggggaagggggccacctttgggccaaatataaaaatttcggaaagggggaaagcccccccccaccttgtgggcccccgccccccgggggggggggcgtatacaaat

SEQ ID NO: 81729 - protein, 164 aa, Zea mays
  misc_feature: Ceres CLONE 1567288
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLGDGRTLAELHIQKESTLHLGLRLRGSMQIFVKTLTGKI

SEQ ID NO: 81730 - DNA, 800 bp, Zea mays
  misc_feature: Ceres CLONE 1567289
  misc_feature: Encodes the peptide sequence at SEQ ID NO. 81731
  misc_feature (800)..(800): n is a, c, t, g, unknown, or other
tccccgcggtggcggccgctctagaactagtggatcccccgggctgcaggaattcgtctcacccctagaaaaacaagtcatagaacggggttgcgaggtagcccaattctacagcactagtctttttcgtctcggtcgccatgtccttcagcgatgacgaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcggctgaaatattaacaatggagatgggaatggtgagatgcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacgggctccagacggggctcaaggtcctcgccgaccgcaagctcagctcccggtcgcgtcgttggn

SEQ ID NO: 81731 - protein, 128 aa, Zea mays
  misc_feature: Ceres CLONE 1567289
  misc_feature: SWISSPROT Homolog: EC 6.6.1.1 Magnesium chelatase
MAPLEENTQKVLLELTGGDSTSDRSGLDLVAVLDVSGSMQGEKIEKMKTAMKFVVKKLSSIDRLSIVTFLDTANRICPLRQVTEDSQPQLLKLIDALQPGGNTNISDGLQTGLKVLADRKLSSRSRRW

SEQ ID NO: 81732 - DNA, 875 bp, Zea mays
  misc_feature: Ceres CLONE 1567292
ggagctccccgcggtggcggccgctctagaactagtggatcccccgggctgcaggaattcgtctcacccctagaaaaatcctctcctctccggaactcctctctgctcacgagtaaagcctgccgctagcccgcgctctggacgtcgcctcctcccccaccccaccggctgtcgccgcccccgccgacgttacctccttacccgccgcacccccccccccctacccccccgtccttgccttggcggatctgcctgcctgtgccgcctggcgctgcctcttatcccgccggccgccgctgcctcacgttagctcctcccccatcgtatccggacctccgcgccgcccccacgcctccctgacttggtggatctgtccaccattcaccggaaacagttggtcgctgcctaggtacccacctaccccctaggcgaggcggtaccccgtcgcccagcgcataagcgcgcccaggcgagcacggaatagctccttttcaaatacactcgggcggaagcttagatctgatctcaaagaacctgccagtttgctgcagccccctcctcgcccggcgatgggatttcatgaagggttttccaatcagacctgtgcgtgaaaataaaaaggggagggtcaatccggaagggtactcaagggcccccaaaaatccaagcaaaagggtaccttgatgccaacaaggtgaatgaacccggggggggccccccatggaaagggcttttttccaaaacttggcacccgcccacccaaaaaaagtttccctggagtgcccaaaaggggaaatgaaatgtccctatgggaactaaggtttgttctaaaaagagggcgccaaattgggcgtctcttggggtaaaaagcgaca

SEQ ID NO: 81733 - DNA, 799 bp, Zea mays
  misc_feature: Ceres CLONE 1567296
  misc_feature: Encodes the peptide sequence at SEQ ID NO. 81734
ccccgcggtggcggccgctctagaactagtggatcccccgggctgcaggaattcgtctcacccctagaaaaagttcccgggcggcgccgaggcgttcgaggcctgcgccaagtactgctacggcatcaccatcacggtgagcgcgcgcaacctggtcccgctgcggtgcgcggcggcgcacctcggcatgtcggaggccgccgacaggggcaacctcgcggccaagctcgacgcgttcctcgcctcctgcctcctgcgccgctggaaggacgcgctgggcgtgctccactccacgcgccaccacgccccgctctgcgaggacctgggcctcacgtcccgctgcgtcgacgccgtggccgccctcgtcgccagcccggacaccgccccgacgtccacgtcggcgtcgccgtggtgggcgcacgacgtcgccgagctcggggtcgacctcttctggcggatcatggtcgccgtcaaggccaccggcgccgtccacgagaagaccgtcggcgacgcgctcaaggcgtacgcgcgccggtggctgcccaacgtcgccaaggaccagccgctcgaccgcgacgccgcggacgtgaagcaggtcgccacgaggcaccgcctccctgctcgagaagatcgtcagcctgctcccccgcggagagggacgccgtctcctgcggctttcttgctcaaagctggctcagggccgcccaacatcctgggggcccgttccaagggcgttccagggccggaaccttggttgaaggaagggggggccttggccacccttgggaagggaggccca

SEQ ID NO: 81734 - protein, 204 aa, Zea mays
  misc_feature: Ceres CLONE 1567296
MSEAADRGNLAAKLDAFLASCLLRRWKDALGVLHSTRHHAPLCEDLGLTSRCVDAVAALVASPDTAPTSTSASPWWAHDVAELGVDLFWRIMVAVKATGAVHEKTVGDALKAYARRWLPNVAKDQPLDRDAADVKQVATRHRLPAREDRQPAPPRRGTPSPAAFLLKAGSGPPNILGARSKGVPGPEPWLKEGGALATLGKGGP

SEQ ID NO: 81735 - DNA, 850 bp, Zea mays
  misc_feature: Ceres CLONE 1567297
  misc_feature (714)..(714): n is a, c, t, g, unknown, or other
ggagctccccgcggtggcggccgctctagaactagtggatcccccgggctgcaggaattcgtctcacccctagaaaaggatgagcgatgtcatcgttcataattaataccgctggtaggagtatttcgcatacatagaatgagagttgcgtaggtagtttctgccttatctacaatactctcgactagagcctctctgtgtgccgaaaaagaaacaggacggtgatcaggatccagctccgtacgaccaactgcagggtcagggtgtggcatggtgatggactggacatcaaaaatgatgaccaccgtaagctgaccaggccggattatatgctgaacagccagtccaatatgctcgtcgggcacgcctggaacaaggacgtcgcgatgagccccatatacactgtgcttcaaggccaacaaggtcaacgacaagagcttctatgacacgtacggtgcacagtgacctcaagtgatgtcttgtgtaggtgatcgacggctcggactacaagcccaagatcaaggtgacgttcatgcggcagccagaacatctctgagccgaggagatcagctacatgatcctgaggacgatgacggagatggacgaggtatcacaagagaacacgctgaacaacgcgtgtcgatgcggtcatccgactagttctactgactaccactactaagactataaaggacacgggcaatgaatctcccncttcaacgtgcatgtccatcagggaatctagccacccgggccacggccatggtcaatctggctttcaaccaaggagttccattcaggcacgttcaatgaaaaaaacgacttctttcgttcgcaacctcgggtgggg

SEQ ID NO: 81736 - DNA, 579 bp, Zea mays
  misc_feature: Ceres CLONE 1567298
  misc_feature (133)..(133): n is a, c, t, g, unknown, or other
  misc_feature (141)..(141): n is a, c, t, g, unknown, or other
ggagctcccgcggtggcggccgctctgaatagtggatcccccgggctgcaggaattcgtctcacccctagaaaaaaccgggcagagcggaggggtgccggtgtccggactccggagagaatggcggccactcnttctcccngaccttatcgccgcccgtttcgcgcgccgccgccgctttcctcctccgacgagccccactgaagcccctcccattatgtgcacccacctttctaactctccggcccgcttactcaatctccctccaatcccagcaaatccctgggcccatggtggcccccccttcttccaaccaagggtccggtcccaacccaatttgggccgggtttttggggggcccggtttccccggggggtccccccccccccgggggaaccccccccccccccccaaagggggcccctcggggggcaatttttttgggaaaaaacccccccaatgtttttttggggggaaaaaaaaaaaaacaccccctttttttggggggggggggcatcttgggacccctttttttgtggggggggggggagaaaaaaaaaaaaaaagggggtgggttttt

SEQ ID NO: 81737 - DNA, 834 bp, Zea mays
  misc_feature: Ceres CLONE 1567299
  misc_feature: Encodes the peptide sequence at SEQ ID NO. 81738
ctccccgcggtggcggccgctctagaactagtggatcccccgggctgcaggaattcgtctcacccctagaaaaagtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctccggcgacaagcccatgatcggggtgcagttcaggggcgaggagaaacagttctcggccgaggagatcagctccatgatcctgaacaagatgaaggagacggccgaggcttacctcggcaccaccatcaagaacgctgtcgtcaccgtcccgggcctacttcaacgactcccagcgcccaggccaccaaggacgcgggcgtcatctccggcctcaacgtcatgcgcatcatcaacgagcccaccggcgcggccatcgcatacggggtcgaaaaaaaattccagcaacgacgggcaagaaagaaagttcttatttttcgaacttcggggggcgggacccttt

SEQ ID NO: 81738 - protein, 214 aa, Zea mays
  misc_feature: Ceres CLONE 1567299
  misc_feature (9)..(213): Pfam Name: HSP70 Pfam Description: Hsp70 protein
MAGKGDGPAIGIDLGTTYSCVGVWQHDRVEIIANDQGNRTTPSYVAFTDSERLVGDAAKNQVAMNPINTVFDAKRLIGRRFSDASVQSDAKLWPFKVIPGSGDKPMIGVQFRGEEKQFSAEEISSMILNKMKETAEAYLGTTIKNAVVTVPGLLQRLPAPRPPRTRASSPASTSCASSTSPPARPSHTGSKKNSSNDGQERKFLFFELRGAGPF

SEQ ID NO: 81739 - DNA, 817 bp, Zea mays
  misc_feature: Ceres CLONE 1567301
  misc_feature: Translation starting site: 145
  misc_feature (802)..(802): n is a, c, t, g, unknown, or other
ctccccgcggtggcggccgctctagaactagtggatcccccgggctgcaggaattcgtctcacccctagaaaaaagctccctcatcctcttcttctcctcctctttcttctcgaaccatcatcatatatatatatagaatcaatatggaaggagcggccgaccataagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgccaccctgctcagcctctggtcgggcaccgtcaacctggcgccgctcctgggcgccttcctcagcgacacctacatgggccgctacgccaccatcgccttcgcctccatggcctccttcctcggcatgatcgtcctcaccctcaccgccgccgtgccgtcgctccaccctgccgccaacagcggcaccaccggcggcccctcgtccctccagatggccgtgctcctcgcctccttcgcgctgctggccgtcggcgccggcggcatccggccctgcaacctgggcttcggcgccgaacagttcgacccgcgcaccccagccggggcgcgggggcatcaacagcttcttcaactggtactactttcactttcaccatcgnccttgatgggtctca

SEQ ID NO: 81740 - DNA, 786 bp, Zea mays
  misc_feature: Ceres CLONE 1567303
  misc_feature: Encodes the peptide sequence at SEQ ID NO. 81741
gcggtggcggccgctctagaactagtggatcccccgggctgcaggaattcgtctcaccccgaaaaagattttcacccaaccctaagcccctcctccctcgtaatcccactccagccgccgccgcgccgccgcctctagcctccggatccaatccagcatcgccgccgcaaaccatgggcttcgacgtgggcgtcgtcccgttcaaccccgacggctggggtcctcctgacgtcccggcgattccgcagtctctggggggcggtgcctccatccccttcgcgcccttctcccgctccgacaagctgggccgcatcgccgactggacgcgcaaccacgccggtcccgccgccttcgccgcggcgtcacgggactccgtattcgacttcacctccgcggacgactcgctcgtcgccggggccgaggactcctcgttccgcctcgtcgatgctaagccgcagccgcggccgcaacggttcggccccaagtggcgcttcaaccagcgccagcagctcccacagcgccaagacgaggaggtgggagcgcgccgccgcttggccgagaaggagcgcgcacgccgcgatcgccacttccagaacaaccgctcacatcaccaccctgggcttcgggggcaacagccttcgtcgtcagcaaagccctccgtcgacatccagcccgactgggacatgcgcgagcagatccccttcgcaaactcaccaacttcccttttcgtgttcgacaagcccaaggatctctcttatggggggccgtcagtctacaatgggccct

SEQ ID NO: 81741 - protein, 204 aa, Zea mays
  misc_feature: Ceres CLONE 1567303
MGFDVGVVPFNPDGWGPPDVPAIPQSLGGGASIPFAPFSRSDKLGRIADWTRNHAGPAAFAAASRDSVFDFTSADDSLVAGAEDSSFRLVDAKPQPRPQRFGPKWRFNQRQQLPQRQDEEVGARRRLAEKERARRDRHFQNNRSHHHPGLRGQQPSSSAKPSVDIQPDWDMREQIPFANSPTSLFVFDKPKDLSYGGPSVYNGP

SEQ ID NO: 81742 - DNA, 833 bp, Zea mays
  misc_feature: Ceres CLONE 1567305
  misc_feature: Encodes the peptide sequence at SEQ ID NO. 81743
  misc_feature (673)..(673): n is a, c, t, g, unknown, or other
  misc_feature (674)..(674): n is a, c, t, g, unknown, or other
  misc_feature (678)..(678): n is a, c, t, g, unknown, or other
ccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgaagatggtgtcccaccccaacatcgtggagctgcacgaggtgatggccacccgctccaagatctacctcgcgctcgagctcgtccgcggcggggagctcttctcccgcatcgcgcgcgcggggccgggtccgggaggacnntgcncgctgttacttccggcagctcgtcgccggcggtcgacttcttgccacggcggcggggtgtttccacggaaaccctgagctcgagaaactgctcctcgacgaagtagggcacctccaagggggcggactttgggctcagcccccttcgccggggat

SEQ ID NO: 81743 - protein, 142 aa, Zea mays
  misc_feature: Ceres CLONE 1567305
  misc_feature: SWISSPROT Homolog: EC 2.7.11.1 Non-specific serine/threonine protein kinase
  misc_feature (116)..(116): Xaa is any aa, unknown, or other
  misc_feature (118)..(118): Xaa is any aa, unknown, or other
MEDAMAADGKSVLQGRYELGRVLGHGNFGRVHAARDLRTGRSVAVKVVAKDKLERAGMAEQIKREIAVMKMVSHPNIVELHEVMATRSKIYLALELVRGGELFSRIARAGPGPGGXCXLLLPAARRRRSTSCHGGGVFPRKP

SEQ ID NO: 81744 - DNA, 849 bp, Zea mays
  misc_feature: Ceres CLONE 1567311
  misc_feature: Encodes the peptide sequence at SEQ ID NO. 81745
tccccgcggtggcggccgctctagaactagtggatcccccgggctgcaggaattcgtctcacccctagaaaaacccccgcctcgccctccgtcgtctcagcgtatgttgtgcatgtgaagagagagaggaagagggtgacgagcgagaaaaaagctaatagagtgataggttgacaagacgcattgaagctaaggccacgcataccaaagcaacctcaccatcgctcgcaagctactcgatcaaggacattattgtcgcaacgagctagctaggatccgcgcgttagtttcgcgaagcggtggtacatatggctcgcatcctcgtgctggctctggtcaccatcgcgagcctcctcctgccgccggtcgtcgcgagccagcaggcggcggccaagtgcgagtacagaaagcactccggccaccggtacaggcacccggtgggcgtgcggaagatcgtggtggacgcgggcggcgccggcgatttcgtctccatccagcgcgccgtcgactccgtgccggagggcaacaccgtgcgcgtcgtcgtgcagatcaacgccggcacgtacatagagaaggtggtagtgccggcgtcgaagccgtacgtcacgttccagggcgccggggcgcgacgtgacggtgggtgaagtggcacgaccggggccagcgaccgcgggccccgacgggcaagccgcttcgaacttacaaaaaccgcctcaggtaacccatcctagcctaactattttcaagcctaaagaacatccagccttcaaggtggagcagcccgttttgccccagccagaccaccccagtaacttgggcccaaaaaaacaaatgggtgcaaccaggggg

SEQ ID NO: 81745 - protein, 111 aa, Zea mays
  misc_feature: Ceres CLONE 1567311
  misc_feature: SWISSPROT Homolog: EC 3.1.1.11 Pectinesterase
MARILVLALVTIASLLLPPVVASQQAAAKCEYRKHSGHRYRHPVGVRKIVVDAGGAGDFVSIQRAVDSVPEGNTVRVVVQINAGTYIEKVVVPASKPYVTFQGAGARRDGG

SEQ ID NO: 81746 - DNA, 1064 bp, Zea mays
  misc_feature: Ceres CLONE 1567312
  misc_feature: Encodes the peptide sequence at SEQ ID NO. 81747
  misc_feature (11)..(11): n is a, c, t, g, unknown, or other
  misc_feature (12)..(12): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttttgcccnncccccccccaactgccaccaagccagacctaaagacaatcccnncnnnnnnnngaaannnnnaacaactggagctccccgcggtggcggccgctctagaatagtggatcccccgggctgcaggaattcgtctcacccctagaaaaacctggaacacacgcaccgtcccaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccaggtgctcgtggcggtctccctcgcctacgcggtcgcccgtgctgctcctcgagtcgccccctcgtgtccacgtcgctgccccggggccgggggccgtccgcccgcgggcgtcgcggaaaacctccaccctcaaacggcccccttggggaagggccccgggaaccaaacaaaccgcccgggcgccgccccccgcgtaaaagcaaccccgccacaaggggaagaaccccctccttccggccggaaaaccccggggggcctgcgggaaacacggggcacgccccccaccggttttgggcccgggggaaattctctttctttgtggggcctccgaaaggtttccgggcacaacctttaaaaattcccaaccccgggttcccgggggttccttctctccaaaaaaagggtccgccccccggaaaaaggcccgccccaaaaattcaggggggccccccccctgtttttcccctcgcaaacttgggaggaggttctctaaggaaaacggcccctttgatacttttttcctgcggggcggaaattttcccccggggggtggggggaggagcgggcagaagaagcccttgcgccccccctccct

SEQ ID NO: 81747 - protein, 135 aa, Zea mays
  misc_feature: Ceres CLONE 1567312
MRRPSGAGVPSRRRRAIQVLVAVSLAYAVARAAPRVAPSCPRRCPGAGGRPPAGVAENLHPQTAPLGKGPGNQTNRPGAAPRVKATPPQGEEPPPSGRKTPGGLRETRGTPPTGFGPGGNSLSLWGLRKVSGHNL

SEQ ID NO: 81748 - DNA, 874 bp, Zea mays
  misc_feature: Ceres CLONE 1567315
  misc_feature: Encodes the peptide sequence at SEQ ID NO. 81749
  misc_feature (247)..(247): n is a, c, t, g, unknown, or other
  misc_feature (250)..(250): n is a, c, t, g, unknown, or other
  misc_feature (363)..(363): n is a, c, t, g, unknown, or other
  misc_feature (375)..(375): n is a, c, t, g, unknown, or other
  misc_feature (384)..(384): n is a, c, t, g, unknown, or other
tggcggccgctctagaactagtggatcccccgggctgcaggaattcgtctcacccctagaaaaagactgcgccacacccacaccgcactccgcaccaaccaaccccggccggccagcccacgagccccatcccgccatccgcccgcgcggcgagcgcagagccgagccgagctgccggaacgcaggcagcggccaccgggaggcctccgaaacgcagcggaacacctgaggaggcggcttcctcggncgnaaatggctctaggaggaggcgcggcgccggcggagatggggtccaagtacacgcgcgggtgctgcggctggctgatcgtggcgctgattgcggcgctggtggccacggccgcngatgttcgccantcatgaaangcgcaaggcccgggggggtccgccccaccatcaaagcccgctgccgggtgccgggggccgcccggggggccatcggacttccaagtaccggcgaaccgcgcctcggggggtccccgccgcaagttcttcccaggtccaaaaaggcggggaaaactgggaaaacaaccagaatccccgggggcgtgggggactccggcctttaacccaccggaaaaggaaacgggggcttgggtttttttcccaggggaaatttttaaagccgtgggggaacccaagaaaaggttcccccttcccccaaggggggtttttcgggggaagggggggtctccctggggggggggggggggggaaaccggggggaaaaaaaataagggcgggggaaaaaaaaagggggggcccccccccccccccctgggccccggggaggggggaatatcaaaaatttttcttttttgtgggggggcaacaccccctttttggaaagagggtg

SEQ ID NO: 81749 - protein, 42 aa, Zea mays
  misc_feature: Ceres CLONE 1567315
  misc_feature (41)..(41): Xaa is any aa, unknown, or other
MALGGGAAPAEMGSKYTRGCCGWLIVALIAALVATAADVRXS

SEQ ID NO: 81750 - DNA, 839 bp, Zea mays
  misc_feature: Ceres CLONE 1567317
  misc_feature: Encodes the peptide sequence at SEQ ID NO. 81751
ctcaccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaaccggagctgttcgagcctctcaagtccggccagaacccccagtacatgggggttcgcctgctccgactcccgcgtgtgcccgtcggtgaccctgggccctgcagccccgggaaggctttaaccgtccgcaaaatcgccctccatggtcccaccctaccacaagatcaagaacgccgggcaaagggtcccccaatccaatacccccctggggccccccccaaggggcagggtcatcgggggtcatttggccca

SEQ ID NO: 81751 - protein, 110 aa, Zea mays
  misc_feature: Ceres CLONE 1567317
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKNRSCSSLSSPARTPSTWGFACSDSRVCPSVTLGPAAPGRL

SEQ ID NO: 81752 - DNA, 841 bp, Zea mays
  misc_feature: Ceres CLONE 1567318
  misc_feature: Encodes the peptide sequence at SEQ ID NO. 81753
  misc_feature (455)..(455): n is a, c, t, g, unknown, or other
  misc_feature (545)..(545): n is a, c, t, g, unknown, or other
  misc_feature (619)..(619): n is a, c, t, g, unknown, or other
agctccccgcggtggcggccgctctagaactagtggatcccccgggctgcaggaattcgtctcacccctagaaaaagcgtgagatctcaccttcgcctatctgttcatcgtccccccttcgtcctcctccccgaccccgacgtgcgacatgaacgggaagcagagcccgcggaatggccgaactgcgtaccacttccagcctgccaagaactggatgaacgacccaaatgggcctctgtaccacaagggcatgtaccacatgttcttccagtacaacccgcacggcccgacgttcggcaccgggaagctctcctggggccactccgtctccggcgacctggtgaactgggcgttcctgggcaccgcgctggacccgacgtcgccgttcgacgccgagggctgctggtcgggctccgccaccacgctggcggacggccgcccccgcatcctctacnacgggcgcgacgcaagcggcgtgcaggtgcagaacgtggcgttccccaagaacccgtcggacccgctgcttcggggagtggcgcaagccngcccggctgcaacccggtggtcccgcagccgggcgacgtgacgggcaacaacttcggggaccccaccaccgccntgcttgggggcccaacgggcctgtggccggttcccccttcccggcccaaggtcggggggggtggggcttccccccctggggggtaccccaaacaaaggaatttctcttgccccttgggaaaggggggggttttccccccccccttttaacccctgtcccccccaaaaaggtgcccccttttgggggaaaggtccccccggaaccttgtttttccccgggggg

SEQ ID NO: 81753 - protein, 145 aa, Zea mays
  misc_feature: Ceres CLONE 1567318
  misc_feature (15)..(146): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature: The sequence is a functional homolog of SEQ ID NO 4 in US patent 7253335
  misc_feature (103)..(103): Xaa is any aa, unknown, or other
  misc_feature (133)..(133): Xaa is any aa, unknown, or other
MNGKQSPRNGRTAYHFQPAKNWMNDPNGPLYHKGMYHMFFQYNPHGPTFGTGKLSWGHSVSGDLVNWAFLGTALDPTSPFDAEGCWSGSATTLADGRPRILYXGRDASGVQVQNVAFPKNPSDPLLRGVAQAXPAATRWSRSRAT

SEQ ID NO: 81754 - DNA, 816 bp, Zea mays
  misc_feature: Ceres CLONE 1567319
  misc_feature: Encodes the peptide sequence at SEQ ID NO. 81755
  misc_feature (500)..(500): n is a, c, t, g, unknown, or other
  misc_feature (653)..(653): n is a, c, t, g, unknown, or other
  misc_feature (727)..(727): n is a, c, t, g, unknown, or other
ctcaccgcggtggcggccgctctagaactagtggatcccccgggctgcaggaattcgtctcacccctagaaaaatcgtcggctcctctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgcgccgggaaggtgctcatgaacgatttccagtctaaagagctccccaacacccgcatcgagcccgaccgccggtggttcggcaatactcgcgttgtgggccagccacagcttgaaatgttccggggagaactccagagtcggctttccnacaacttcagtgtcatcctgaaagaacggaagctgccactatcgctcctgcaagatcatcaaaagcaagcgaaggcacatctgctttgaagtgaaccttttgagcatgcttttgggccaaagggcaagaggaaacgtccccgaactactgctnctgactacgaatctttgctgaagagagctgatgattccccagatgtggtttgagcaaaagatgcttcatcaaanttcccaggggagaaagagaagatgggctacgtgatctagtgaggcatacattggttgagaagggaagaagcaaaagaatcggggtggag

SEQ ID NO: 81755 - protein, 136 aa, Zea mays
  misc_feature: Ceres CLONE 1567319
  misc_feature (49)..(135): Pfam Name: NGP1NT Pfam Description: NGP1NT (NUC091) domain
  misc_feature (108)..(108): Xaa is any aa, unknown, or other
MAKKKEKAVNVSGKPRHSNDVNRPNDKKGAGGGAGGGSRSAATVRRLKMYKTRPKRDRAGKVLMNDFQSKELPNTRIEPDRRWFGNTRVVGQPQLEMFRGELQSRLSXNFSVILKERKLPLSLLQDHQKQAKAHLL

SEQ ID NO: 81756 - DNA, 771 bp, Zea mays
  misc_feature: Ceres CLONE 1567322
  misc_feature: Encodes the peptide sequence at SEQ ID NO. 81757
  misc_feature (363)..(363): n is a, c, t, g, unknown, or other
  misc_feature (364)..(364): n is a, c, t, g, unknown, or other
  misc_feature (373)..(373): n is a, c, t, g, unknown, or other
  misc_feature (387)..(387): n is a, c, t, g, unknown, or other
  misc_feature (433)..(433): n is a, c, t, g, unknown, or other
ggagctccccgcggtggcggccgctctagaactagtggatcccccgggctgcaggaattcgtctcacccctagaaaaaagccccacaccgcttcactcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggcgccaaccacgcccatcaaggacggcgccgcnnctcgacttncgccgccgcgctcntcgaggaggagcgcacaggcagcagctgcagtccatcagcgcgtcngtggcgtctctgacacgtgaaacggggcgaaagtggtcaaggcgacccggccggaaggggcgagcccccgcgacgggtgaccgccaagccccaagggcacaacaggaacaacaacccggcggccccaaaattggggtgtagggacaggtttcctaaaggttaccctgtttcctttaaaaaacttttccccctggggaaaccttgtacaaagccggggcctttaattttccaaaaagggggggtgttttttatacaagttcccccccggggggcccctttgtgggaaaactcttttttcgggggccccacaaaaaaaagcggggggggggggttcccct

SEQ ID NO: 81757 - protein, 87 aa, Zea mays
  misc_feature: Ceres CLONE 1567322
  misc_feature: SWISSPROT Homolog: EC 4.1.1.49 Phosphoenolpyruvate carboxykinase (ATP)
  misc_feature (59)..(59): Xaa is any aa, unknown, or other
  misc_feature (62)..(62): Xaa is any aa, unknown, or other
  misc_feature (82)..(82): Xaa is any aa, unknown, or other
MATPNGLARIETNGATKPDNGVCHDDSSAPVRAQTIDELHSLQRKRSAPTTPIKDGAAXRLXPPRSSRRSAQAAAAVHQRVXGVSDT

SEQ ID NO: 81758 - DNA, 784 bp, Zea mays
  misc_feature: Ceres CLONE 1567332
  misc_feature: Encodes the peptide sequence at SEQ ID NO. 81759
tccccgcggtggcggccgctctagaactagtggatcccccgggctgcaggaattcgtctcacccctagaaaaaaacccccgaccccgaagccccaaacccctaccaccatttcccgggagtctcctttcccggagagtggatccgccactccaatctgcaccattctataaggaaaacctagatccggactcctagccgtcggccatggccacgcgccgggccttctcgtccatccttcgctctgcctctcgcattcgctccgcctcaccgtccccatgcccgcgtgcgccgctccaccaccgcccgtcccccgcgggcttcatactcaaccgtgtagccgcctacgcctcctccgccacggcccaggccgcgcccgctccgccacctccttcaaccggcaagaaaaccggtggcggcaagatcaccgatgagttcaccggcgctggcgccatcggccaggtgtgccaggtcatcggcgccgtcgtggacgtgcgcttcgacgaggggctgcccccgatcctgacggcgcttgaggtgctcgacaacaacattcgcctcgtgctcgaggtggcgcagcacctcggggagaacatggtccgcaccatcgccatggacgggacagaggggcttgttcgcggccagcgtgttctcaacaccgggtctcccatcactgttcctgttggtagggcaacgcttggacgcattataaatgttattggtgagcctattgatgagaagggagatataacaacaaaccacttcctccctattcatcgttgaacc

SEQ ID NO: 81759 - protein, 191 aa, Zea mays
  misc_feature: Ceres CLONE 1567332
  misc_feature (86)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MATRRAFSSILRSASRIRSASPSPCPRAPLHHRPSPAGFILNRVAAYASSATAQAAPAPPPPSTGKKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDITTNHFLPIHR

SEQ ID NO: 81760 - DNA, 777 bp, Zea mays
  misc_feature: Ceres CLONE 1567337
  misc_feature: Encodes the peptide sequence at SEQ ID NO. 81761
  misc_feature (717)..(717): n is a, c, t, g, unknown, or other
tccccgcggtggcggccgctctagaactagtggatcccccgggctgcaggaattcgtctcacccctagaaaaaactcctcccgttcagcaggtccagcagcgttcgtttcgttgctccacctccactcatcagatccatccacgcgagagaccgaggcaggcagccatgccgctgccgctgccgctgccgccgctcctgctctgcgtctgcgtctgcgtctgcctctgcctctacctcacccacctcccccgcctcgcctcctccgagcccgacgccgacaaggcggcgctgctggcgttcctcgccggcgtgggccgcggcgccaccgcgcgcgcgcgcatcaactggcccaccaccccgctcgcctgcgccggccccggaccgggctggacgggagtcacctgcagccccgacggcgcgcgcgtcgtggcgctgcacctcccggggctgggcctctcgggcaccgtgcaacccggcacgctcggccgcctcacggcgctgcagctgctcagcctgcgctccaacaacctgtcgggcccgctccccgccgacctcctgcgcctgcccgcgctcgcggggctccacctccaccgcaacgccttctccggcgcgctcccgcccgggctcgcggggctcgccgcgctccaggcgctcgacctctccctcaacggcttcggcggcggcatccccggcgcgctcgccagcctcacccgccntttgcgcgctcgacctctccaacaactcgctctccggccgcgttcccggaccttcggctt

SEQ ID NO: 81761 - protein, 203 aa, Zea mays
  misc_feature: Ceres CLONE 1567337
  misc_feature (184)..(184): Xaa is any aa, unknown, or other
MPLPLPLPPLLLCVCVCVCLCLYLTHLPRLASSEPDADKAALLAFLAGVGRGATARARINWPTTPLACAGPGPGWTGVTCSPDGARVVALHLPGLGLSGTVQPGTLGRLTALQLLSLRSNNLSGPLPADLLRLPALAGLHLHRNAFSGALPPGLAGLAALQALDLSLNGFGGGIPGALASLTRXLRARPLQQLALRPRSRTFG

SEQ ID NO: 81762 - DNA, 816 bp, Zea mays
  misc_feature: Ceres CLONE 1567339
  misc_feature: Encodes the peptide sequence at SEQ ID NO. 81763
  misc_feature (656)..(656): n is a, c, t, g, unknown, or other
ggagctccccgcggtggcggccgctctagaactagtggatcccccgggctgcaggaattcgtctcacccctagaaaaacttccccgtgaccccgtttcctccagtttcctaccttcctctcgtcccagcagccgcaagccaaaaccctagcaagcaaaccaccggagcagcggcgctcgcgcgggcggagccatggcggacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgagcgcaaaacaacaaaatatatgacgaagtatgaacgtgcgcgcattcttggtacacgagccttgcagataagcatgaatgctccagtcatggttgagcttgagggagaaactgaccctcttgagattgcgatgaaggagcttagagcgcgcaagatacccttcacgatcagacggtacctacctgatggaagttatgaagactggggagtagacgagctcattgtggaggactcctggaaacgccaggttggtggagactgaagatgctgatctacttggcatggaaaggatgtgtnagtacaggtcttcgttgcctctgagtggatgctgaacagtgaatgaactaggacgaaacgatgctatgctagatgttaccctgacgtctgtgggttgcttggaactctggaaacgttgatggctggtggacggttggttgaagtaatgcctgggtcgttc

SEQ ID NO: 81763 - protein, 142 aa, Zea mays
  misc_feature: Ceres CLONE 1567339
  misc_feature (61)..(114): Pfam Name: RNA_pol_Rpb6 Pfam Description: RNA polymerase Rpb6
  misc_feature: SWISSPROT Homolog: EC 2.7.7.6 DNA-directed RNA polymerase
MADDDYNEIDMGYEDEPPEPEIEEGAEEELENNEDAPDDVIGGEGEDKEQEKTKRERKTTKYMTKYERARILGTRALQISMNAPVMVELEGETDPLEIAMKELRARKIPFTIRRYLPDGSYEDWGVDELIVEDSWKRQVGGD

SEQ ID NO: 81764 - DNA, 803 bp, Zea mays
  misc_feature: Ceres CLONE 1567340
  misc_feature: Encodes the peptide sequence at SEQ ID NO. 81765
ggagctcaccgcggtggcggccgctctagaactagtggatcccccgggctgcaggaattcgtctcacccctagaaaaaaatccaccccttccccgacgaggcaggcagggcaccacgccattctcgcgcgaggagagggcacaggaaagaaagaaaaaaaatcacctccttcaacctctccccctcctccaccgaaatcatcctccagaatctcccgatctttactccgccaaagatcctatacacgcgcggctatttgtagcgtctgccctgccctgcccggcctcgtggaaaggcgctccgctcttggctctccccacatgcgggcgggggctgttggttcgggggggaggcagtcaaatccgcctgcggctgaatcgggggagaggggccgcatggcggaggagaacaggcagcagcggcggcggcggcggcggttcgcgaacctgcgcagcgtccggtggcggatcgatctcggcatcctgccggcgtcgcccggggcctccgtcgacgagctccgccgcgccgccgcggattcgcggaggaggtatgttagtttgaggcgccgccttatggtagacccgcatcttccaaaggaggaggacagatcatccaaccttgttgttgacaaccccgctctctcagaccccagatagcagcctggggccgcttctttagagggggctgagttgggagaagacagtttgaccaaagaccggttctcgattaaatcccagaaagaatggtaggttacttttcaaaacggccctagttgcccaggcccgtgcctcacgggaggaaac

SEQ ID NO: 81765 - protein, 86 aa, Zea mays
  misc_feature: Ceres CLONE 1567340
MAEENRQQRRRRRRFANLRSVRWRIDLGILPASPGASVDELRRAAADSRRRYVSLRRRLMVDPHLPKEEDRSSNLVVDNPALSDPR

SEQ ID NO: 81766 - DNA, 848 bp, Zea mays
  misc_feature: Ceres CLONE 1567345
  misc_feature (486)..(486): n is a, c, t, g, unknown, or other
ggagctccccgcggtggcggccgctctagaactagtggatcccccgggctgcaggaattcgtctcacccctagaaaaaactccaccctctctctccattgtctccattattttctctctcctccgtctccaccccctttattctctctctcccagctcctcctccctgtctgctcccctccacatccactgctgtggcgctctccctctcccgtctccccttaccttctccacctcccccattccgccaccgcacaagccgacctccctcaccaagaggagaaaagaaagggagagcgaaggaggcaaaccaggtgggacagcaacgcgacgtgcttgctattctctctagttggatgctgagtggcatgccggtcgatatttgggaaagcagatttttatgttggcaagtgtgagtgcgagttctttgctgaaactttaagcttcacctgagatctgatattgtcggtgccaaaatgctgtacanttgactatttgaggacacgttcttaggagctcatgcaaggtgtaagtcttactgcaagaagggcagctgtgcatgttaagacccatacatagcttctcttgatacccaacacggggggggaaaaattgaaaaacaatttgatctcctgggttcaaaaaaaggggttcaagggtttgcctccaatcagcctgagcaaaggccctgtatgtttttgggtcaaccttaacaaaccaaggggaaaggcccccacaccttttttcccacgggagaggcccaaaacgggggggggaaccccagaaaatccggaaaacctgggggaaaaaattttaatcctccctgtttaaaaaaaaaaaaaaaattga

SEQ ID NO: 81767 - DNA, 832 bp, Zea mays
  misc_feature: Ceres CLONE 1567350
  misc_feature: Encodes the peptide sequence at SEQ ID NO. 81768
ccgcggtggcggccgctctagaactagtggatcccccgggctgcaggaattcgtctcacccctagaaaaaactttcgcaagcccccttccgaccttgcccctgcggtctcccgagtcccgaagcatccccttccaaaaccctcgccgcgccgcagccacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagtgcaaaagctgctggaaatgaggttattgggattgatttggggacaacgaactcatgtgtttctgttatggagggaaagaacccaaaagttattgagaatgctgaaggtgcgagaacaacaccatctgttgtcgcatttactcagaagggtgaaagacttgttggaactccagccaagcgccaggcagtaaccaacccccagaatactttctttggaacaaagaggttaattgggcgacgctttgatgatccacagacacagaaagagatgaagatggtgccatacacaatcgtgaagggctccaatggtgatgcttgggttcaaacaacagatggcaagcagtactcacaagtcaggtcggtgcatttgtgctggaccagaaggaaggaaacagctgaatcctaccttgggcaagtctatctcaaaggcaggggattactgttccggcttatttcaaaggaccttcagcgtcagggccaaaaaggaagcaagcccgc

SEQ ID NO: 81768 - protein, 211 aa, Zea mays
  misc_feature: Ceres CLONE 1567350
MAASLLLRAVRRRELASPLGSLGASIQSTCVANICSKWGRFARPFSAKAAGNEVIGIDLGTTNSCVSVMEGKNPKVIENAEGARTTPSVVAFTQKGERLVGTPAKRQAVTNPQNTFFGTKRLIGRRFDDPQTQKEMKMVPYTIVKGSNGDAWVQTTDGKQYSQVRSVHLCWTRRKETAESYLGQVYLKGRGLLFRLISKDLQRQGQKGSKP

SEQ ID NO: 81769 - DNA, 810 bp, Zea mays
  misc_feature: Ceres CLONE 1567352
  misc_feature: Encodes the peptide sequence at SEQ ID NO. 81770
ggagctccccgcggtggcggccgctctagaactagtggatcccccgggctgcaggaattcgtctcacccctagaaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcacaacgagcaggtcgcggcggcggcgtcgcgcgcgtcctacgcgctgctgtgggtgcgccggaacgtggcggcgtaccaccggccacgcagatccagggcatcgccgggggcaacaaggtgttcccgtcggccagaacgtgacggcgcagctggtcccggccatggacaaagtggaaggccgggccccccagcccccccctcaagggggcccgaaagggggtggccccccattgggggtaacgggggtttgggttggtcctaccccgtcccttgggggggggcggttccggggggggacctccccggcaggggccgccttggaaaccccaggggtccaaatttcctgggggggaaaaaaccgggggcgggaccccctctgggggggaaaaacccgtacaccccgggttttttttgcggattatacccccg

SEQ ID NO: 81770 - protein, 225 aa, Zea mays
  misc_feature: Ceres CLONE 1567352
  misc_feature (29)..(219): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALHNEQVAAAASRASYALLWVRRNVAAYHRPRRSRASPGATRCSRRPERDGAAGPGHGQSGRPGPPAPPSRGPERGWPPIGGNGGLGWSYPVPWGGAVPGGDLPGRGRLGNPRGPNFLGGKKPGAGPPLGGKNPYTPGFFCGLYP

SEQ ID NO: 81771 - DNA, 775 bp, Zea mays
  misc_feature: Ceres CLONE 1567353
  misc_feature (284)..(284): n is a, c, t, g, unknown, or other
  misc_feature (285)..(285): n is a, c, t, g, unknown, or other
  misc_feature (304)..(304): n is a, c, t, g, unknown, or other
  misc_feature (305)..(305): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (327)..(327): n is a, c, t, g, unknown, or other
  misc_feature (328)..(328): n is a, c, t, g, unknown, or other
  misc_feature (346)..(346): n is a, c, t, g, unknown, or other
  misc_feature (367)..(367): n is a, c, t, g, unknown, or other
  misc_feature (699)..(699): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
tccccgcggtggcggccgctctagaactagtggatcccccgggctgcaggaattcgtctcacccctagaaaaaagagtccaagccaacgccgatcgagagcccgcatatctatatctcgctcgccgcggcaggcagagaggtggggtgccggccggcggcgaggagaaggtggaggagcacgtacgtgagttgggcgcggcgatgtcgcggttcgtcgacaagctgccattctttgaccggaggtcgtcgctgatggaggaggccgggggacattccgcggagnncggcctcctgcacatgcannccaccaccagnnnccgcaccanncagcggccctggcctcantgggcagcccgccaggcccgntccgcccgcccgggccgaaagccaagttcgttccgttttcaccgccttccccgccaaacctttgcttgaaaaccccccctttcaaacgaaaggggggggcgcaaaaggaaaacccccttttctttgcgccccccagagtttttctttgcccccccaggggaaattttgggaataattaaaaacccccttttttaaaattttgggggggggggggggtctcctccctttgtgcgccgggggggggggtccctcccccaccgggggggggggggggggcccccccttttttgtggggggggggggggggcgcccccctttttattttttccccngggggggggggggggggngnnnnnnnnnaaaaaaaaaaaaaaaaaagagagggggggccccccccccccccccccc

SEQ ID NO: 81772 - DNA, 983 bp, Zea mays
  misc_feature: Ceres CLONE 1567355
  misc_feature: Encodes the peptide sequence at SEQ ID NO. 81773
  misc_feature (1)..(1): n is a, c, t, g, unknown, or other
  misc_feature (2)..(2): n is a, c, t, g, unknown, or other
  misc_feature (17)..(17): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (93)..(93): n is a, c, t, g, unknown, or other
  misc_feature (983)..(983): n is a, c, t, g, unknown, or other
nntttttttcttcttcncccacccagcgcccccgcgcagctctttctttttnnntcnnngnngaggggtannnnnnnntaacnnnattcaccncggtggcggccgctctagaactagtggatcccccgggctgcaggaattcgtctcacccctagaaaaccgcagacagccaggcacactcgcgcgaccatgtaccgggcggcggctgtcatctcgaggtcctcatcagcactgcggaggcagctcgcgcggggcgtggccggggagctgccgcgtctgttggcgcgagggtatgcggccacggcgaaggaggtgtccttcggcgttggcgcccgcgccgccatgctgcagggcgtcaacgacctcgccgacgccgtcaaggtcaccatgggccccaaggggcgcactgtgatcatcgaggggtcccataaaggtcccaaggtcacgaaggacggggtcactgttgcaaaaagcgtggagttcgaggatagcgcgaagaatgttggggcgaatctggtgaagcaagttgctgatgctacaaacaaagctgcaggggatggtaccaccttgtgcaactgtgcttacacaggcaattcttactgaaaggatgcaaggccgtgggccagccggtgtcaaacgttaatgcaccttgccggaaatggtaataaacaaggccaataaaacggctattccactggctccccctccaaaaggtaaaagcggtgggaagaaataaatttctcccagaaacaaaatttaacccagggtgaagcaaaccatttttcttgccaaacgtggtgaaaaaggaaacaatgggaaaaatcctaaataatccaaaaaggcctactggaaaaaacactctggaaaagggaatggagagtccatttaaccaatttggctgaaacggccaaaaaacaaattgggcgacaacattcaagcctttggaaaacccacctaccgacgggcaaaattgaaaagcctcn

SEQ ID NO: 81773 - protein, 137 aa, Zea mays
  misc_feature: Ceres CLONE 1567355
MYRAAAVISRSSSALRRQLARGVAGELPRLLARGYAATAKEVSFGVGARAAMLQGVNDLADAVKVTMGPKGRTVIIEGSHKGPKVTKDGVTVAKSVEFEDSAKNVGANLVKQVADATNKAAGDGTTLCNCAYTGNSY

SEQ ID NO: 81774 - DNA, 847 bp, Zea mays
  misc_feature: Ceres CLONE 1567356
  misc_feature: Encodes the peptide sequence at SEQ ID NO. 81775
  misc_feature (673)..(673): n is a, c, t, g, unknown, or other
ccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtcccttgcctacttcaacgactcacagaggcaggcccacnaaggatgctgggggtgattgcctggcctcaatggtgctggcgtatcatcaatgagcccaccccctggctgctaattgcctatggggccttgaccagaaggccaacccagcgtccggtgaagaaaaaatgttcttcatcctttgaaccttggaaggggggtaccctttcgatgtt

SEQ ID NO: 81775 - protein, 220 aa, Zea mays
  misc_feature: Ceres CLONE 1567356
  misc_feature (9)..(215): Pfam Name: HSP70 Pfam Description: Hsp70 protein
  misc_feature (163)..(163): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPCLLQRLTEAGPXRMLGVIAWPQWCWRIINEPTPWLLIAYGALTRRPTQRPVKKKCSSSFEPWKGGTLSM

SEQ ID NO: 81776 - DNA, 799 bp, Zea mays
  misc_feature: Ceres CLONE 1567357
tccccgcggtggcggccgctctagaactagtggatcccccgggctgcaggaattcgtctcacccctagaaaaaacccggtctccagaacagacaacccgtccttctccttcccatcggctccacacaaccagaaggttcttcgcttcactctgccctgcgccgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaaggtcactcacttctgtcaaacttatcccggttttgtagaaacttctttttgtagttttttccatgttttcccttgagccttgaaggcttggcaagccaatgtaagaaccttgtcattcatatggtgatgaaactcaagagaatagctttatattgttttattgatttatttatgtgctcactaacttattgtggagggtgatagttcaaaacccacttaaattcgcttcacaaatatcttcatcaaatgttgtgtgggcaacttctttcccattttgttaacttggttttttcaccggggaattgacttttaagggctttggcggcgtaaaaaatattgattgggggggggaaacttttaaattttaaaaagattgccaacttttttacccaaaagggggttgaaaggttaatttcttaaagctttcccccccatttggctaatgtcgaaaaaaa

SEQ ID NO: 81777 - DNA, 965 bp, Zea mays
  misc_feature: Ceres CLONE 1567358
  misc_feature: Encodes the peptide sequence at SEQ ID NO. 81778
tgtgtgtttgcttcccccccctcatcccccaccgtcccgcgtctccctccctcccttgaggtggatataaaaataaacaaagctggagctcaccgcggtggcggccgctctagaactagtggatcccccgggctgcaggaattcgtctcacccctagaaaacgtccccaacttctccctgcgtcggccgatgctgcggcgacatgaccacaaggtttcgaaccctctccagcggagggaacggggttagcgagcggcctccgctgcgacggcaacgcaacggcgtgggagggccatggcggcccccgcgctcgccttccccatgttgctggctgcctcactgctctccgtcgccgctcctgcgctggctcgaagcccatcttgccctgatggttggcaaggcggccctgttcagaacagatgcttcatgtacatatcagcctccctttcttgggatagatccgaggctgtctgccataactacccccggcatctcgctgcaggatcatcaatccaagagctaaacttcgtgaagtctctctgtggatcatcatccacaggatgctgggttggagggcatcactacagcactagtaccggtaacggttgggaaatggcctgatgattccctctggttggaaacgaaactgttcttcccttgggggaggccattggcctggacaactggaggatggattccctggcatttaaaagttaccccaccagtcaaccaaatttgggggttatttttgggttcacccaattgggtccagccctgtcaaacttatttacctggaaaaaaaaggggggcaggggggagaccccccatggggtcctggaattctcggctcgggattgaaaaccccccgttgggcacccaatatggccttccccttggaaaaccatttgggccacaaccccgggggagcataattttccattaggacccacatctgacacggcggg

SEQ ID NO: 81778 - protein, 108 aa, Zea mays
  misc_feature: Ceres CLONE 1567358
  misc_feature: SWISSPROT Homolog: EC 3.4.21.84 Limulus clotting factor C
MAAPALAFPMLLAASLLSVAAPALARSPSCPDGWQGGPVQNRCFMYISASLSWDRSEAVCHNYPRHLAAGSSIQELNFVKSLCGSSSTGCWVGGHHYSTSTGNGWEMA

SEQ ID NO: 81779 - DNA, 793 bp, Zea mays
  misc_feature: Ceres CLONE 1567360
  misc_feature: Encodes the peptide sequence at SEQ ID NO. 81780
ccccgcggtggcggccgctctagaactagtggatcccccgggctgcaggaattcgtctcacccctagaaaaagctacacgttcgcttgatctttacggccgccgctactcgttcgccatggctgcctgctcctccaggctcctatacctcactctgagctcctctttcctccgctcctgccgcctcgcgtccagctccctacttcccaccgcctcccgctgccacccggggtcgctccactccctccgcttctgctctgctgtccccgagtttgtcgatgtcgccgccgaccctgccgaggcggctgtatcctccggacacccgtggccggagtggggcaacttccttgataagctgcgggccaaggggtacttcgagcaaggtttgccctccagcgtgagttctggcgagggagccgccggagatggggatccagcaactgcatctgagaacgcagcaacggctgcttccggtaatacggtggtggatgcggaggatagcgcggtgacctcggaagatatctatcattttctcaaggacgagaacagggtgaagaatgcgtgcctcaaatttgggcgagaccgcttcgatctcctcaggtggaagaaaccttgcgactcttttcctctttccctctatagaggaaatcaatttctcggtcgcgtactttattatgtaatatttaggatacatggatctcggatttcagtttttcggatgctgcacgaattatcatgccacttatttagtggagatgcagcccgcaattgcttactaggcctttttggtgtca

SEQ ID NO: 81780 - protein, 225 aa, Zea mays
  misc_feature: Ceres CLONE 1567360
MAACSSRLLYLTLSSSFLRSCRLASSSLLPTASRCHPGSLHSLRFCSAVPEFVDVAADPAEAAVSSGHPWPEWGNFLDKLRAKGYFEQGLPSSVSSGEGAAGDGDPATASENAATAASGNTVVDAEDSAVTSEDIYHFLKDENRVKNACLKFGRDRFDLLRWKKPCDSFPLSLYRGNQFLGRVLYYVIFRIHGSRISVFRMLHELSCHLFSGDAARNCLLGLFGV

SEQ ID NO: 81781 - DNA, 824 bp, Zea mays
  misc_feature: Ceres CLONE 1567364
  misc_feature: SWISSPROT Homolog: EC 2.7.11.1 Non-specific serine/threonine protein kinase
  misc_feature (824)..(824): n is a, c, t, g, unknown, or other
gcggtggcggccgctctagaactagtggatcccccgggctgcaggaattcgtctcacccctagaaaaaccgccaccgccaccgccggctcctgctgccaccgcccgctggctggcttagcgcgtaggctgtgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcggcttccgcttctcccgcctcatcgtcttcctcctcttcctgcccaccccgcccatcaaccccgccgcgcacctcgtctcgctcgtgtcctcgcccgccgtggcgctcgcgggggccaacgccacggccacgatcaccacgaccaccaccaccaccaccaccgtcaccaccaccaccaccactgtgggcccccgacatcggcgggggcccacccgcaccaccaaccacaaccggcatgggccccgtcttcgttcggccggccacccgattccggcgtccggccccttgggccccctcccgggacccccagcgaagcttccttcgagggcgggaacgggaattccttcggcctgtccgttcccaaaaaagggccccaaggggcagccaccccaaaaccttcccccccggcctcccggggaacccccaccaaaggggcccctctttn

SEQ ID NO: 81782 - DNA, 834 bp, Zea mays
  misc_feature: Ceres CLONE 1567366
  misc_feature: Encodes the peptide sequence at SEQ ID NO. 81783
tccccgcggtggcggccgctctagaactagtggatcccccgggctgcaggaattcgtctcacccctagaaaaaatctcgaaaaaaaaaaaaaactgatcagccaaccaaaaccagccaggagtgacggaacggaacgaaccattattccttccttccttcccctcgctgcctccgccacggcatccacagtatctcgatctccactactacattgatttccagccccccaatgacgagagcgcccccccgccgcctctggccagccgcagtaattgcagcgcagcccaagtgaccggcctttgaggtttgaccccgcgccggcgccatggccgcggacgccaccgcctccgcctcctcctcgtccgccgcatacctcccgacctcgcgcctggacatccaggccgccgtcgccaaggccgccgagctgcgcgcgctccacgccgcgctcctccagggcggcagcagcagcggcggcgccgccgccgccgcgtccaatgccggggcctacgccagcgctagccggagccccgccgtcatccgcctgccgccggccgcgtcgccggcgccggcccccctgcccacggccgccgagaactaccccgggtttggccccaacttatgatgaaagagcacttgggggggaaacaaactcctttcggccaaaaataacagggagcctggtcccaaaaactggaagcgggatctcggtttgggacccttgatttctggatgggccctaaaaaaaacgaggggggccttttttccggaatttttgaaaaaaaccggaaacccctttttttcttttctttaagaaaaaaggggagaccttcctt

SEQ ID NO: 81783 - protein, 98 aa, Zea mays
  misc_feature: Ceres CLONE 1567366
MAADATASASSSSAAYLPTSRLDIQAAVAKAAELRALHAALLQGGSSSGGAAAAASNAGAYASASRSPAVIRLPPAASPAPAPLPTAAENYPGFGPNL

SEQ ID NO: 81784 - DNA, 828 bp, Zea mays
  misc_feature: Ceres CLONE 1567368
  misc_feature: Encodes the peptide sequence at SEQ ID NO. 81785
ggagctccccgcggtggcggccgctctagaactagtggatcccccgggctgcaggaattcgtctcacccctagaaaaaacctggtcctcctctccactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatctgatgggtggggaggcgccggagccgcggcggctgacccgggcgctgagcatcggcggcggtgacggcggctgggttcccgaggagatgctgcaactcgtgatggggttcgtcgaggacccgcgcgaccgggaggccgcgtcgctggtgtgtcaccggtggcaccgcgtcgacgcgctctcgcggaagcacgtgacggtgcccttctgctacgccgtttccccggcacgcctgctcgcgcggttcccgcggctcgagtcgctcgcggtgaaggggaagccccgcgcggccatgtacgggctcatacccgacgactggggcgcctacgcccgcccgtggatcaccgagctcgccgccgccgctcgagtgcctcaaggcggctcacctccgacgcatggtcgtcacagacgacgacctcgccggaactcgtccctgccagggggcacatgctgccgggactgaaacctcaataagtgcaccggctttctcactcatggaactccccctccgttccccgctccta

SEQ ID NO: 81785 - protein, 152 aa, Zea mays
  misc_feature: Ceres CLONE 1567368
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLIPDDWGAYARPWITELAAAARVPQGGSPPTHGRHRRRPRRNSSLPGGTCCRD

SEQ ID NO: 81786 - DNA, 829 bp, Zea mays
  misc_feature: Ceres CLONE 1567369
  misc_feature: Encodes the peptide sequence at SEQ ID NO. 81787
agctccccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctgtcgcggatcaaaccacggatctgctgcagaagctgtcgctcgactcgcagcccaagccggcggacgcaacacagcctgctgctgccaccgccaaaaagggcgccgcggcgagccagccgctgagcgtggcgatcccgccggagcccgtcatcacgccggtgatccaagactttacggatcccaacctgttttatctaccagcgtattactacggaggctacgacagttccatgagcgagtgggatgattatccgagatatctaaattcagatgggagtggaagatgcccccagcggtatacggaagatattatggaaaatggggtatgcttccttaccggggcatactctccctgcccacttccccaggttcaaacagt

SEQ ID NO: 81787 - protein, 150 aa, Zea mays
  misc_feature: Ceres CLONE 1567369
MAAVAPPPAPAPAPVPAPAPATGPVADQTTDLLQKLSLDSQPKPADATQPAAATAKKGAAASQPLSVAIPPEPVITPVIQDFTDPNLFYLPAYYYGGYDSSMSEWDDYPRYLNSDGSGRCPQRYTEDIMENGVCFLTGAYSPCPLPQVQT

SEQ ID NO: 81788 - DNA, 833 bp, Zea mays
  misc_feature: Ceres CLONE 1567374
  misc_feature: Encodes the peptide sequence at SEQ ID NO. 81789
gcggtggcggccgctctagaactagtggatcccccgggctgcaggaattcgtctcacccctagaaaaaaccacgaaattttaacttgttgcttctctccctcttctgttctgtctcgtccccttcacgaatcacgacagtattgaagcaattcctgattgctgatcctccacaatttctcccgtggattggagcgatctgaattggagccgtttactgctgacatggcgggaactgatcgcctctaccctgaaattgggacgtatgacctggagcccccgcaggtcccagcctccgccgggggcagcggcgaggaggaggccggggtttgcgacgcactggtgatgtgggacgacgaatccgacgcgtgtccctcccatgaagcggcccccatcatatttgagaagggcactagggatcctcctcctaaagttttcaaggaagaaaggcttgatgttgtccattattcagagttcagcgatgagatggcgactgagaaggaattcggagaaaacaactatgacagtttcccttcttgtgacaaacaggcatcatatgggtgcctccctctgttccacctatgccaaacatgatcacgatgagtggcaaaagggctttggttacaatagtccgtgcttcccagaggaagaatataaagtgggatatggacgaaagaaaatttggagatgacaattgtggggatgtgctcttcttaaatggtttggttgcaggaaaaggataaaaatattatccaattgcatcaatttgattttagggatgtatgggcacgttctatgaatttcccgaattttttgccttggaaaagacttttgt

SEQ ID NO: 81789 - protein, 122 aa, Zea mays
  misc_feature: Ceres CLONE 1567374
MAGTDRLYPEIGTYDLEPPQVPASAGGSGEEEAGVCDALVMWDDESDACPSHEAAPIIFEKGTRDPPPKVFKEERLDVVHYSEFSDEMATEKEFGENNYDSFPSCDKQASYGCLPLFHLCQT

SEQ ID NO: 81790 - DNA, 818 bp, Zea mays
  misc_feature: Ceres CLONE 1567384
  misc_feature: Encodes the peptide sequence at SEQ ID NO. 81791
caaagctggagctccccgcggtggcggccgctctagaactagtggatcccccgggctgcaggaattcgtctcaccccttgaaatagccgatcgagatctatccccaatcccttctcccccctccagccgacgggcgccggaggccgacggcgacggggcagcacattgcctctgattgattgatcgacagaagcctcgcgacccggcccccgcttcgccgtgatccggcgacccgaggagtcgagccgagcaccgaaatggggtcgttcaacggccacatcctgccggggacgctgttcctggcggtgggcctgtggcgggtgtggtccgccgtcgcgcgcttcgccgccgacccgccggcgttccgcgtccgcacgtggaaccccctccccaaggggccccggctgctggagctctacttggtggccggcggcgcgttcctggacatgtgcctggagctcggcggcggcatcctcgccggcggcgcccgggtcggcccggacagcctcatctacctcgagcacgccggcatgctgctcatgttcttcctcttcggcgcgctcgccctcctctcccagaagacaaggtacctgccgctgaccgacggcgagctgagcctagtggcagcgacggcattcacgtcagagctgcttctcttctcctaccactccgccacccacacggggctagagggctactaccaccacctcctggtcctcctcatcgggctctgcatcctctccaccgtcctgggcgcgctctcgacggcgagcttgcccgccgaccttgccggcggcgtggctcctcacgcctgcagc

SEQ ID NO: 81791 - protein, 187 aa, Zea mays
  misc_feature: Ceres CLONE 1567384
  misc_feature (106)..(186): Pfam Name: DUF716 Pfam Description: Family of unknown function (DUF716)
MGSFNGHILPGTLFLAVGLWRVWSAVARFAADPPAFRVRTWNPLPKGPRLLELYLVAGGAFLDMCLELGGGILAGGARVGPDSLIYLEHAGMLLMFFLFGALALLSQKTRYLPLTDGELSLVAATAFTSELLLFSYHSATHTGLEGYYHHLLVLLIGLCILSTVLGALSTASLPADLAGGVAPHACS

SEQ ID NO: 81792 - DNA, 739 bp, Zea mays
  misc_feature: Ceres CLONE 1567386
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (708)..(708): n is a, c, t, g, unknown, or other
ggagctcaccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccgggctcgccgggcctcctcggtgcgcgttgcgccggccgccctgccgggactttccctgcaggtcgggttgaaaacccctccaaaggtaacggtgggcgcccccccccgggggggggaaaccctattttcctttataaaccccacggggggtgtgtcctgggcccccccccccgcttatatgggggggggggggggggcccccaaaattggggggcccccctccccccccaaaaaaatttttggggtgcccaaaaaagggggggggggggggggggggggggcccccctttttaaaaaaaaacttttnnnnnacccccccagggggggggggggggggggggtgttttttttttttttgggggggggggcgcccccccccttttaaaaaaaaaaaaactggggggaaaaaaaatataaaactttttccccccccccccgccccctggggnctttcccccccaaaaaaatatttgtgggggg

SEQ ID NO: 81793 - DNA, 832 bp, Zea mays
  misc_feature: Ceres CLONE 1567388
  misc_feature: Encodes the peptide sequence at SEQ ID NO. 81794
ctccccgcggtggcggccgctctagaactagtggatcccccgggctgcaggaattcgtctcacccctagaaaaagtaccgcgcgctcgcgcccgaaatttcacaacaccaaacccgcaggggggagaagcgcaaagccacgaggagtgcgaggcgagggccgacaccggggacaagcacggcgcggcggcggaggcagcaatggcggcgctgcagagttggcgcaaggcgtacggcgcgcttaaggacaccaccaccgtcagcctcgccaatctcaactccgacttcaaggatctggatgtcgcgatcgtgagggccaccaaccacgtggagagcccgcccaaggagcgccacctgcgcaagattgtggcggcgacgtccatcgcgaggccacaggcggacgtcacttactgcatccatgcgcttgcccgacgactcgccaaaaccaggaactggatcgttgccctaaagacacttgtagtgatccataggcttcttcgtgaaggtgaccctgcattccgcgaagagtttctaacatttacacagagagtgcggattttgcagctgtcaaacttcaaggatgattccagccccaggtggtctgtatttcttcaatttaaatttaaccttatgttttatttggatcattaatattggttccatatttctttcaaatttatcctctttatatttcggatttataactagcttggggattatgctttcatgggttcgcacatacgggtttatttttggaagaaaaactagaatgcttcagggggtttgaagtatgacatttgaagctgcaccttttatcaaaccaaggtcaaggt

SEQ ID NO: 81794 - protein, 149 aa, Zea mays
  misc_feature: Ceres CLONE 1567388
  misc_feature (29)..(143): Pfam Name: ENTH Pfam Description: ENTH domain
MAALQSWRKAYGALKDTTTVSLANLNSDFKDLDVAIVRATNHVESPPKERHLRKIVAATSIARPQADVTYCIHALARRLAKTRNWIVALKTLVVIHRLLREGDPAFREEFLTFTQRVRILQLSNFKDDSSPRWSVFLQFKFNLMFYLDH

SEQ ID NO: 81795 - DNA, 962 bp, Zea mays
  misc_feature: Ceres CLONE 1567390
  misc_feature: Translation starting site: 246
  misc_feature: SWISSPROT Homolog: EC 3.6.3.14 H(+)-transporting two-sector ATPase
  misc_feature (63)..(63): n is a, c, t, g, unknown, or other
  misc_feature (64)..(64): n is a, c, t, g, unknown, or other
  misc_feature (74)..(74): n is a, c, t, g, unknown, or other
  misc_feature (677)..(677): n is a, c, t, g, unknown, or other
tatttgtgtggtagggtgccaaatacctcgtccactaataccaagatgaaaatggtaggaaannacgcaaaaanacaaaactggaactcaccacggtggcggccgctctagaatagtggatcccccgggctgcaggaattcgtctcacccctagaaaaaatcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtgggcgcagcacctttggcgagaacatgggggcgcaaccatcgctaatggacggcaccgaagggggttcgntccgccggcccaggggcgtccctcaaaacctgggctccccccatcacccgtgccctgtttgggcaggggcctaccccttgggaccggatcaattaaaggttaatccggggaaacccaattggaataaaaaaggggggaaaattaacgacaaaaaccactttccctcccctaatcccaaccggggaaaacccccccggccttttcggttggaaacagggccccccttgaggccaaccaaatttccttggtttaccgggaaaatcaagggggcccgtgggaatctta

SEQ ID NO: 81796 - DNA, 757 bp, Zea mays
  misc_feature: Ceres CLONE 1567393
  misc_feature: Encodes the peptide sequence at SEQ ID NO. 81797
ctcaccgcggtggcggccgctctagaactagtggatcccccgggctgcaggaattcgtctcacccctagaaaaaaggcggagtcaaacaaaagaaaggtgctatttctccgggtgtcctaaacgatttcgcggtgctcgtgcttcgctgcccactttctccacttcctcctcctcgcgagctcagctcgcgcaccgccgcagacagcgccgccgccctctcctcctccccttccgctttgccgccacccactgctgccggccgccgcaggcaccccatggccccgaccgggcggctcctcgcggtagccgccctctccttcctatgtctgcaggggccgtggggagattcaggcagcgcatttgctcagagccagcagccgcttcaccggaccgttggcgcagaggcaaatgacggcggcggcctcatgccggagctcccgcccagcggcctcatgcccatgccggagctctcacccagcggctctcccacgccatttgtccccttcctggcgcctgctccgctcgcgccattctttaacaacagcacgccaaagctctcaggaaaatgcacgctgaactttaccgctgtcgacaaactcatgaccaccacggctgtcgactgcttcacctcgtttgctcctttcctggccaatgtcatctgctgccctcagcttcaggcaacactgaccatcctcatagggcagtctagcaagcagacaggttctctcgcattgaatcccacggggggcaactact

SEQ ID NO: 81797 - protein, 160 aa, Zea mays
  misc_feature: Ceres CLONE 1567393
MAPTGRLLAVAALSFLCLQGPWGDSGSAFAQSQQPLHRTVGAEANDGGGLMPELPPSGLMPMPELSPSGSPTPFVPFLAPAPLAPFFNNSTPKLSGKCTLNFTAVDKLMTTTAVDCFTSFAPFLANVICCPQLQATLTILIGQSSKQTGSLALNPTGGNY

SEQ ID NO: 81798 - DNA, 842 bp, Zea mays
  misc_feature: Ceres CLONE 1567397
  misc_feature: Encodes the peptide sequence at SEQ ID NO. 81799
gagctcaccgcggtggcggccgctctagaactagtggatcccccgggctgcaggaattcgtctcacccctagaaaaagtgcctgcgccattggggcctgtttggagaccccattccattttcaccttccccttcgcaggatccccctcccgtgccgtgctctctcaacaagggagaaggggaaaccaccaccaccaccacacttgataagaagggggccgcacgcgcctgcccgctcccgccgctacgccatggacgcctgggaggccaccaaggcggtgttcgaccgggtgcgggcgctggacccggacaacgcgtccaagatcatgggcctgctgctcatccaggacaacagcgacaaggagctcatccgcctcgccttcggccccgaccaccccccccacgccttcgtctccgccgcgcgcgccgacctcgccgccaagcccgcgtccccgccgtcgcccgtgctgggcccgctccaccagacctggggagcgccgcctcacccgagccctaccgctggctccgaccaccaacaccaggcccccttcgccgccgacctcgcgctcggctacgacttcgacggcgccggcgccggcgctgacgcgttcttccccgacgactacgactgctggtcaccggccggcgccgcccaccgccgcagcttctcgctcaacgacgccgaggccaccgccgccgccccccggcggcgcttgcctggaaggccatgcaatgtactttcccgccgccgggttctgcaaaaaacagactccatcctgcctgcttccctccacgggcttttccggaagaaccaaagaaccccccccccggtatccgccaaaa

SEQ ID NO: 81799 - protein, 197 aa, Zea mays
  misc_feature: Ceres CLONE 1567397
MDAWEATKAVFDRVRALDPDNASKIMGLLLIQDNSDKELIRLAFGPDHPPHAFVSAARADLAAKPASPPSPVLGPLHQTWGAPPHPSPTAGSDHQHQAPFAADLALGYDFDGAGAGADAFFPDDYDCWSPAGAAHRRSFSLNDAEATAAAPRRRLPGRPCNVLSRRRVLQKTDSILPASLHGLFRKNQRTPPPVSAK

SEQ ID NO: 81800 - DNA, 828 bp, Zea mays
  misc_feature: Ceres CLONE 1567400
  misc_feature: Encodes the peptide sequence at SEQ ID NO. 81801
ccccgcggtggcggccgctctagaactagtggatcccccgggctgcaggaattcgtctcaccccctagaaaaaacgccgccgcctctcccagtgggtcctccgcatctcccatctcccatctcccgtctcccctcttcctcctcccctgcgatcttctccaccgcatcacctccctcgaaccctagacccacccacgcgcccattgccttcggtcgccatgtccgccgctcagcttctccgtcactcgcgcaagctgcggagtttgcaaaatgctgtaggttgtgagaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacttggagaatagcatccaacagccttaccccaagtgctgctagctggctcagtggttcattctcatgtggacaggtagtctcagcgcggccattctcaagtagtgcagacctgcctccacatcaagaaattgggatgccgtctctttcacctacaatgactgagggaaacattgccaagtggcttaagaaggaaggagacaaggtctcccctgggtgaggttctctgccgaagtggaaactgacaaaaccactgtgggagatggagtgccatggaagagggttatcttgctaagattattcatggagatggtgcgaaggaaaataaaagttggggaggtcattgctataactgtaaaaaaaaaaaggggaacttccaaaaatta

SEQ ID NO: 81801 - protein, 147 aa, Zea mays
  misc_feature: Ceres CLONE 1567400
  misc_feature (3)..(147): SWISSPROT Homolog: EC 2.3.1.12 Dihydrolipoyllysine-residue acetyltransferase
  misc_feature (118)..(147): SWISSPROT Homolog: EC 1.2.4.1 Pyruvate dehydrogenase (acetyl-transferring)
MSAAQLLRHSRKLRSLQNAVGCENFSFVRHFSSGSGSFIARENGIGKRTRGTRFSQHNQPAKQLETFSAGVNGSCTWRIASNSLTPSAASWLSGSFSCGQVVSARPFSSSADLPPHQEIGMPSLSPTMTEGNIAKWLKKEGDKVSPG

SEQ ID NO: 81802 - DNA, 827 bp, Zea mays
  misc_feature: Ceres CLONE 1567402
  misc_feature (386)..(386): n is a, c, t, g, unknown, or other
  misc_feature (477)..(477): n is a, c, t, g, unknown, or other
  misc_feature (640)..(640): n is a, c, t, g, unknown, or other
tccccgcggtggcggccgctctagaactagtggatcccccgggctgcaggaattcgtctcacccctagaaaaagccacgcgcagcagcaacccggtagcaggagcgcagccagcaagctcagccccccagccctactgccaccgcgccgaacgccatggccgagccggcagacaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggagggggaaccagtggaaagagcgcggcacaggcactgtgaagctgctncagcacaaagacaccgccaaggtccgccctcgtcatgcgtcaggcgaagacggcttaagatctgcgccaaccatctcgtggtggcgacganctagatgcaggagcacgcggggagcgacaagttcgtgcgtgtggcacgcgctggacttcgccgacggcgagctcaaaagagagatgtttgctatccggttttggatcctgtcgagagtgagcacctagaaccatatctttactgcctctttatcccttcttgncatctgttcgtagctagcagcttgcactggtaccaatgtttgggtaccctctgttggatgaacgaactggggttaatgttggttttggctttccttttttcctgggaaaagttgatcggatcactgggtcttagggattctttgaaatttgccgaaaatgcctatggtttggtccaatgccaattca

SEQ ID NO: 81803 - DNA, 789 bp, Zea mays
  misc_feature: Ceres CLONE 1567404
  misc_feature: Encodes the peptide sequence at SEQ ID NO. 81804
  misc_feature (789)..(789): n is a, c, t, g, unknown, or other
ctccccgcggtggcggccgctctagaactagtggatcccccgggctgcaggaattcgtctcacccctagaaaaaatggcaccgttttggtctatttcataaaaacctagaggcgaccggccagcgccatatcccgcgccgccgccgccgccgccaacgcttaatgctagtgttcctccggcgaggcctcttgctcgtccggcagcccaccacccgcgtccttgccaaaccgtctctccgccctgcttgtctcttcgtccaccacttcgccgtcgacacgatgggtgagggttctgctgctggtaaggacgcgaaggggaaggggaagggggaaggggaagaccaaggccgccgccgcggattcggccctggtcgttcgcgacgactcctacctagaggcggtcactcagaagaggattcgcttcttcgaggagatccaggcaaggcaagccgtcgagcggctgaatatcggcggcgaagttatcaaggtaactttgcctgatggcgctatcaaggagggtaagaaatggataacaaccccaatggatattgctaaggagatatcaagtggatttgcagctagttgtttgatagctcaagtggacgaaacactctgggacatggggaggccactcgaaggtgattgtaaattgcaaatgttcaagtttgataccaatgaaggtcgtgacaccttctggcactcaagtgctcatattcttggagaatctattgagagagcatatggatgcaagctgtgtattgggccttgcacacaaggaggggagggttn

SEQ ID NO: 81804 - protein, 82 aa, Zea mays
  misc_feature: Ceres CLONE 1567404
  misc_feature: SWISSPROT Homolog: EC 6.1.1.3 Threonine--tRNA ligase
MDIAKEISSGFAASCLIAQVDETLWDMGRPLEGDCKLQMFKFDTNEGRDTFWHSSAHILGESIERAYGCKLCIGPCTQGGEG

SEQ ID NO: 81805 - DNA, 1163 bp, Zea mays
  misc_feature: Ceres CLONE 1567405
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1108)..(1108): n is a, c, t, g, unknown, or other
gggaggggggaatataaagtggtgcggattatgtatttttttttttttttnnnnnnnnnngggggcnnnnccccacactgggctccccgcggtggcggccgctctagaactagtggatcccccgggctgcaggaattcgtctcacccctagaaaaaagcaaagcccaggctgcccagcacacgcgacgcgaaccagctgccgaggaaccctagcggagcactgtgcaggcgaccgcggcgcgctatcacttacggggggatacggcggcatcgtccccctcggcccctcctccatccctggtgcgggggcgccagcctgcaggggttgaatgctgatttgttgtggctgattaaccggggtggatcggcgattagccgggattaagtccgctgaccgcccctccgggcaattaaaaaacgataaggtcatccccccccagcagggggggggggagggggggggggcgctctccccctaatccttcaccgaccccaaccccaaatccaaggccccgtcgaagccggcgggcggggggggtcctcctgccaataaaggagtgtcctggcgggattccctattcctcgtggagcccaatggggggcagcgccgtggggccccccaaaaccgggccctagtcagctcggcaggccccccccccgtctccagccggggccgcttttctcatgggggtgtttggccgctaggcccgaggaggggcggtcacaccccctaagggggcccacgtccccacggccaagggcggagtagcgccacgtcggctatcaacgtgacaaccctcactctgatacgcccgccgagtaagagaaaaggcgggggacacgcggggggagggatggggcgggaatagcgcgacgggcgtctgggatacgcgtcggctgggaactacgccgtggcgacacaccgcccgctcccgcattaagcggggagtggtacgtgacccaggctgccatcgaatcgcgcggatgaggccggctcgagtaggcggagcgagctgtagcggacagggcgggtggtgctaaacatgataaggtcgtaactttcacccatccccactccgtaggcgcacgcctcgccgcgcgcagcggngaagcgccccgcgcacgctgttgtccctgtggctatggccgcgtgccacgcataa

SEQ ID NO: 81806 - DNA, 800 bp, Zea mays
  misc_feature: Ceres CLONE 1567406
  misc_feature: Encodes the peptide sequence at SEQ ID NO. 81807
  misc_feature (713)..(713): n is a, c, t, g, unknown, or other
gcggtggcggccgctctagaactagtggatcccccgggctgcaggaattcgtctcacccctagaaaaaacagcaaagaacttggccccgcctcccgtctcttaccgcacatgcgcgtcgggccgcgtcgacatagctgcttgccgccgacacccgcagccgcaatggccgtcgcccacgcgccgccgcgccggggcgtgctccccctcctgctcgtcgccgcgctcgtggcggcgctgccggccacctgcgccgcggccaggagcaagaagtcgtacacggccatcttcagcttcggggactcgctctccgacgccggcaacctcatcgtcaacggcacgcccaaggcgctcaccaccgcgcgccctccctacgggatgaccttcttccgcaagcccaccggccgctgctccaacggccgcctcgtcgtcgacttcctgggtactgcactgtaccctagtagtagttcgttccaacaccggcagctgtttttatttcgcttccgtgactaatttttcccaactgcttgtacttatttttgtggtctctgggatatctaattcaaacgtctccgtcgctaaaactttttgatttgagtgtcaagaggagcctgctatgacttgggtggtcaagatgaaaatgacctgttctttttctttttattaaacaaaaagtttggtagagcaaacctaaaatttgttttgttaaattttnagaaaaggggaaaaacaagatgaggtgactagtgactactaaatttggtttgtaagagtcccatttctttgctctcagctcttcatc

SEQ ID NO: 81807 - protein, 115 aa, Zea mays
  misc_feature: Ceres CLONE 1567406
  misc_feature: SWISSPROT Homolog: EC 3.2.1.51 Alpha-L-fucosidase
MAVAHAPPRRGVLPLLLVAALVAALPATCAAARSKKSYTAIFSFGDSLSDAGNLIVNGTPKALTTARPPYGMTFFRKPTGRCSNGRLVVDFLGTALYPSSSSFQHRQLFLFRFRD

SEQ ID NO: 81808 - DNA, 832 bp, Zea mays
  misc_feature: Ceres CLONE 1567408
  misc_feature: Encodes the peptide sequence at SEQ ID NO. 81809
ctccccgcggtggcggccgctctagaactagtggatcccccgggctgcaggaattcgtctcacccctagaaaaaatgcccctctgcagccgccggccctcagcaagcaagcaagggacagacgcggcggggatgggcagcggggtccgggcgctgatgcgccggaagcaggtagactccgagcggacgcgcgccgtcggcagcgcccaccagctccgcaaggagctctccgtcacccatctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaggagttgcatggttgattggctgggctttgatacttgaatacacgattggtggatcagccgttgcccgtggcatttctcctaatctagccttattttttggaggacacgatagtctgccatggattttagcacgacatgagatcccatggcttgatgtcgttgtagatccttgtgcttctttcctcgttatcgtcatcactggccttctctgtgtggggataaaagagaggtcatttgtgcaaggagttgtgacggtcttaaattgccttggtgaatgtatttcgtaacatagacggtagctacatcggctttcaaaaaggatgggttgggctacaagggtgctggcggatttttttccttagtggaggcgatgggaaga

SEQ ID NO: 81809 - protein, 202 aa, Zea mays
  misc_feature: Ceres CLONE 1567408
MGSGVRALMRRKQVDSERTRAVGSAHQLRKELSVTHLVAIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGHDSLPWILARHEIPWLDVVVDPCASFLVIVITGLLCVGIKERSFVQGVVTVLNCLGECIS

SEQ ID NO: 81810 - DNA, 826 bp, Zea mays
  misc_feature: Ceres CLONE 1567409
  misc_feature: Encodes the peptide sequence at SEQ ID NO. 81811
  misc_feature (796)..(796): n is a, c, t, g, unknown, or other
gcggtggcggccgctctagaactagtggatcccccgggctgcaggaattcgtctcacccctagaaaaaactgaggactctgaccagtgggactaggatattccttcttcttcacccacgactccgccttcctagttcttgggcggccggtgaggacgaacacggactcgcgctctcgctcgcgccatcggaggaaaggagatccactcggagcatgcgggccgccgcgcggtagatgaaactgaggaacacggcaataacacgagcaaattcagcttgtcttccaatgggggatcgtgttggtgtcaagtacaacagcatcaatgaggctgaagagcataagggagggcatggcatccccaaggtttccatgatacccctcatattcctcatattttatgaagtttcagggggtccctttgggattgaggatagtgtcaaggctgctgggccactactggcaattttgggctttcttctgtttgcactcatatggagcgttccagaagctctaatcactgctgagatgggcactatgttccccgagaatggtggttatgttgtctgggtttcttcagctcttggtccgttctggggttttccagcaggttgggcaaagtggctcagcggtgtcatagataatgccctctatccagtcctatttctggactatgtcaagtccagtgttccagcctcttggaggtgggctcccaagggactttagcggtgctttatcctcacagttgcgctttacatacatggaactaaccgagggcctgactatagtttggctgggntggcagttcctttcttggggggtgtcctcc

SEQ ID NO: 81811 - protein, 162 aa, Zea mays
  misc_feature: Ceres CLONE 1567409
MKLRNTAITRANSACLPMGDRVGVKYNSINEAEEHKGGHGIPKVSMIPLIFLIFYEVSGGPFGIEDSVKAAGPLLAILGFLLFALIWSVPEALITAEMGTMFPENGGYVVWVSSALGPFWGFPAGWAKWLSGVIDNALYPVLFLDYVKSSVPASWRWAPKGL

SEQ ID NO: 81812 - DNA, 759 bp, Zea mays
  misc_feature: Ceres CLONE 1567412
  misc_feature: Encodes the peptide sequence at SEQ ID NO. 81813
  misc_feature (621)..(621): n is a, c, t, g, unknown, or other
  misc_feature (759)..(759): n is a, c, t, g, unknown, or other
ctccccgcggtggcggccgctctagaactagtggatcccccgggctgcaggaattcgtctcacccctagaaaaaccccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcgctgcagcttgctgaagtctttacttgctgcattctgtgctcacactttttgaagctgctctnctctgctctgcgttgttgatttctgcactcaagcttctcttgcctgtgcactcaagcttctctcttcctgggcaactagtgatctccttggaacatttcagcttttacctagagatctttctggttgttgctgaaggn

SEQ ID NO: 81813 - protein, 29 aa, Zea mays
  misc_feature: Ceres CLONE 1567412
MSAEVAGGHPYFLSCYFWFIYCIKFRDFT

SEQ ID NO: 81814 - DNA, 1261 bp, Zea mays
  misc_feature: Ceres CLONE 1567413
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (419)..(419): n is a, c, t, g, unknown, or other
  misc_feature (471)..(471): n is a, c, t, g, unknown, or other
  misc_feature (748)..(748): n is a, c, t, g, unknown, or other
  misc_feature (1132)..(1132): n is a, c, t, g, unknown, or other
  misc_feature (1161)..(1161): n is a, c, t, g, unknown, or other
  misc_feature (1208)..(1208): n is a, c, t, g, unknown, or other
ntttttannnnnttccctcccccctccccccgccttctttttaannannnnnnnnnnnnnnggcacnnnnnggcgcccggggctccccgcggtggcggccgctctagactagtggatcccccgggctgcaggaattcctctcacccctagaaaaatcacagcttcgagactcgtcctccatgggttctggcggcgtcagatggaaggctctgccgctgtgcctagctctcgtggctctgcaagcatgcctccctgctcgcggggcagctcccaagacttacatcgttcagatggccgcgtctgagatgccgagctcgttcgatttccaccacgaatggtacgcatcccctgtgaaacccgtgagctctgtgcacctggaaggagacccggacgaccattacgccgcgaggatcgtctanaattatttccccccccccaggggggacagaagggggggggaccaagaccaantcccattcccccccccccaagcgggacggccttgcctggcccgcgcccccctggaaaacggttccttccccccttccccccaccatcctagaagcccccggcactttccttgggggcactcccggccccgggaagaaatcaccccagcaacgctacttacagggtcccccccccggcccctgtgcctctgtaaactccccaaccctctcattctctcccccgaccccaggctcgctcgtgttgagcacgcggccccaagccgtgggacgtcccacgnaacgagaacttccttttccagagttattatctttgctctctcccaccgcggattgtggaggacactctttgtgcaacgcgcaccgcgctagttctgatctgacccgcgcacattgatctctcgccctactatagcttgctcacctgaattacgcgctcccgccacaaggcgctcaaacacacgaccgcgcgctcgtgttgagatcgagcatactatcgtctagtaggtgagtagcatcgaccgcgcgcccactgaactatcgctagctgcgatccccgcagagctgccgcttaagctgctctcatacgcaggcagggccgcaccagctgtcacgacggtcccactcgcgttatgtagtgctccatcccatccgagtcacgtttntattactctatacccgacctgcttattancaccagccagcccagcacaactcctcgcgctgtgccgctcgactcgntcccatctcagccacaatgccatactacgctcgccgtttctcacgtattcacc

SEQ ID NO: 81815 - DNA, 792 bp, Zea mays
  misc_feature: Ceres CLONE 1567414
  misc_feature: Encodes the peptide sequence at SEQ ID NO. 81816
ctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaggccttcaccgtccgcaacatcgcctccatggtcccaccctacgacaagatcaagtacgccggcacagggtccgccatcgagtacgccgtgtgc

SEQ ID NO: 81816 - protein, 139 aa, Zea mays
  misc_feature: Ceres CLONE 1567414
  misc_feature (79)..(139): Pfam Name: Pro_CA Pfam Description: Carbonic anhydrase
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVC

SEQ ID NO: 81817 - DNA, 806 bp, Zea mays
  misc_feature: Ceres CLONE 1567416
  misc_feature: Translation starting site: 164
  misc_feature: SWISSPROT Homolog: EC 1.6.2.4 NADPH--hemoprotein reductase
ccccgcggtggcggccgctctagaactagtggatcccccgggctgcaggaattcgtctcacccctagaaaaagcacgcaccccaccccctcctgccgtcctcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccgctcgccgcgctggcggccaccgccgcggccctcttcgcagggctgcttattatcgctgtctggttccgatccggaggcgggacgccgtccaagccggtcgccacgccggtacggccaccgccggtcaaggtagacgccgacgccgacgttgatgacggccggaagcgcgtcaccatcttcttcggcacacagactggcaccgccgaggggttcgccaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcaacatatgggggatggggagccaactgataatgcagcacgattctacaaatggtttactgagggaaaagagaaggaagtttggttgaaggattcttaatatggtatttttggccttgggaaacagcaatacgaacatttttataaggttgccaaagtggtagatgagctagtagaggagcagggttggaaaacgtcttgttcctgttgg

SEQ ID NO: 81818 - DNA, 1210 bp, Zea mays
  misc_feature: Ceres CLONE 1567417
  misc_feature: Encodes the peptide sequence at SEQ ID NO. 81819
  misc_feature (40)..(40): n is a, c, t, g, unknown, or other
  misc_feature (72)..(72): n is a, c, t, g, unknown, or other
  misc_feature (76)..(76): n is a, c, t, g, unknown, or other
tgtggtttttgttgtgttgtgggtggtgggtggtgggggnttttgtggggcgattttttcctttcccgcgantagnaaaatgctggagctccccgcggtggcggccgctctagaactagtggatcccccgggctgcaggaattcgtctcacccctagaaaaaataaacgcgggcgatcaagatggcgcacgaccccagcctgggcttcgcggactacttctcggcggcggcggcggcgggcgccacggcgatggacgacgacgtcggggcgccggagctctatggcctgcatgccgacgacatggagttcctcggcatgcgtggcctggccgccatgccccccgccgcggcacaccaccagcaccaccaccatcacggccacagcaaggccggtgcgctcctcgacgacgacgacgcgggggtggggccagacgtcagcggctccgcggacgacgccaccatgcgcttcctgagcgagcagaagcagcagcagcaccaagcgcccgctgtcccctgtcgctgtgccgggccggacgttggcgaccaaccttggcacgaagcagcaagcaccctccgccgggcgggtgggcttccttccgtccccgggttcccattccaggggaagcaagccagccccgggcggggcgttgggggttggcaggccaacccagtccaccggaaccttataccttcgtacgagtttcgccccgggcaaagagcaaggccacaccgcggtgtgtggatggaagaccccatatggcagcgctcaggaggcttctccccccaaggggggtttggtcacccgtgtctctggtttgccccccccgtgtagcgacgctccacaaggcactaatgggtgtttcccaccatgttttaagaatgggaagaagattatttttttttgggtcagaggagcgcctttcgccccccacgagggtggggagaaataggtgccaagtgacagatgtccactccatgtgtttagtggcacctgtcacataagctacagtgacgcggcgtgccccaaaaggtgcgccccgccaaaaaataaaatggccccgggggccttccgtcacgttgctatagagagcgcgggcggggccaaaggtaatataagcggggggggagcggtgacccacaaagaggggggagagatcttgtacatacagaggccctcactggtgggagcccgcgggggggagtaataaaa

SEQ ID NO: 81819 - protein, 216 aa, Zea mays
  misc_feature: Ceres CLONE 1567417
MAHDPSLGFADYFSAAAAAGATAMDDDVGAPELYGLHADDMEFLGMRGLAAMPPAAAHHQHHHHHGHSKAGALLDDDDAGVGPDVSGSADDATMRFLSEQKQQQHQAPAVPCRCAGPDVGDQPWHEAASTLRRAGGLPSVPGFPFQGKQASPGRGVGGWQANPVHRNLIPSYEFRPGQRARPHRGVWMEDPIWQRSGGFSPQGGFGHPCLWFAPPV

SEQ ID NO: 81820 - DNA, 878 bp, Zea mays
  misc_feature: Ceres CLONE 1567418
  misc_feature: Pfam Name: GATA Pfam Description: GATA zinc finger
acccgcggtggcggccgctctagaactagtggatcccccgggctgcaggaattcgtctcacccctagaaaaagaggctgcctaccctcccaccgtgaaaccttcctccctctccctctccctctccctctctgtccccttctctcctccgacggtcgacagcctactctgcacgcccggagaacccgaccggacgagcaccacacgaacacccacacgcccaccttttttctgtggaagtccttaggctggggcctagggtctgctactgcctctctcgggtgctggcgaggtatcgctacacagaaataattcttgatgttggggcgtttcttttgctcacgactttccttgtacatgagaaaccgcttctttggacccttgctcctccgggtgcgcttgcgtgcgatcttcctgtgccgcgttcttggtagttctcgatgggggaactacgcgacagcatcgtggggaacccaggacactgccttcagtgtgaagtcacaaacactcccccgagtttaaatgggccgccctatatcccggcgctctgccatgcatgtggcttcaagaagatcaccaagggttcatgggccaactacactccaatgcttgtgaaggacaatgtggatgagaattaacccccaatttgccaggtgaaatctacctggtttaaggttgaaattcccaaaaaaaaaatcctaattctccctatttttgggggaatgggcccttttttccgggaaaaaatttttcccagggggggggcgggggctccaccaaagggggtctgtgtccccctttggggattccccacccattcctttcctcgagaaaagttgggaaccctctcttggggggcgcgagagagagcccatttaa

SEQ ID NO: 81821 - DNA, 851 bp, Zea mays
  misc_feature: Ceres CLONE 1567419
  misc_feature: Encodes the peptide sequence at SEQ ID NO. 81822
ctccccgcggtggcggccgctctagaactagtggatcccccgggctgcaggaattcgtctcacccctagaaaaactccacttccgccgcgacgatctcctcccacccgtagaccaacaacaacggtactaaccagtaccagccccgcatgcctctcgcggcggctgccgcggccgttgccgcatgtccttcgccgatcggcctcacccgctctttgtgccgtatcgaggcgcatccgcggcgccggcggaggttccggttggaggcaaattcgtcggcgtctacgtccgctcccgcgccgaccgcggcggatgagggaggcggagcggggttgtgccctgtggtcaggttcgacatggccgacttcaccgtcgccgaccgcgtcagcgtcgggctccatggacggtcggatgagatgatcttcgaggccacggtgtgcgatccgagcagcgagctgtatgggtcaacggtggtcctgcggcagctgaagagtttgcaggcgaagcgcagggggcgtcgcgctctccgagtgctgaagaagctggctcgtcgcaaaatgatgtaccactcctacgcacttcaggtccatggttacattgctccgtgcaatgccgtggaggaagaagatgtcccgttaagaatggttcaatgggtaatatgggaagccattcccctgcgtccctggttgcaacttctcgattgggatcccaacccttagaagcaaacattaaccgttgggacaaaaaaaacaggtaagggaggggtagggaaatgaactctttttggaaaggaaccagcctgtaaaattcgaaacagcttgcgtttttaattaagggaaaaatttgatgtaag

SEQ ID NO: 81822 - protein, 189 aa, Zea mays
  misc_feature: Ceres CLONE 1567419
MPLAAAAAAVAACPSPIGLTRSLCRIEAHPRRRRRFRLEANSSASTSAPAPTAADEGGGAGLCPVVRFDMADFTVADRVSVGLHGRSDEMIFEATVCDPSSELYGSTVVLRQLKSLQAKRRGRRALRVLKKLARRKMMYHSYALQVHGYIAPCNAVEEEDVPLRMVQWVIWEAIPLRPWLQLLDWDPNP

SEQ ID NO: 81823 - DNA, 774 bp, Zea mays
  misc_feature: Ceres CLONE 1567420
  misc_feature: Encodes the peptide sequence at SEQ ID NO. 81824
ggagctccccgcggtggcggccgctctagaactagtggatcccccgggctgcaggaattcgtctcacccctagaaaaaaattctcacgcccatcacaagtgaaggaaggctactggtgctggtgccggcactggcagccggtgcctaaccatatctacctcatataactttccactggccgtagtcggcttcttctctgaactgaagcaggggggagacaagcgccatggctgaggatgccagaggagagaagaaggatgcctacgcggcggcgccggcgtccaagttgccggcgaagcaacggggagggttcaggagcatgcccttcatcctagcgaatgacttctgcgaccggcttgcttcggtggggttcacgacgaacctgatctcgtacctcaccctgcagctgcacctgccgctcgtggaggcctccaacatcatcaccaactacaatggcactgctaacctcactccgctcatcgggcgtctcatcgccgactctttttgctggcgcttctgggacatcactttcggctccatcatctaccagctcggcatggtttgctttatccctctcggccgggctcccctggggttaacccgccattcctggggcaaagaacggcttaaaaaatggcccaggggcccgggttccctccctaaccaaaaaatttccccggggcgtggaaccctgtgctctcgggccccttggaaacatttaaaattgtgggacccccggggggggccaaaacccccccccccctgtgttacaca

SEQ ID NO: 81824 - protein, 182 aa, Zea mays
  misc_feature: Ceres CLONE 1567420
MAEDARGEKKDAYAAAPASKLPAKQRGGFRSMPFILANDFCDRLASVGFTTNLISYLTLQLHLPLVEASNIITNYNGTANLTPLIGRLIADSFCWRFWDITFGSIIYQLGMVCFIPLGRAPLGLTRHSWGKERLKKWPRGPGSLPNQKISPGRGTLCSRAPWKHLKLWDPRGGPKPPPPCVT

SEQ ID NO: 81825 - DNA, 822 bp, Zea mays
  misc_feature: Ceres CLONE 1567421
  misc_feature: Translation starting site: 132
ctccccgcggtggcggccgctctagaactagtggatcccccgggctgcaggaattcgtctcacccctagaaaaacaacgccatccgttccatttcttatcccctctcctccggtcctcccccctcccctcgatggcgtccctcacgctcccagcactcgctctcgccctctctaaccccggcgccgtccgcctacgcgccgcggccttccgctgctgggcgctccggcggcgcggctgggcggcggcgggcgccctggcctcgcccaactccgtgcttagcgagcatgccttcaagcggctccagctcgggagcgacgacgaggacggggaagggccgtacgggagcgacgccgacgaggggttcgaggcgggggagggggacaacgaggagctcgccattgccaggctcggcctgcccgacgagctcgtcgccacgctcgagaagcgcgggattacgcacctgttccccatccagagggctgtgttgattcccgctctcgaggaccgtgacctgattgccagagcaaagactggaactggaaagacactggcctttggcatacccatgatcaagcaatttaatcgagcaagacgatggtcggattacaaggagaggtcgtactcctcgggttctggttctagcacctaccagagagttagccaaacaagagtccggcacaccgccctcttttcgtgtagctggccgcccgcaccagctcgaaaccatggaagtcgccggccgtggcgtgccccccccgggcttcttgcgcgggcccgttcaagcagcagggcgcgtacgtgggccgttgcccgtcgccccc

SEQ ID NO: 81826 - DNA, 814 bp, Zea mays
  misc_feature: Ceres CLONE 1567423
  misc_feature: Encodes the peptide sequence at SEQ ID NO. 81827
ccccgcggtggcggccgctctagaactagtggatcccccgggctgcaggaattcgtctcacccctagaaaaaagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctccgcgccgctctccaccgccgacaggacctggatggacgagtacctcctcgaggccaagctggcgctcgggtacccgctcgcgccctcggagacgctcggcgaaggcgatgactgccccgcgcgtcatttcgatgtgctgttctacctcgggttccaacatctggacccctctagcgagcgcacgcggatgccggacgtacggaaagggccactccgggctctggttccgggggcagaaccttctgggagctcgcggtcctgcaagtccttcttggccaagggcacccccggggagtcccctgggcccaataagggaacgggggggttccctcctaattggggaaagaaaaaggttgccccccaaagggtctcagaggcgggcaca

SEQ ID NO: 81827 - protein, 118 aa, Zea mays
  misc_feature: Ceres CLONE 1567423
MDEYLLEAKLALGYPLAPSETLGEGDDCPARHFDVLFYLGFQHLDPSSERTRMPDVRKGPLRALVPGAEPSGSSRSCKSFLAKGTPGESPGPNKGTGGFPPNWGKKKVAPQRVSEAGT

SEQ ID NO: 81828 - DNA, 862 bp, Zea mays
  misc_feature: Ceres CLONE 1567425
  misc_feature (391)..(391): n is a, c, t, g, unknown, or other
  misc_feature (471)..(471): n is a, c, t, g, unknown, or other
  misc_feature (766)..(766): n is a, c, t, g, unknown, or other
  misc_feature (768)..(768): n is a, c, t, g, unknown, or other
  misc_feature (775)..(775): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
tccccgcggtggcggccgctctagaactagtggatcccccgggctgcaggaattcgtctcacccctagaaaaaatcggcaggagctacaggttccacactggagccgaactcctccgcacggacacccaatgcacggatgcttccttgaaagcgctgtggcaacactcggactcgatcatgtgctgttccctgaaggctgctcccgtgttcacctttgccaaccaagccggcctggacatgctggagacgacgctgattgctctccaggacatctcccttgagaagatccttgacgacgatggcaggaaggcgctctgcaccgagtaccctaagattatgcaacagggcttcgcgtacctcccccggtggcgtgtgtgtgtcaagcatggngcgggcggtgtcgtacgagcaggcggtggcgtggaaggtcctgagcgacgacgacaccccgcactgccttgctttcatgntcggtgaccgggtccttccggggaaaaccccgtcccccctagtagaaaaacccaagttccctaacgtttgcggctcctgttgtttgaaattcgtaaccccatgtaccgccccctttttccttggggccccggaaaccctttaaaaacccccttttggatgtgtttatctccccccccgggagaaaaaaacactttttgaaaaaagtgggggcgccctcccggtgggggtggtattaaagaagaaaaaccccctgtttgtcccccccaaaaaaatttttggggcccccaaaaaaananagggaangagatattttcccatttaaagagaaaagaaaaaagggnnntttctctctcccccccccccccccaaatttttttttaaataatatat

SEQ ID NO: 81829 - DNA, 1239 bp, Zea mays
  misc_feature: Ceres CLONE 1567426
  misc_feature: Encodes the peptide sequence at SEQ ID NO. 81830
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (757)..(757): n is a, c, t, g, unknown, or other
  misc_feature (814)..(814): n is a, c, t, g, unknown, or other
  misc_feature (1097)..(1097): n is a, c, t, g, unknown, or other
  misc_feature (1106)..(1106): n is a, c, t, g, unknown, or other
  misc_feature (1162)..(1162): n is a, c, t, g, unknown, or other
  misc_feature (1191)..(1191): n is a, c, t, g, unknown, or other
  misc_feature (1199)..(1199): n is a, c, t, g, unknown, or other
  misc_feature (1208)..(1208): n is a, c, t, g, unknown, or other
  misc_feature (1209)..(1209): n is a, c, t, g, unknown, or other
  misc_feature (1211)..(1211): n is a, c, t, g, unknown, or other
  misc_feature (1212)..(1212): n is a, c, t, g, unknown, or other
  misc_feature (1231)..(1231): n is a, c, t, g, unknown, or other
nnttttnnnnnnnnnccatcctgggggggtaataattataaaaataaaaaaannnntggtggnnnnnnnnnnnnnnggtggagctcccgcggtggcggccgctctagactagtggtcccccgggctgcaggaattcgtctcacccctagaaaaagtctccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgcttcagtggaagatcaaagaggagtaagggattgttgtcaagtttcaagggtgcgccttgcctcccaaagatacctgtggtacaacggcctcctgggccgccctttcccaaaatgcctgaaaaaaaagggccaacacaccaggtttttttaaaagaaaaaagttttgctgtttttccccccccccagaaggggtttgtagccccccccccctccaaaaaaagaaagagccccctgcctcattggtggggataaaaagaacaggggggcgggcaagaaacacaccccccctaatggaagaattgttttttaataaagagggtggagggccacccaccccaccatgcccacaagggctcgcggcattgttgtgctcttacccccccccgcgacggctgggcgcgcgcagaaagaaatagagaatgaattgtgcgacgagattaccgcctcccgcgtaagntgtagtttgaagtggcatatgtgagggcgtcatgggtacaagtgttgcgaagtctgngaggcagaggccaagaacgaggctcgtactctttggcacgagtgggagatgggatgtgagtaaggcggctgagcgtcctgcttcgcagcgaacagtcattagagcaggtcgcgcgcagtggatgacatcggtgtactcaggtcatgagcggagagtgcagtgtgagagtgtaggcgcgcttagagagataatgagccggtaatcgcctccggtaagagccgctggagcggtgacatgaccgtaattcgtagggaggagaagaatagtctcggtcgctggacgnacgaatgcngttctcccgaggtctagtctggtggtgcctttactgtttgggtggtggcactctgngagatggagtgggcgtggcgatatcgacnctcactcntgcgactgnngnnggggatatgatctgctctnatacgctc

SEQ ID NO: 81830 - protein, 104 aa, Zea mays
  misc_feature: Ceres CLONE 1567426
  misc_feature (2)..(59): Pfam Name: Ribosomal_L38e Pfam Description: Ribosomal L38e protein family
MPKQIHEIKDFLLTARRKDARFSGRSKRSKGLLSSFKGAPCLPKIPVVQRPPGPPFPKMPEKKGPTHQVFLKEKSFAVFPPPQKGFVAPPPSKKRKSPLPHWWG

SEQ ID NO: 81831 - DNA, 1006 bp, Zea mays
  misc_feature: Ceres CLONE 1567428
  misc_feature (385)..(385): n is a, c, t, g, unknown, or other
  misc_feature (395)..(395): n is a, c, t, g, unknown, or other
tacccgcggtggcggccgctctagaactagtggatcccccgggctgcaggaattcgtctcacccctagaaaagtctctgagcgtgtgtctgtctgtcagtgagtaataaatggcagcgagcagcgtgcgtggctgaaggctgctgagcagagcagggcgagcgctcgctagtcggctagtgctgtgctgtgctgtgctgtgcagcggttgctcctcctggtcctgctactgctccgctctcctcgtcgcttgctcgtcttttttccacactgggcggatttctttctcgcaaggagcaggaggaggaggagggggaaaggtttgtccttttcttgcgagaaccctttcccccccatccggggggggggggggggtccaaaacctnaccctttttntgcttctactcccccaagagatttttcccccacagttttgggcccttggagccccaattcccatcccttgggaacaacccaagttggagggggcgcgccaaattcccgttgtgggcttggacctaaaaggtcccagaaactcccttttgccccccccagaccctgttttggagcccgttggggggaactcctcggctccccccccccgagttgtaggccccgccgcgcaggcttacgcccccccccccctcggcccgcgtggcgggccaccggggcaacacacgtactattgctgcagtggtggcctgcccctccgaggcgcgcgccaatgtgtggtggcccgagagcggcatagtggtgtgccgtagcaggttatggccgcggcgcttgcccaccccccgcgtctccgcgtttttcgtcccgcgccggcggcctgcctttgtcccccacgctgtgttgtgtctccccctctgccttgccccgccccttggggccgaggtggccagcctgtgcgccgctgctcagtgttggtcggcgccgggcagtccgcaggtctgtgcgggccgttgtcggccggtccctcgcctctgcccttggggttgtgttgtgga

SEQ ID NO: 81832 - DNA, 845 bp, Zea mays
  misc_feature: Ceres CLONE 1567431
  misc_feature: Encodes the peptide sequence at SEQ ID NO. 81833
ggagctcaccgcggtggcggccgctctagaactagtggatcccccgggctgcaggaattcgtctcacccctagaaaacaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgatatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaaatcccgtgtgaatcagcaaggaccaccttgcaaggctaaatactcctgggtgaccgatagggaagtagtaccgtgagggaaaggtgaaaagaccccccggtgggtagggaaatagaacgtgaaaccgtgctgagttcccaagcggtgggagggggaaagtgatctctgaccgccgtgcctggtgaaaaatgagcccggcgaactcatagggcggtggctttgggttaaggggaatgggaaccccacccggaagcccgtacgctaaaagccaagtctttcataaggggggaattggtcccactgcctttttgggaccccgcaaaacccggggggggaatcttatcccgtgggaacacagggatatag

SEQ ID NO: 81833 - protein, 39 aa, Zea mays; identical to SEQ ID NO: 59176
  misc_feature: Ceres CLONE 1567431

SEQ ID NO: 81834 - DNA, 841 bp, Zea mays
  misc_feature: Ceres CLONE 1567435
  misc_feature: Encodes the peptide sequence at SEQ ID NO. 81835
  misc_feature (807)..(807): n is a, c, t, g, unknown, or other
ggagctcaccgcggtggcggccgctctagaatagtggatcccccgggctgcaggaattcgtctcacccctagaaaaagctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcgccagcacggccaacacgtccgcgctgatgcagcagaacgcgccgctggcctcgtccaagccgtccgtgccggagacggagaccatccctccggaagagacgctggacgacggcgacggcgcggataccggcgatctgcgtggggacggagcccggcttgcccggaagctggccgtcatgaggaacgacatggcagcgggggtccgacgagcccggcttgcccacaaggaaggacggcggcgggaatgcggaggccgagcccaccaacaagccatctgaggatgggaacggggggccaacaaggaggcaaagatgaagtggcgacgagaaacagcgggggaacaagcgggtttcccggtacgccccgggccgaaccgtggtgccaaacctgttccgggcgaacgtggccgcgtggaaccccaaaaccagaaaggacggtggttaccctgggggaaaaccccttcccgggccggccggccnggccggggggggttttccaacccaaaaagcccgt

SEQ ID NO: 81835 - protein, 159 aa, Zea mays
  misc_feature: Ceres CLONE 1567435
MASTAYSRSSSNKLPGGERRLPPRLMRGLTSKFEPKKLGVGLVAGCCLALLTYVSLAKLFAVYSPVFASTANTSALMQQNAPLASSKPSVPETETIPPEETLDDGDGADTGDLRGDGARLARKLAVMRNDMAAGVRRARLAHKEGRRRECGGRAHQQAI

SEQ ID NO: 81836 - DNA, 855 bp, Zea mays
  misc_feature: Ceres CLONE 1567437
  misc_feature: Encodes the peptide sequence at SEQ ID NO. 81837
aagctggagctccccgcggtggcggccgctctagaactagtggatcccccgggctgcaggaattcgtctcacccctagaaaaaatcccagcacgtctcgtctccctccaaaaaaaaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctctaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatccccctgtacgagaagtacggcgagaacttcgtggacatgctggacggggtgttcgcgttcgtgctctacgacacccgcgacaggacctacgtggcggcgcgcgacgccatcggcgtcaacccgctctacatcggctggggcagtgacggttccgtctggatcgcgtccgaaaataaagcgcttaacaaggactgcgtgcgctttcagatcttcccgcccgggcaccttctactccagcgcccggcggcggggttccgcggggggggtacccccccccacttggttcccggaacaaggtgccccccggatggcgtaacaagccgccttgttccttcaaaaaaggcctcttcaaaaaaggggggtcatcaagaagggctccat

SEQ ID NO: 81837 - protein, 231 aa, Zea mays
  misc_feature: Ceres CLONE 1567437
  misc_feature (2)..(162): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIIPLYEKYGENFVDMLDGVFAFVLYDTRDRTYVAARDAIGVNPLYIGWGSDGSVWIASENKALNKDCVRFQIFPPGHLLLQRPAAGFRGGGTPPHLVPGTRCPPDGVTSRLVPSKKASSKKGGHQEGLH

SEQ ID NO: 81838 - DNA, 826 bp, Zea mays
  misc_feature: Ceres CLONE 1567448
  misc_feature: Encodes the peptide sequence at SEQ ID NO. 81839
  misc_feature (630)..(630): n is a, c, t, g, unknown, or other
  misc_feature (635)..(635): n is a, c, t, g, unknown, or other
  misc_feature (643)..(643): n is a, c, t, g, unknown, or other
cgcggtggcggccgctctagaactagtggatcccccgggctgcaggaattcgtctcacccctagaaaaaaaaaacgaaacggcgaccacatacaaaacagcgactcccttgttgccggctatagcttttgcctccgtttcgctttgataaataaaagccataactcccggccgtccatcgctcgcctcccctccctccctccccgccgctgtctccggcgacagccagcctcatcgtccatggcctctacatgcctagcccccgcctccctctccacgcccctgctctccgactccatcgcgcgcgcgcccgccgccaacgggcacgccaccaaccaccgacaccaccaccacgacgacagcgacggtgctgcggcggtctccgtttgcgacgacggcggcggggacccgttcgcgttcctctcggaggaccggccgccgagggaccgagggccgtccccggccgacccgttccgcaacggcacgccggcgtggggcggcggcgtgtacgcgtggtcgaggacgctgctgctcctgccggtcgcgttggtgcggctggcactgttcgggctctccatcgcgatcggctacgcggccacgtggggtggctctccgcgggtgggcggacacncacangaaggccncgggtgggcggcgggcctatgccgggcgtggcgcccgcggctcatgtggatcacgcggatctcagctcgctgcatcctcttctctttcggggaccattggatcaaaaaagaaaggaaggcccgctcgtagggagctccccccctattgttggttccaattcaaatctccgaaattagaaaccc

SEQ ID NO: 81839 - protein, 177 aa, Zea mays
  misc_feature: Ceres CLONE 1567448
  misc_feature (131)..(131): Xaa is any aa, unknown, or other
  misc_feature (132)..(132): Xaa is any aa, unknown, or other
  misc_feature (135)..(135): Xaa is any aa, unknown, or other
MASTCLAPASLSTPLLSDSIARAPAANGHATNHRHHHHDDSDGAAAVSVCDDGGGDPFAFLSEDRPPRDRGPSPADPFRNGTPAWGGGVYAWSRTLLLLPVALVRLALFGLSIAIGYAATWGGSPRVGGHXXEGXGWAAGLCRAWRPRLMWITRISARCILFSFGDHWIKKERKARS

SEQ ID NO: 81840 - DNA, 767 bp, Zea mays
  misc_feature: Ceres CLONE 1567452
  misc_feature: Encodes the peptide sequence at SEQ ID NO. 81841
  misc_feature (490)..(490): n is a, c, t, g, unknown, or other
ccccgcggtggcggccgctctagaactagtggatcccccgggctgcaggaattcgtctcacccctagaaaaacttcctccgctctcagcttaccccaccacaggcgagggaggcgactccttcctcgcggctacccgctccggccccgatcgcatctcctttgcacgccacggcccgcgcgcagtgtccaccggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacagagcattagagcaattatcttggagttgcagatctgtacctgaagattcatattgaaatctggaaagctctgctngtgagtacagagaaatatttcttggccttttggaggaaaacacgccaaaaacccccccaaaaaaggggaaaaaaaagggggggtttttttttttttgggtgggccccccccccccccgaaaagggggggggggaaaaaaaaaaaaacacaccccccccccccccccccccttttttttgttttttaaaaataaaaaaaaagaagggagattttttttttttttttcccccccacccccacacccccaccccgggcgcggggggggggggggacacac

SEQ ID NO: 81841 - protein, 77 aa, Zea mays
  misc_feature: Ceres CLONE 1567452
PRGGGRSRTSGSPGLQEFVSPLEKLPPLSAYPTTGEGGDSFLAATRSGPDRISFARHGPRAVSTGTAVLRVWGRIWC

SEQ ID NO: 81842 - DNA, 790 bp, Zea mays
  misc_feature: Ceres CLONE 1567458
  misc_feature: Encodes the peptide sequence at SEQ ID NO. 81843
ctccccgcggtggcggccgctctagaactagtggatcccccgggctgcaggaattcgtctcacccctagaaaaagtgtagcctctccaccgcgcccacttcttatactgccagcgtctgctccctctcgcggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacattaagtacagccgccctcaggatgctggatgggatgccaaggagtttgataatgagactccatacactattatgtttggtccagataagtgtggatcaaccaacaaggttcatttcatccttaagcacaagaatcctaagactggaaagtatgttgagcatcatctcaaattcccaccatctgtcccatatgacaagctctctcatgtctacacggctatcttggagccagacaatgaggtcaaaattttgggtagatgggggagaa

SEQ ID NO: 81843 - protein, 196 aa, Zea mays
  misc_feature: Ceres CLONE 1567458
  misc_feature (24)..(196): Pfam Name: Calreticulin Pfam Description: Calreticulin family
MGGRALLLLLLVSALVFQIHASDPLLYEPFDEDFEGRWVVSKKDEYQGVWRHAKSDGHEDYGLLVSEKARKYAIIKELDEPVTLKDGTVVLQFEVRLQNGLECGGAYIKYSRPQDAGWDAKEFDNETPYTIMFGPDKCGSTNKVHFILKHKNPKTGKYVEHHLKFPPSVPYDKLSHVYTAILEPDNEVKILGRWGR

SEQ ID NO: 81844 - DNA, 811 bp, Zea mays
  misc_feature: Ceres CLONE 1567461
  misc_feature: Encodes the peptide sequence at SEQ ID NO. 81845
agctccccgcggtggcggccgctctagaactagtggatcccccgggctgcaggaattcgtctcacccctagaaaaaattccttccacttccactctctctttgcttccccgccctctccgccgcgcttttgctgatccgtgtgctgtgtgtgtgtgtgtgcgcgcgcgcgcgcttcaacttgaagaagcgcgggcgatcgagatggcgcacgaccccagcctgggcttcgcggactacttctcggcggcggcggcggctgcggcggcgggcgccacggcgatggacgacgacgtcggggcgccggagctctatggcctgcatgccgacgacatggagttcctcggcatgcgtggcctggccgccatgccccctgccgcggcacaccaccaccaccaccaccatcacggccacagcaaggccggtgcgctcctcgacgacgacgacgcgggggtggggccagacgtcagcggctccgcggacgacgccaccatgcgcttcctgagcgagcagcagcagcagcagcagcaccaggcgccgctgtcgctgtcgctgtgccggccggacgtgacgacgacgttgcacgagcagcaccacctcgccggcggcggctcctcgtcccggtaccatcaggagcagcagccgggcggcgtgggtgcagcagcagcagcacgactactcgccgtcgccgcagcagcacgcgtggcacctgcggcagctcagggttcctcgtcccggccgcaacaggttcctgcaggagttcctgccgccttccccgggggacagcagcagcgctgcccgccttccagaaag

SEQ ID NO: 81845 - protein, 203 aa, Zea mays
  misc_feature: Ceres CLONE 1567461
MAHDPSLGFADYFSAAAAAAAAGATAMDDDVGAPELYGLHADDMEFLGMRGLAAMPPAAAHHHHHHHHGHSKAGALLDDDDAGVGPDVSGSADDATMRFLSEQQQQQQHQAPLSLSLCRPDVTTTLHEQHHLAGGGSSSRYHQEQQPGGVGAAAAARLLAVAAAARVAPAAAQGSSSRPQQVPAGVPAAFPGGQQQRCPPSRK

SEQ ID NO: 81846 - DNA, 836 bp, Zea mays
  misc_feature: Ceres CLONE 1567463
  misc_feature: Encodes the peptide sequence at SEQ ID NO. 81847
  misc_feature (773)..(773): n is a, c, t, g, unknown, or other
  misc_feature (800)..(800): n is a, c, t, g, unknown, or other
  misc_feature (802)..(802): n is a, c, t, g, unknown, or other
  misc_feature (808)..(808): n is a, c, t, g, unknown, or other
  misc_feature (809)..(809): n is a, c, t, g, unknown, or other
  misc_feature (831)..(831): n is a, c, t, g, unknown, or other
tggagctccccgcggtggcggccgctctagaactagtggatcccccgggctgcaggaattcgtctcacccctagaaaaagttccgcttcgtcccagcctctagttcttcctttcctccagagtgatggccaaatgctactcagattggccaccgattccgcctttccatccatcgcgaagaacgccgccgcaatcccacgcctccccgatcacgatcaggcggcagctcgtgtccttcgtgctccagtgctccagatcctgcgctcccctcctcgagcccaagaacctgcccgatgagttcgaggccgtgccggcgacgacgacgccgccgctgccggacgccgccccgaagctggggatttctaacaagttcatccgaggcctctgcggcgacccgcagaccgagcagctggccttcgagggctacaggagggcgctgctgcagcccgagttccggctggagaagaagacggccaacgcgctgaccctgcagctgatcagggagaagcagtggggctcgctggagctgctggtcgaggacttcagggcccacggcgtgctcccggagaagcggacgtgcgcgcggctcgtcgcctgctgcatcagggcggggcggttcggactcgccgacgcggtgctcggggtcgtcgaggcgaagaagggagcccccgctgccatggccttcagcgcggccatgcaggcgtacaacaggctgcacatgtacccggagaacggtgcttctgtacgggccaggcgagggtggccccgcctgncgctgaacgccgacgcctaccctgccncnatggcnngcttgcggcgcgctgggcgagnccgga

SEQ ID NO: 81847 - protein, 237 aa, Zea mays
  misc_feature: Ceres CLONE 1567463
  misc_feature (217)..(217): Xaa is any aa, unknown, or other
  misc_feature (226)..(226): Xaa is any aa, unknown, or other
  misc_feature (229)..(229): Xaa is any aa, unknown, or other
  misc_feature (236)..(236): Xaa is any aa, unknown, or other
MAKCYSDWPPIPPFHPSRRTPPQSHASPITIRRQLVSFVLQCSRSCAPLLEPKNLPDEFEAVPATTTPPLPDAAPKLGISNKFIRGLCGDPQTEQLAFEGYRRALLQPEFRLEKKTANALTLQLIREKQWGSLELLVEDFRAHGVLPEKRTCARLVACCIRAGRFGLADAVLGVVEAKKGAPAAMAFSAAMQAYNRLHMYPENGASVRARRGWPRLXLNADAYPAXMAXLRRAGRXR

SEQ ID NO: 81848 - DNA, 810 bp, Zea mays
  misc_feature: Ceres CLONE 1567466
  misc_feature: Encodes the peptide sequence at SEQ ID NO. 81849
ctccccgcggtggcggccgctctagaactagtggatcccccgggctgcaggaattcgtctcacccctagaaaaaagctccgctctggttcctggtccaggggccttccacgccttccctttccatggcgtccagggatctccggcgcctgctcgacggtgtcgccctcgtcgcgcgcgaggccacgcggggtacctccctgcgtgatgtcctcaggtctgcgctccttgccaccaccgacctcgccggcctcaccagaggcaccccgcgccgtccgccgcaccctccaggcgcaggaccgctgcccgccaccgaatcctcccgcccctcctccgtcgtgtacttctcccacgatgaagccacggcgtcgccgcaagatcatgcactggagcgtccgccgccagcgcaagaggccccgcaccccgcgcggacgcaggagaccgtccgaactggtacaaccgcctccgttgcagccgaacctgctgccgtcgcggcggacaggcccgaacctgcggcacctcctcccgatccctcgcctttgccccaacaggcgccccctttggcctcagcggcgcctggggagaagaggaggcggctgcgggaacggaaggttccatccacgcccttcaccagagcactcgggtttgcaggactgggcgccgggttagcgtggggcactgttcaggagtcggcccgtcggggtatgatgcggggagcagcgctcaaggtggggcagatgctgagcatccaggacgaatcccttgtacttccgccggtgttagcagctcttgatattgttcgtcaaggtgct

SEQ ID NO: 81849 - protein, 229 aa, Zea mays
  misc_feature: Ceres CLONE 1567466
MASRDLRRLLDGVALVAREATRGTSLRDVLRSALLATTDLAGLTRGTPRRPPHPPGAGPLPATESSRPSSVVYFSHDEATASPQDHALERPPPAQEAPHPARTQETVRTGTTASVAAEPAAVAADRPEPAAPPPDPSPLPQQAPPLASAAPGEKRRRLRERKVPSTPFTRALGFAGLGAGLAWGTVQESARRGMMRGAALKVGQMLSIQDESLVLPPVLAALDIVRQGA

SEQ ID NO: 81850 - DNA, 801 bp, Zea mays
  misc_feature: Ceres CLONE 1567468
  misc_feature: Encodes the peptide sequence at SEQ ID NO. 81851
gagctcaccgcggtggcggccgctctagaactagtggatcccccgggctgcaggaattcgtctcacccctagaaaaattctcctcctgcgggtctcctcgcccagcggactcctactctgctgcgctccgctccgttccgttccgctcccttcctctcggcagcaatcgaatgtctcccgacgtagacgccgccgtggcaaccgccgtcgctgccgggggaggctgcggcggtgacggagaggcgggcggtggcgcgtcgtcgtccccggcgtccgcggcggcggcgaacgggcgggcgttggtgcggtgggatcagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgtggggggtcatgcgggagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaggggtgcggtggacttccttgtgaaaccagtgagaaagaatgaactgcgtaacttatggcaacatgtgtggaggcggcatgcaatgaatttgcagacaaatggatcagaaaataatgcaggcagcaatcatattagtgccaacgttgctaaggggtcaaagacaggaaaaaaacagt

SEQ ID NO: 81851 - protein, 210 aa, Zea mays
  misc_feature: Ceres CLONE 1567468
  misc_feature (56)..(172): Pfam Name: Response_reg Pfam Description: Response regulator receiver domain
  misc_feature: SWISSPROT Homolog: EC 3.1.4.17 3',5'-cyclic-nucleotide phosphodiesterase
MSPDVDAAVATAVAAGGGCGGDGEAGGGASSSPASAAAANGRALVRWDQILPRRSLRVLLVEHDDSTRQVVTALLRKCGYRVAAVADGMKAWGVMRERAYAFDLVLTEVAMPSLSGIQLLSRIVAADECKNIPVVMMSSQDSIGTVLKCMQRGAVDFLVKPVRKNELRNLWQHVWRRHAMNLQTNGSENNAGSNHISANVAKGSKTGKKQ

SEQ ID NO: 81852 - DNA, 815 bp, Zea mays
  misc_feature: Ceres CLONE 1567472
  misc_feature: Translation starting site: 655
  misc_feature: Pfam Name: POX Pfam Description: Associated with HOX
  misc_feature (597)..(597): n is a, c, t, g, unknown, or other
  misc_feature (604)..(604): n is a, c, t, g, unknown, or other
  misc_feature (739)..(739): n is a, c, t, g, unknown, or other
  misc_feature (740)..(740): n is a, c, t, g, unknown, or other
ctccccgcggtggcggccgctctagaactagtggatcccccgggctgcaggaattcgtctcacccctagaaaaaatgggccactactgctagagctagtgctagtagcagcgtggagaggcagagaagtagccaaagccaagtaggaggaggaggaggagcggcaggtagggcgcggggcgagagcttgacgcggcaaccaccgctgcactgcactgcactgcaccccctagctcctccgagctcagcagctcgctcgcggcaagtcgccatccatgtcaggaaagatttatctggtcggccgatcgagctcctctccttctccgaagcactgaagctccagcggctgccctgcctgacagccacttcgcacgaccaaattaaaaagcgtgggtgcagcagcagcagcacgactactcgccgtcgccgcagcagcacgcgtggcacctgcgcagctccaggttcctcgtcccggcgcagcaggtcctgcaggagttctgcagcctccccgtggacagcagcagcgctgccgccctccagcagcgcgccaaggccgcaaaatagccggccccgcagcagcagcaagaagacggcggcngcgccgnaggggtcgtcgtcgtcggcctcctgggcgccgtcgccgcagatccaggccatggacgcgctggagctgcagcggctcaaggaaagctctacatcatggctggaagaggtggaccggagatacccggcgtactgcnnagcaaatgcgggcgctgggcggcgggttttaaggccgtggcccgggaacccccccgccggcggcggtacaccggg

SEQ ID NO: 81853 - DNA, 860 bp, Zea mays
  misc_feature: Ceres CLONE 1567475
  misc_feature: Encodes the peptide sequence at SEQ ID NO. 81854
  misc_feature (610)..(610): n is a, c, t, g, unknown, or other
ctccccgcggtggcggccgctctagaactagtggatcccccgggctgcaggaattcgtctcacccctagaaaaaccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaggccctccgcggctgggcgccgcgccgcgccgacacgttcgagaagcttaataagataggatcgggcacgtacagcaacgtgtaccgggcgagggacaccgtctctggccggatcgtcgctctttanaaggtccgcttcgataacctcgagccaaaaagcgtcaagtttatgggcccgggaaaatactgatcctaaaggagaactcgaccacccccaacattcatcaaattagaagggcttgggtccacttcccaggaatgtcatgccagcccttttacctttgtcctcccaagtaccttgggaagcaaggatccttggctgggtccttggccggcaaagtttggtgaatgttccaaagtttcccccgtttggcccc

SEQ ID NO: 81854 - protein, 148 aa, Zea mays
  misc_feature: Ceres CLONE 1567475
  misc_feature: SWISSPROT Homolog: EC 2.7.11.22 Cyclin-dependent kinase
  misc_feature (128)..(128): Xaa is any aa, unknown, or other
MGCVFGRAAASSSAAPKKKWGKGRSSPQPEAGSPSAVAATDGDGRPRRRLGGRRASGPRQGCVPAAAAAEQLAAGWPPWLVAVAGEALRGWAPRRADTFEKLNKIGSGTYSNVYRARDTVSGRIVALXKVRFDNLEPKSVKFMGPGKY

SEQ ID NO: 81855 - DNA, 831 bp, Zea mays
  misc_feature: Ceres CLONE 1567476
  misc_feature: Encodes the peptide sequence at SEQ ID NO. 81856
ctggagctccccgcggtggcggccgctctagaactagtggatcccccgggctgcaggaattcgtctcacccctagaaaaacccctatcccaccacccgtgcctcgtcgtatcgccgttctacgcaaccgcagcgaaaaggagcccaggcgataaaaaagaaaaagggcgaggccgtcgaaaagggaagcgcagccgcagagtgggtgaaaggtggggggacgattcggagagatcgagaaagaggagagagagagggacgggggcggggccggcggaagcggagcctgcgcccgccggaccgaatcctcgccggatcgcccggcctgccggggcggcgctgcggacggcctgatccggctggaatggcggcgggccgacgagggatctagcggaggtgggtgtcgcgcggcaatggctgcggcggaggcgcggcgccggtcagcggtctgggctctgctgccgctgctgctgcggctgctccacccggccgcgctcgtgctggccaacaccgaaggtgatgccttgcatagcttgaggactaacttaaatgatcctaataatgttctacaaagttgggatcccactctggtcaacccctgcacttggtttcatgttacctgcaataatgacaacagtgttatcagagttgatcttggaaatgctgcactatcaggaactttggttcggcaacttgggcagctcaaaaacttgcagtacctgggagctctacagtaataatatcagtggcactatacctagtgaaacttgggaatcttacaaacttgggtcagtttgggatttgtactttgaccaactttccttggtcccat

SEQ ID NO: 81856 - protein, 107 aa, Zea mays
  misc_feature: Ceres CLONE 1567476
  misc_feature (31)..(71): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAEARRRSAVWALLPLLLRLLHPAALVLANTEGDALHSLRTNLNDPNNVLQSWDPTLVNPCTWFHVTCNNDNSVIRVDLGNAALSGTLVRQLGQLKNLQYLGALQ

SEQ ID NO: 81857 - DNA, 931 bp, Zea mays
  misc_feature: Ceres CLONE 1567477
  misc_feature: Translation starting site: 225
  misc_feature: SWISSPROT Homolog: EC 6.1.1.6 Lysine--tRNA ligase
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (70)..(70): n is a, c, t, g, unknown, or other
nggggggnnagggccgcccccgttgcgcattttttaattgtttccgagtgggtagaagnnnnggaaagantttagaggtgggagtccccgcggtggcggccgctctagactagtggatcccccgggctgcaggaattcgtctcacccctagaaaaagcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaagcttacagatgtggcagagtgtttagctggggaggatcatgaacaagagaacatcgtcgtcgaagctattcttttatgatctttatggtggtgggatgaaggttcaagtgatggctgatgccaggacctcagagttggatgaagctgaaattttctaagtaccactcagggtgtgaagccgaggtggatattgttggcatatgggggatatcccaggaaaaaagccacccgagggggagcttaaggtgttattttccaaaaaaaatttggtcggtcccctccccctccatggtccttccatattgaatgcccctcccaacc

SEQ ID NO: 81858 - DNA, 802 bp, Zea mays
  misc_feature: Ceres CLONE 1567480
  misc_feature: Encodes the peptide sequence at SEQ ID NO. 81859
  misc_feature (712)..(712): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaaccgtccacctcagctcccatatccgctcccctacctctccagcatcctcccgtctccgtcgtctcgtctccgctcctcacctcgccagccatgggcaagatcaagatcggaatcaacggtttctcgaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttctctgacaaggacaaggctgctgcacatctgaagggtggtgccaagaaggttgttatctctgccccaagcaaagatgcgcccatgtttgttgttggtgtcaatgaagacaagcacacctccgatgttaacattgtttccaatgctagctgcaccacaaactgccttgctccccttgctaaggtcattcatgacaactttggcattattgagggcttgatgacactgctcatgccntcactggcacccagaagactgttgatggaccctcaacataggactggagaggaggcaggactgccagctctnacatcattcccagcagcg

SEQ ID NO: 81859 - protein, 170 aa, Zea mays
  misc_feature: Ceres CLONE 1567480
  misc_feature (1)..(112): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MTYMFKYDTVHGQWKHSDIALKDSKTLLFGEKPVTVFGIRNPEEIPWGEAGAEYVVESTGVFSDKDKAAAHLKGGAKKVVISAPSKDAPMFVVGVNEDKHTSDVNIVSNASCTTNCLAPLAKVIHDNFGIIEGLMTLLMPSLAPRRLLMDPQHRTGEEAGLPALTSFPAA

SEQ ID NO: 81860 - DNA, 873 bp, Zea mays
  misc_feature: Ceres CLONE 1567481
  misc_feature: Encodes the peptide sequence at SEQ ID NO. 81861
tccccgcggtggcggccgctctagaactagtggatcccccgggctgcaggaattcgtctcacccctagaaaaactacttttaacgttattttacttattccgtgggtcggaagcggggcacagcctctcatcgccaactcggagaccttgagaggaaagccatcgcgcgctagggcctagggcagggcacgagcaaaggccctcccgcgggttccattggagcgcgagcgaacggcgccgactcggcaacacacgttagctttattcgctatggcatcgccatcgtcgtcgtcctggctgctgctgctgctctcgtgcctcgcgcttgccctgctcgcggcggacgccgaagtgcaccaccatgagttcgttgtccaagagacgccagtgaagaggctgtgcaagacgcacaacgtcatcacggtgaacgggcaatacccggggccgactctggaggtcagggagggcgacacgctggtgatcaacatcgtcaaccgggcgcagtacaacgtcaccatccactggcacggcatccggcagatgataaccgggtgggccgacaggccggacttcgtgactcagtgctccatcaggccccgcggcagctacaaataacggttcaccatcaagggggcaagaaggcacccttttggtggcacgcccacaactccttgcttaagggaaacccgtttaccgggcccctcatcatccgcccccaggggagaaaatggaacctacccctttcgccaaaaccctcttggggaaaagcccccggtcattcctttgggggaaatgggagagggacttccaaaccccgaaatcaactttcttcccggggaagggcgccaataaggaaaagggcgggggcgcccc

SEQ ID NO: 81861 - protein, 114 aa, Zea mays
  misc_feature: Ceres CLONE 1567481
  misc_feature (34)..(115): Pfam Name: Cu-oxidase_3 Pfam Description: Multicopper oxidase
  misc_feature: SWISSPROT Homolog: EC 1.10.3.2 Laccase
MASPSSSSWLLLLLSCLALALLAADAEVHHHEFVVQETPVKRLCKTHNVITVNGQYPGPTLEVREGDTLVINIVNRAQYNVTIHWHGIRQMITGWADRPDFVTQCSIRPRGSYK

SEQ ID NO: 81862 - DNA, 898 bp, Zea mays
  misc_feature: Ceres CLONE 1567482
  misc_feature (55)..(55): n is a, c, t, g, unknown, or other
  misc_feature (96)..(96): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (118)..(118): n is a, c, t, g, unknown, or other
  misc_feature (121)..(121): n is a, c, t, g, unknown, or other
  misc_feature (124)..(124): n is a, c, t, g, unknown, or other
  misc_feature (130)..(130): n is a, c, t, g, unknown, or other
  misc_feature (136)..(136): n is a, c, t, g, unknown, or other
  misc_feature (195)..(195): n is a, c, t, g, unknown, or other
tggagctcaccgcggtggcggccgctctagactagtggatccccgaggctgcagnatttcgtctcacccctagttattgtgcctgcgccataagancctgtttgggagaannnnnttnccntcnaaatcnaaccangctctgaacatccgtaaagcaacccccctctccattccaaacaagccctcctgcctccnttcctgggctagctgtcaggacggctcagctccagctttgcggccctccagctctccccagttcaagttcaatattggcgagcatgcgagtttgccctcttccgtcgtcgtcatcatcatcgtcctcgcgatcccggcgtccctgtttcggcctacgcctcccgtagacaacaggtgcgccctgctctccggcaagctatggacaaccccgaaccgcttcccccctctgctccccggcaagaggaagaagaagacacgcaagatcaccgatgctatcaaagccagcggcaactagtgccccaaggtgaagccggtcgaagtcgaactcctcgacccgacgcttgggggaggcctacgtacaggacgtcgtacccgaccgagcttctcggtcccccgggaaggaccggcaaccattaggaaagcgggttgatcaaactggtgggtgggtgaaaggaaaagcgatctggtccaaatttctaaactgcagcttctcccccggccatggaagccccgtcccgggcccgaacaaagaacgtggcactgtgatcaccttcggccctaaagaagaggggggggtggacaacatcccaccaaagagatagaccgtagtgggccccaaacaatccagatctcaagcggacatttgcttcccggttcacgggtccctaataaggagggccctggttaacacttcctacagagg

SEQ ID NO: 81863 - DNA, 839 bp, Zea mays
  misc_feature: Ceres CLONE 1567487
  misc_feature: Encodes the peptide sequence at SEQ ID NO. 81864
ctccccgcggtggcggccgctctagaactagtggatcccccgggctgcaggaattcgtctcacccctagaaaagtctccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctaggtacttttggaacctaagctattagacctgtcagtgttggatgtctggatcttgcatttttggagaaatccaatttacctcgttcaaggatgcaagtatatttcttgtttaactgcacattactttatatttatgcctgtttcataaaaaaaaaaaaaaaaaaaaaagagcccgcaatacaaaatccggaggaactcccaggaggcgaaaagcagatccgtctcccccgaacgggcgatcgcttatcgacttgtagcggaagccatgggcgtcggccagcgcttatctgcgggcacgggagcagtgggagggcccctccaggcgcacgttcgggccgcgattcagtaagacgcacccttgcgcggacttgaatgggccgaccgcccaaccgatgtgcagggcaa

SEQ ID NO: 81864 - protein, 69 aa, Zea mays; identical to SEQ ID NO: 8575
  misc_feature: Ceres CLONE 1567487
  misc_feature (2)..(69): Pfam Name: Ribosomal_L38e Pfam Description: Ribosomal L38e protein family

SEQ ID NO: 81865 - DNA, 790 bp, Zea mays
  misc_feature: Ceres CLONE 1567490
  misc_feature: Encodes the peptide sequence at SEQ ID NO. 81866
ctccccgcggtggcggccgctctagaactagtggatcccccgggctgcaggaattcgtctcacccctagaaaaaatcggacatcggagagatgcgcgcgggcggcggcgcgcctccccgacacgcaccactctccccgaccgcctctgccactgccacgctactagtacccgcttctgtcgccatgcccacgccgcgcctcgcacacctccgccacctcctctcattccgctccgcccttccccgcccgctgggtcccaaccaaagccacccgctccccgggtcggttcacccgtctcttctcctcccccgtgccatggctggtgtcgcgtacgcaggtctggcgacggggtcggcggaatacgaggaggtgctcgggtgccttgcgtcgctgataacgcagaaggtgcgcgcggacaccggcaaccgcggcaaccagtgggagctcatggccaagtacgtccagatactggaactggaggaatccatcgcgcagttgaaagtggttcacgttgctgggaccaaagggaagggttcaacatgcacatttgctgagtcaatccttcgatcatgtggtttccacactgggctcttcacttcaccacatttgatggatgtccgcgagcgatttcggcttgatgggctggacatttcagaagaaagtttattaggtatttctggtggtgctggaacacactgaaggacaagactgggtgatggtgtaccgatgccggcctactttaggttccttgcactgctagcattcaagatcttttcagatgagcaggtgg

SEQ ID NO: 81866 - protein, 171 aa, Zea mays
  misc_feature: Ceres CLONE 1567490
  misc_feature: SWISSPROT Homolog: EC 6.3.2.17 Tetrahydrofolate synthase
MPTPRLAHLRHLLSFRSALPRPLGPNQSHPLPGSVHPSLLLPRAMAGVAYAGLATGSAEYEEVLGCLASLITQKVRADTGNRGNQWELMAKYVQILELEESIAQLKVVHVAGTKGKGSTCTFAESILRSCGFHTGLFTSPHLMDVRERFRLDGLDISEESLLGISGGAGTH

SEQ ID NO: 81867 - DNA, 826 bp, Zea mays
  misc_feature: Ceres CLONE 1567491
  misc_feature: Encodes the peptide sequence at SEQ ID NO. 81868
  misc_feature (821)..(821): n is a, c, t, g, unknown, or other
  misc_feature (826)..(826): n is a, c, t, g, unknown, or other
ctggagctcaccgcggtggcggccgctctagaactagtggatcccccgggctgcaggaattcgtctcacccctagaaaaaacacagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccaccatcagagtaggcagctacaacggggaggagatatatgcgccgttcaagagcctcctacccatggtgaacccagacgaccttgtgtttggaggctgggacatcagcagcatgaacctggcagatgccatgaccagggccaaggtgctggacattgacctgcagaagcagctcaggccctacatggagtccatggtgccacttccgggtgtctatgatccggacttcatcgccgctaaccagggctctcgtgcccacatgtcatcaggggcaccnagaan

SEQ ID NO: 81868 - protein, 202 aa, Zea mays
  misc_feature: Ceres CLONE 1567491
  misc_feature (62)..(202): Pfam Name: NAD_binding_5 Pfam Description: Myo-inositol-1-phosphate synthase
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFIAANQGSRAHMSSGAPR

SEQ ID NO: 81869 - DNA, 829 bp, Zea mays
  misc_feature: Ceres CLONE 1567494
  misc_feature: Encodes the peptide sequence at SEQ ID NO. 81870
  misc_feature (292)..(292): n is a, c, t, g, unknown, or other
  misc_feature (294)..(294): n is a, c, t, g, unknown, or other
  misc_feature (737)..(737): n is a, c, t, g, unknown, or other
  misc_feature (760)..(760): n is a, c, t, g, unknown, or other
  misc_feature (770)..(770): n is a, c, t, g, unknown, or other
ccccgcggtggcggccgctctagaactagtggatcccccgggctgcaggaattcgtctcacccctagaaaaattagcaatttttgactcgtgcgtgcgtgactacagttgcatgctatggccatggtcaccacttcgccggcaactgtgcagccatcatcatgcaagcacacgagccgcggcgcggcgcggtgctgccctcctcctctgctgtcctggaagacacgaagctttgggcagcaggtgacgacaagggccacggcggcgagctcccgtgggcagcccgcgggcgngncacaggcagggggagaagagggcgacagtatcaggcggctgcagaacgggtcggacgtgcggggcgtcgcgctggagggcgagaaaggccgggccgtggacctcacgccgctggcggtcgaggccatcgccgagagcttcggggagtggctgcgagaggaggagctccggctccggggccaggagcccgagcagctgcgtgtgtccgtcggccgcgacccgaggctgtcggggccgcggctcagcgcggcgctcttcgcggggctcgccagggcgggctgctccgtcttcgacatggggctcgccaccacgccggcctgcttcatgagcaccatactgccacgcttcaactatgacggctctattatgggtagtgaagtaatgatacggtattttacgtttgcgtccgtgttggtgtgcgtgcatgccatgcaaatgcatgtngtttcacttgtccattactacgnttccggatcnggagttgcatgcatgcaaaatgacggcgtcacaccctcccctacaacccgaaacgggcc

SEQ ID NO: 81870 - protein, 237 aa, Zea mays
  misc_feature: Ceres CLONE 1567494
  misc_feature (71)..(214): Pfam Name: PGM_PMM_I Pfam Description: Phosphoglucomutase/phosphomannomutase, alpha/beta/alpha domain I
  misc_feature: SWISSPROT Homolog: EC 5.4.2.10 Phosphoglucosamine mutase
  misc_feature (59)..(59): Xaa is any aa, unknown, or other
  misc_feature (60)..(60): Xaa is any aa, unknown, or other
  misc_feature (215)..(215): Xaa is any aa, unknown, or other
MAMVTTSPATVQPSSCKHTSRGAARCCPPPLLSWKTRSFGQQVTTRATAASSRGQPAGXXQAGGEEGDSIRRLQNGSDVRGVALEGEKGRAVDLTPLAVEAIAESFGEWLREEELRLRGQEPEQLRVSVGRDPRLSGPRLSAALFAGLARAGCSVFDMGLATTPACFMSTILPRFNYDGSIMGSEVMIRYFTFASVLVCVHAMQMHVVSLVHYYXSGSGVACMQNDGVTPSPTTRNG

SEQ ID NO: 81871 - DNA, 678 bp, Zea mays
  misc_feature: Ceres CLONE 1567497
  misc_feature: SWISSPROT Homolog: EC 1.10.99.1 Plastoquinol--plastocyanin reductase
  misc_feature (349)..(349): n is a, c, t, g, unknown, or other
  misc_feature (350)..(350): n is a, c, t, g, unknown, or other
ggagctccccgcggtggcggccgctctagaactagtggatcccccgggctgcaggaattcgtctcacccctagaaaaaaagcctgtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcagccggtgaggggcttggcctgagcatgggcgcgagcgcgcccagcgagcatgtgtgccagcggcgagcagcatctccgccgaccgcgtccccgacatggagaagcggagctgatgaannctctcttctcggcggcatctcgttgcccaccgtcggcatggccgtcccctacggggggcttttttcgtccctgccgggttcggggaacccccggggggggggaccttacccaaaaggaaaagttggggaaaccaacttccccggggggaggggggggtcaaaaaggcaaggggccccaaaaaaccccacaccttttgggaaggggggcccccggggggggaccccccccctccccttgtgggggggggaaaaaagaaaaaaaaaccctggccccccccctgggggtaaaaaccccccgggggggggccaccccccccgggggggggga

SEQ ID NO: 81872 - DNA, 743 bp, Zea mays
  misc_feature: Ceres CLONE 1567498
tccccgcggtggcggccgctctagaactagtggatcccccgggctgcaggaattcgtctcacccctagaaaaaagcagctcggctcgcaccccgtcggctccccgccacggccctttcaacccaaaagacccgtttctcggacgccgcgccccgcgcctccagcttaaaccccgaagcgcagttcctagtgcatcgccgccgcggccgccgctgagagtagtcatgtgcgagtgtgccccggcgcagtcctaacggtacgtaggtctctccacggtggggtttagtgaagttaagaaaacaccgccatggggtgacagggccggggtcaaagggcgggccatggggcttttccaggcggcaagccccccaagtccgcagggtggcccgggaaaggcgggcgtcctcctttttcttcggggggggccttaacttcgggggggccccgcgggttcccccccgcccgggggtgggggggccccttttccaaaggggggttgggggggcctttcggggggggggccctttttgggggggggggggatttttttccccggggggttttttttttttggggaaccaaggggtggggccccccccccccggggccccccggggggggggggcgcgccccccaaaaaggggggtggtgcccccccaaaaaaaaattttttttttgtgggcgcgcggccccccccctctttttgtagagaggaaggggcttcttctcccccggggggaggga

SEQ ID NO: 81873 - DNA, 988 bp, Zea mays
  misc_feature: Ceres CLONE 1567499
  misc_feature: Encodes the peptide sequence at SEQ ID NO. 81874
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (94)..(94): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (122)..(122): n is a, c, t, g, unknown, or other
  misc_feature (181)..(181): n is a, c, t, g, unknown, or other
gttgtgttnnnnnctnctatatgcatacataatcgagcgaagaagagagaagtatattaaccacaaaaagaaaggtccagcggggggggtttcnttttnnntgtccaagctggtactccccncggtggcggccgctctaaaactagtggatcccccgggctgcaggaattcgtctcacccnctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgcccaaggtgcccctgagatcctcaagctcaacatggctctcatcctgctgccgttctgccggaaattcgcctaacaaccctaagggccaaccgggctttagcaatttcaataaccccttcaaaaaaaaaaattaaaatttccaaaaaagggccattgccgccttgtcccattcggggaattggccccaaaagggggatttccaaaacgggttttgtgaaaaaccgtgttaacccttgggaaaatttccccaaaaaggggtttaaaaaaaagttttgccccccaaagggggagaaaaaattttttctgtggggccccccacccttttggggggggggggcaaaaaaattttttccccctttttaaaaaagaggatgcggccgcaaaatattttttttctcttgggggggcctttttttttttctggagaaaaaaaaacaaaccccccccccggggggggtggtttttcccccggggaaaaaaaacccccccccccggtggaacacaccctcaccataaatagggggggtggcgatattttctcccccctcaatcaaaaaaataagggaggtgagaaaaaaaaaaaaaatttcacctctctctccgaataattgagaaaaaaaataattttgttaa

SEQ ID NO: 81874 - protein, 31 aa, Zea mays
  misc_feature: Ceres CLONE 1567499
MGYCVCVAQGAPEILKLNMALILLPFCRKFA

SEQ ID NO: 81875 - DNA, 825 bp, Zea mays
  misc_feature: Ceres CLONE 1567501
  misc_feature: Encodes the peptide sequence at SEQ ID NO. 81876
  misc_feature (512)..(512): n is a, c, t, g, unknown, or other
agctccccgcggtggcggccgctctagaactagtggatcccccgggctgcaggaattcgtctcacccctagaaaaagccccagcctcgccgtccggcgctgccctgtcccatctcaccgcagctcgctcccacctcgagccgcgagcgcgcccgtagcagtctcaacgcgggcactcgcttgcgtaccccaggccgatcgacgagtccgcccggcccgcgtctcacgcgtgagcctgttgcgcgcggtggcttgttgttcgatcatattcgtgtacgggcaccccgcacggccggagaatcacttgccagccccagccccgttttccggggctcctcatccctcgcctcgccggtgttgcttcccggaggtttccgctgccgctgcgtgccggtgccgcgggcaggcgcaggaggctctcggctgtttccttagcgtgccatcgtccatggaggcgaagcagcgcccgcggcacggcgagggagaggaggccgccggcgacggacaacggcngcggcggcggcggcggcaaggagtacgacccatggacggcgtggctctacaagccgcacaccatctcggtgctcctcgtcggcgcctgccttctcatctggggcagtggagcactcgatccctgaagcgctgctgctcacagtagcttgacatcaatcaagaggggtgtctgggctatgattgcagccttccttgcctactgcacgcttcaggcacctttcacgatacttattaggccccatcctgctgtctggcgcctggacatggactggctgtcgtttacctcgttgctcttacctttcttcttttccag

SEQ ID NO: 81876 - protein, 45 aa, Zea mays
  misc_feature: Ceres CLONE 1567501
MIAAFLAYCTLQAPFTILIRPHPAVWRLDMDWLSFTSLLLPFFFS

SEQ ID NO: 81877 - DNA, 669 bp, Zea mays
  misc_feature: Ceres CLONE 1567502
  misc_feature (246)..(246): n is a, c, t, g, unknown, or other
  misc_feature (273)..(273): n is a, c, t, g, unknown, or other
  misc_feature (276)..(276): n is a, c, t, g, unknown, or other
  misc_feature (283)..(283): n is a, c, t, g, unknown, or other
  misc_feature (284)..(284): n is a, c, t, g, unknown, or other
  misc_feature (292)..(292): n is a, c, t, g, unknown, or other
  misc_feature (293)..(293): n is a, c, t, g, unknown, or other
  misc_feature (626)..(626): n is a, c, t, g, unknown, or other
  misc_feature (646)..(646): n is a, c, t, g, unknown, or other
  misc_feature (647)..(647): n is a, c, t, g, unknown, or other
ctggagctccaccgcggtgggcggccgctctagaactagtggatcccccgggctgcaggaattcgtctcacccctagaaaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctnccgggcgacggcccacttttatcacgnctngcgcggnncgcgcagnngtggctctccaacggggccctgcctcccgccccccggtctaggggggcgcccttccctcattcgggcgggggggaatttccgcccaaaattccggggggcccaaaaaaaacacgttttaaaaattttacccaaacccccccggaaaaacccaggggagggggggggggggtcccccggggaaaaaccccgggtttttaaaaccaaggggggccccaaaataaataaatttttttaaaaaaaaagtgtctcccccccccccaaaatataaagccccccccccccccacaaaagagaaaagagggggagggtttttttttttctccccccccccntggtttttttgttggggggnnaaaaaaaaaaaaaaaacccccc

SEQ ID NO: 81878 - DNA, 835 bp, Zea mays
  misc_feature: Ceres CLONE 1567503
  misc_feature: Encodes the peptide sequence at SEQ ID NO. 81879
ctccccgcggtggcggccgctctagaactagtggatcccccgggctgcaggaattcgtctcacccctagaaaaagtctcgcaccgtcgcggccacccattctctctcgtccatcgcatcgctccggctcccagcgcaatcgatccatccgtccctaggtagtgcttcagctatgcagttcagcagacgtgcttcccctagagggaaaagcgtgtatgagcccagtgaggagaggcagtggaggttatgggagtgagaggatgaggatcaactgctgcagcatcaggcgcaacaaggcactgaggaggatgtgtttcactgcaaagggtgctgtgagcagcacgcagtgtgtgctcacatcagatgctggcccagacactcttgtcgtccgaacatccattcggaggaattatgctgatcctaatgaactcgctgccgtcattttgggtggtggtaccgggactcagattgtccctctcacaagcacaagggccacccctgctgttcctattggaggatgttacaagcttattgatatccccatgagcaactgtttcaacagtggcataaacaagatatttgttatgactcagttcaactcatcttctcttaaccgtcacattcatcgtacctatctaggtggggggatcaacttaactggatggatctgttgaggtgctggatgccacacaaaatccctggggaagcctgcctggttgttccaggggcacaggagaaccccggttagaaaatttatcctggggaccttgaggattaattacaacgcttaaagcctttggaaccccatttttgatttttgctcaagaaaaccacct

SEQ ID NO: 81879 - protein, 152 aa, Zea mays
  misc_feature: Ceres CLONE 1567503
  misc_feature: SWISSPROT Homolog: EC 2.7.7.27 Glucose-1-phosphate adenylyltransferase
MSPVRRGSGGYGSERMRINCCSIRRNKALRRMCFTAKGAVSSTQCVLTSDAGPDTLVVRTSIRRNYADPNELAAVILGGGTGTQIVPLTSTRATPAVPIGGCYKLIDIPMSNCFNSGINKIFVMTQFNSSSLNRHIHRTYLGGGINLTGWIC

SEQ ID NO: 81880 - DNA, 826 bp, Zea mays
  misc_feature: Ceres CLONE 1567505
  misc_feature: Translation starting site: 126
ctccccgcggtggcggccgctctagaactagtggatcccccgggctgcaggaattcgtctcacccctagaaaaaagagtgcgcctctccttattgctcaccccaaagcaaagcaagcacgaagaaatgggcgagataggcacggaccaccgcggcctagtagccgaggccgaggccggcggcagcggcaaggaggagggcatggtcctcggcgacgaggaggaggaggaggagacttcgccggtggagcaggtgcggctgacggtgccgtcgacggacgacccgtcgctgccggtgtggacgttccggatgtggagcatcgggctgctgtcgtgcgcgctcatgagcttcctcaaccagttcttctcgtaccggacggagccgctgatcgtgacgcagatcacggtgcaggtggcgtcgctgccgctgggccacttcatggcccgcgcgctgccgcgcgccaggttccgggcgcccgcgctgctgggcggcggggagtggagcctcaacccggggcccttcacatcaaagagcacgtgctcatctccatcttcgccaacgccggcttcgcgttccgcaacggcagcgcctacgccgtcgccatcatcgacatcatcggcgctttctaccacgccacatctccttcttcaccgcctgggctctcgtcgtcaccacgcaggtgctccgggtacgggtggggcagggctgctgcccaagtacgtggtgcagccggcgcacatgtggtggccgggcacgctcgtccagggtttccctctttcggggcattgcacgaagagggcgaatccggcaaaagcctcccgccaaat

SEQ ID NO: 81881 - DNA, 777 bp, Zea mays
  misc_feature: Ceres CLONE 1567509
  misc_feature: Encodes the peptide sequence at SEQ ID NO. 81882
agctcaccgcggtggcggccgctctagaactagtggatcccccgggctgcaggaattcgtctcacccctagaaaaaaggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatggtacccacgcaccctttcgtttactgtcaaaatattttcctttttttttgcttttaagagttcgtaggtgaagtttttttttgtgctgctgttcaccaacgctgtagacattggggtgatgagtggagcggccatgtacatcaagaaggacctgaatatcacggacgtgcagctggagatcctgatcgggatcctcagtctctactcgctgttcggatccttcgctggggcgcggacgtccgacaggatcgggcgccgcttgaccgtcgtgttcgccgctgtcatcttcttcgtggggctcgttgctccggggtttcgccgtcaactaccggatgctcatggcggggccgctcctgggcgggagtccgggtgggctacgggggccatgatcccccccgggtaccccgccgaaatttcgcccgggggggtcccgggggtttccgaacccccttcccggaaggggttcattaaaattggggacccgggtttgggtacctggccaaaatttggggtttccggcccctccccc

SEQ ID NO: 81882 - protein, 132 aa, Zea mays
  misc_feature: Ceres CLONE 1567509
MYIKKDLNITDVQLEILIGILSLYSLFGSFAGARTSDRIGRRLTVVFAAVIFFVGLVAPGFRRQLPDAHGGAAPGRESGWATGAMIPPGYPAEISPGGVPGVSEPPSRKGFIKIGDPGLGTWPKFGVSGPSP

SEQ ID NO: 81883 - DNA, 770 bp, Zea mays
  misc_feature: Ceres CLONE 1567512
tcaccgcggtggcggccgctctagaactagtggatcccccgggctgcaggaattcgtctcacccctagaaaaaagacaaagcacgagccacgcacggcccccgctgcctcccttccgccgccgccgccgccgccggcgcgccaccgtcgctgctctcccgccttcaccgcgcccaactccaatccttgcctcccccgcgcgcttcagcctcttcactccccatcgttttcgcctggccagatccaggtttccttgaccgagacctcgcctgctttacgcctccggtcggattcttcgccgtccttgtccccactgggcacggctggggtggagcggagatcggatccgccgggagctgattccttctctcgcagtctagtttgacgctgattcatttgctggtcggcatagcatgatcctgcggtggatgcggataacttgtgcaaagctggtggcttggggggttgtctttttaaatctggcctaaagatatcctgagacggtaccgtcacatggatgctagtacagaaggtactgatgctattgggggcggggggctttaaacaatggggcccccgggaaatttccccccaatgaaaagggaaaaggggccccccaaaaaaaccccattggcttggctaaatggggccccttccggggaaaaacgggaggggaatcacccccttcttaaagaaataaaaaatgggaaacccccctcccaattccccggaaaaaaaaaacccccccgattttcttgggggggggttcta

SEQ ID NO: 81884 - DNA, 884 bp, Zea mays
  misc_feature: Ceres CLONE 1567515
  misc_feature (507)..(507): n is a, c, t, g, unknown, or other
ctccccgcggtggcggccgctctagaactagtggatcccccgggctgcaggaattcgtctcacccctagaaaaaagggccccacgcgtcggcgggcgcgcgccgccgaacgaaaccatcccggcaaggcaagcaagcaaccgtggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcactcgcatccggtagctcgatcacttcttcctctggattttgggaaaggagcatcggacgtcggatgcatgacacactcattgcattagcgcctacgcctaccgcaagtggaagcctatggatctcaaagcagccctctctggtacaatcttctgccttctgcttctatttctgcgtgggctgcagatgtcggcccttcngaaaatagaggccacccagaacgcaggccctcagggtggaatgcctccccacaccttgcccggaaaaacccctgaaaacctgttttgggaatttttttgaggaaaatcaaccattgcagggactggggggaatatgggcaaaaacttttgtcaaaaacaaaggttttcaaaagttggggggttttctataccccttaaaaaattggccccgggggcccataatggaaagaaaacccccccccggttttggggggccctttatttctcaattcgtgttttttccccaacaaaattttggtcctccagaaggaggagggggcccccccgtaaagaagaggccccccgggggggggggtgtgtgtgttttttaacaacct

SEQ ID NO: 81885 - DNA, 822 bp, Zea mays
  misc_feature: Ceres CLONE 1567516
  misc_feature: Encodes the peptide sequence at SEQ ID NO. 81886
tccccgcggtggcggccgctctagaactagtggatcccccgggctgcaggaattcgtctcacccctagaaaaaagaccccactaccattaccaaccagagcgacaagcccgaccgcccgcttccttgcaaacgaaacaaaacaaaacaatggcgacagcgagtgagatcgcggcggtgggcgtaataggcgcggggcagatgggctcgggcatcgcccagctcgccgccgccggaggctgtgccgtacttctcctcgacgccgaccccactgccctctcccgtgccgtcatctccatctccgcctccctacggcgcctcgccgccaagggccagctctcccaggccgcgtgcgaggactcaataaagcggataaggtgcgtctccgccgtgcaggatctcagggacgcggatcttgtgatcgaggccgtcgtggagaacgaagctgtcaagaagaagctattcgtggagctggataaggtcacgaagccctcggccatcctcgcctccaacacgagctccatctccataacccgcctggcttcagctaccaaacgcccctctcaggtgataggcatgcacttcttcaaccctccctcggtaatgaaactgatcgagattatccgaggagccgatacgtcagatgaaggtgttgctgcggtcagatcttttctcgaagactcgggaagtcgttatatgctcgcaagattacccaggatcatcgtggaccgcatcctcatgccaatgatcaacgagcccttctgggctctggacaccggagtggcaccaaaggagacatcaacgcagggatgaacttgggccca

SEQ ID NO: 81886 - protein, 220 aa, Zea mays
  misc_feature: Ceres CLONE 1567516
  misc_feature (9)..(181): Pfam Name: 3HCDH_N Pfam Description: 3-hydroxyacyl-CoA dehydrogenase, NAD binding domain
  misc_feature: SWISSPROT Homolog: EC 1.1.1.157 3-hydroxybutyryl-CoA dehydrogenase
MATASEIAAVGVIGAGQMGSGIAQLAAAGGCAVLLLDADPTALSRAVISISASLRRLAAKGQLSQAACEDSIKRIRCVSAVQDLRDADLVIEAVVENEAVKKKLFVELDKVTKPSAILASNTSSISITRLASATKRPSQVIGMHFFNPPSVMKLIEIIRGADTSDEGVAAVRSFLEDSGSRYMLARLPRIIVDRILMPMINEPFWALDTGVAPKETSTQG

SEQ ID NO: 81887 - DNA, 1043 bp, Zea mays
  misc_feature: Ceres CLONE 1567520
  misc_feature: Encodes the peptide sequence at SEQ ID NO. 81888
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (21)..(21): n is a, c, t, g, unknown, or other
  misc_feature (60)..(60): n is a, c, t, g, unknown, or other
  misc_feature (61)..(61): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
nnnggccgannnnccccccantttccttccgggcgcgtgtgccttctcgttttttttttnntccccnnnnnnnnaaagatggaactccccgcggtggcggccgctctagaatagtggatcccccgggctgcaggaattcgtctcacccctagaaaaaagcgagcccccgtcccgctcccttcctgctacctgctggccgctgccctttccttcccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgacaacccgggatctggggccccttccctcctcaagcagggcgcgccaacccccatgggtgttcaaaccaaggggccggggggggccccccgccggcgcaacttcgaagtttccgcccgaagccgccgcccccccattggggcccccttccaaaccgaaaccccggcgcaaaaggggcgccccccaaaaagcctcccgaaacccctcccgccccctggaagaagccttcccacaccgtttggcccccccgcgccgccacattttcacagtggggggggggcctcttgggggcccccccaacagcctgtaaacccccaaatccccccggtttcccttagaaaagggggccccccggtcccccaaaattccgtttcaccgccccccccccctccaaaaaagggccccttgcccccaacaggggagaaagggcccaaaaaccccacaaagcccgcggggggaaccccgggggggcggaacaaaaacccccccgccagcttttggggccttgtccaaaaaccttagaaacaaaggg

SEQ ID NO: 81888 - protein, 155 aa, Zea mays
  misc_feature: Ceres CLONE 1567520
MGVQTKGPGGAPRRRNFEVSARSRRPPIGAPFQTETPAQKGRPPKSLPKPLPPPGRSLPTPFGPPAPPHFHSGGGASWGPPQQPVNPQIPPVSLRKGGPPVPQNSVSPPPPPPKKGPLPPTGEKGPKNPTKPAGGTPGGRNKNPPASFWGLVQKP

SEQ ID NO: 81889 - DNA, 793 bp, Zea mays
  misc_feature: Ceres CLONE 1567522
  misc_feature: Encodes the peptide sequence at SEQ ID NO. 81890
ggagctcaccgcggtggcggccgctctagaactagtggatcccccgggctgcaggaattcgtctcacccctagaaaaaagtcatcgccaccggaccaccgtcacgcggagctctctcctactctcctcttcccctctaaaaccccacgaaatcgccgaaaggagtagcggacgcagcccccaccaccacttgttcaatctctctcctctcccgtctcgcctcccggagcgcaagaaaagctcggattcctggtggtttctaccatcctccgtcctcgatctgagcgttgcctgcttccctgcccccccgctcagatgtccgccttccgtgtcctgtaaaatctttcgccgcgcagcaatctccccccacttgtcggctgtcctgctgctgctgctgccaatggcgaccaagggagggaacgcaaggggcgttccggtgggggcgctgctggtggccgcgctcctccttagctccttggttcccacctccgcgtcctcgtaccccgcaagggtcgtgagcgggttcctctccaatgcggcgtcggcggtggtgaagcggctgtggtcgctcaaatccaccaccaagacagcagcgagcgggggaaagtctatggtgaagtacgagggcgggtacactgtggagacggtcttcgacggcagcaagctggggatcgagccctactccgtggaggtcacccagagcggcgaactactcgtcatggactccatgaacagcaacatctacaggatggcgctgccgctgtcccgaatatagagggcaaaagcttgttgcc

SEQ ID NO: 81890 - protein, 124 aa, Zea mays
  misc_feature: Ceres CLONE 1567522
MATKGGNARGVPVGALLVAALLLSSLVPTSASSYPARVVSGFLSNAASAVVKRLWSLKSTTKTAASGGKSMVKYEGGYTVETVFDGSKLGIEPYSVEVTQSGELLVMDSMNSNIYRMALPLSRI

SEQ ID NO: 81891 - DNA, 1107 bp, Zea mays
  misc_feature: Ceres CLONE 1567531
  misc_feature (1)..(1): n is a, c, t, g, unknown, or other
  misc_feature (15)..(15): n is a, c, t, g, unknown, or other
  misc_feature (70)..(70): n is a, c, t, g, unknown, or other
  misc_feature (73)..(73): n is a, c, t, g, unknown, or other
  misc_feature (75)..(75): n is a, c, t, g, unknown, or other
nccctttaccccttnttcttttcctccataccaatgagagagacaaaaagatgttccttccagtggttanccncnaaaattggggctccccgcggtggcggccgctctagaactagtggatcccccgggctgcaggaattcgtctcacccctagaaaaagtccacatccatcgtccccttccgtctcgcgcctgtccccccgccttcccctcccggatccccttgggcagcctgatcccgcgatgcataatgcccgcctcccacatatccgaggcgcctccgctggggactcgtccggtttctgtgggctcaaccttactggcgtgggggcgtaattctaacaggaccacggagccgggtggtgcatgagcgctgagatgccccgtcgctgctctgcctacgagcactgtgctcccccgagaggcgccctgatctaccagctacccaatttcgatatccggcctccccggtcagaatctaatctagatcattatctatgggagaaaaagtttatgcgttgctggcacgtgaatacacaccagttagacattgcagccttaccagatgccaggagtgctctatctaagaatatgcttcccacccatggccccctgcctttttattccccacgagaataaaccgccccctccccaatgggggtgggccctcctttggccttttcgaaaactcagggaagttttcgcccggaacccaaaattggcaactaatggaagaccccccccccgcctttaaatgatctctttcttttacgagatgccggagaaattatcaaccggtgggattttttccccacgcgcgttataacccattttttcccaggaggatgcaggggcgcccctttttctcgggggacggggaacactttgcatggtctacccactctttgcgtattcgcggcttggcaacgacaaacgaagagaacaccccgcgcaatgtgtctccggggggattccatggtccctctttcggggacaaaaattaataacccaccgcttgtcaccccaagagggaggccctctttgtgttggcgccaccctctcttaaagggatgggcgggataacccccgtgccgtaatcctccttttg

SEQ ID NO: 81892 - DNA, 782 bp, Zea mays
  misc_feature: Ceres CLONE 1567532
  misc_feature: Translation starting site: 273
  misc_feature: Pfam Name: LUC7 Pfam Description: LUC7 N_terminus
  misc_feature (743)..(743): n is a, c, t, g, unknown, or other
ctccccgcggtggcggccgctctagaactagtggatcccccgggctgcaggaattcgtctcacccctagaaaaattcctgaggaacaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgccatggacgcattccggaagcaactggatgtgctcatgggcgctaaccgcaacggcgacgtcgaggaggtgagccgcaactactacgaccgcgacgtctgccggctcttcctcgccggcctttgcccccacgacctcttccagctcacgaaaatggatcttggtccttgttctaagattcactcgcttcaactgcggaaagattatgaagaagcgaaagcaaagggaacagagattttgacagagaactcgaggatatgatagaaaggctcattgtggagtgcgacaggaaaattcagaaggccctgaaacgacttgcggatgacgatgccaaggctgctattgcgatatccgtctcggaaggtactctgacggatgacatactgcagctgtcaaacagatcagggaaaaatggtagaaagtgatggcttttgattttgagggaaaactgatgataaataaaggccccagaangtgtgggagaacccaaactaaaaaagctgatttgcggcc

SEQ ID NO: 81893 - DNA, 824 bp, Zea mays
  misc_feature: Ceres CLONE 1567534
  misc_feature: Encodes the peptide sequence at SEQ ID NO. 81894
tccccgcggtggcggccgctctagaactagtggatcccccgggctgcaggaattcgtctcacccctagaaaaagtttcctcgtccggagcgaggcgaggggtgacgcaaccgagcgccgccaaccgcgaccgccttcctcacctgtgtcacctccgccgccatcctcacttcgatcgcctccgccgtcatcctcagcttgtcctgtcgcactgcttgtgccgcaccagcttgttgccttccgcgcccggctgcgccagccaggctcgtccggccctcgcgccgcttacttctattttgcccggccccatagaattcgaaccgcaaatgagacaggcgctactgcagccgtgggaaaggaaacgcaaaacaacgccaacgccgtcttctcttcctggaggcgggcctgggaaggaggtggagcgcagctggctccgctagggtttcccctgttctcggtggaggcgccgcgcctccgggacacgggctgcgtcaggtgactgctgcagagccccttgatgcaagggaggtcaagccgtctgtgattctcttccagaagttctatcccgatgccgtccatcacgcactacgtgctggatcgcctcctagagacacggtcgcctgttcatgtccagaaaggtggttcccaaagctccccccccgccctcctgacaaggccacaccgggtgcccagtgtctactgtcagggacaacggtcgtcgctggccatcacttctatgccacgccttgaagaacaacaaccctgccaagaacttgccttttcctcgtttccccgggaaaccttggtcggccataacctcaatca

SEQ ID NO: 81894 - protein, 85 aa, Zea mays
  misc_feature: Ceres CLONE 1567534
MPSITHYVLDRLLETRSPVHVQKGGSQSSPPALLTRPHRVPSVYCQGQRSSLAITSMPRLEEQQPCQELAFSSFPRETLVGHNLN

SEQ ID NO: 81895 - DNA, 840 bp, Zea mays
  misc_feature: Ceres CLONE 1567536
  misc_feature: Encodes the peptide sequence at SEQ ID NO. 81896
ggagctccccgcggtggcggccgctctagaactagtggatcccccgggctgcaggaattcgtctcacccctagaaaaactcgatccggaaacctctcaaaccgtaggcgcctcctggaagtttcagagctcaggaatctgcgccatggcgagtgagacggagaccttcacatttcatgctgagatcaaccaggctgctctcactcatcatcaacaccttctactccaacaaggagatcttcctccgcaagcttatctccaactcttccgatgcgctggacaagatcaggttcgagagtctcgctgacaagagcaagctcgatgcgcagcctgagcttttcatccaccttgtcccagacaaggtcacgaacacgctctccatcatcgacagcggtatctgcatgaccaaatccgaccttgtcaacaacttcggtaccatcgccaggacctgcacgaaggagttcatggaagcccttgctgccagagctgatgtgtccataatgggccagttcgacgtcggtttctactctgcctacctcggcaccgatagagttgacgagaccacccagcacaacgatgaccagcactgcatgtgggagtcccaagccggcgcggctttcccctgttacacgtgagcctttaggggagaaactttgttggggggaccaaaatcacagggggtccctaaggaaccattacctggaagtccttggagggaggaatgcccaccaaggatacaggggctaaaaacccccctggaagattggcgtccccccccccaattcccgagaggggacttgaaaaatttccacccgaaacggggtaaatttttggaaaaaaa

SEQ ID NO: 81896 - protein, 152 aa, Zea mays
  misc_feature: Ceres CLONE 1567536
MLRSTRLLSLIINTFYSNKEIFLRKLISNSSDALDKIRFESLADKSKLDAQPELFIHLVPDKVTNTLSIIDSGICMTKSDLVNNFGTIARTCTKEFMEALAARADVSIMGQFDVGFYSAYLGTDRVDETTQHNDDQHCMWESQAGAAFPCYT

SEQ ID NO: 81897 - DNA, 734 bp, Zea mays
  misc_feature: Ceres CLONE 1567543
  misc_feature: Translation starting site: 149
  misc_feature: SWISSPROT Homolog: EC 2.4.1.13 Sucrose synthase
  misc_feature (338)..(338): n is a, c, t, g, unknown, or other
  misc_feature (476)..(476): n is a, c, t, g, unknown, or other
  misc_feature (477)..(477): n is a, c, t, g, unknown, or other
gagctccccgcggtggcggccgctctagaactagtggatcccccgggctgcaggaattcgtctcacccctagaaaaaaaaccctccctccctcctccattggactgcttactccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcacccntttgaagacattcttcgtgctgctcaggaagcaattgtgctccccccatgggttgcacttgctatcagggcaaggccctggtgtctggggattacattcgggggaaatgttaattgaagcttgcctgtggaggaaacnntaaaggtttccgaagaactggcattcaaaggaaaaactgggggggtggggaaattcccaacgcaaacttttggctttggcgttttttttttaaccccctaaaagaggccctttttttccccggcttccttggggggggaaaaaccccccccaaaaaaaggggggggggtttttttttttaaaacacccacccccgtgtggtgcaaaaaaaaatttttttcccccccacaaaaaaaaaaaaaaatttttttccccccc

SEQ ID NO: 81898 - DNA, 864 bp, Zea mays
  misc_feature: Ceres CLONE 1567545
  misc_feature: SWISSPROT Homolog: EC 6.2.1.12 4-coumarate--CoA ligase
  misc_feature (352)..(352): n is a, c, t, g, unknown, or other
  misc_feature (427)..(427): n is a, c, t, g, unknown, or other
  misc_feature (766)..(766): n is a, c, t, g, unknown, or other
tccccgcggtggcggccgctctagaactagtggatcccccgggctgcaggaattcgtctcacccctagaaaaaatttatttccgcctcgtctcttccccgtctcgacagcatcactgccgtgtagtgtagctagagcccctgcactggtccggattcgcagagcaaaacggaaatgatcactgtggcagcaccggaggcgcagccgcaggtggcggcggcggcggttgcggcgccggaggagaccgtgttccggtcgaagctgccggacatcgacatccccacccacctgccgctccacgactactgcttctcgagggcggcggaggccgcgggcgcgccgtgcctcccctnccccggccaggggggggaggtacacttactcctaaactctcctcctgtgccacaaggacgcggcgtgcccccacnggctcggcgtcgcccatggcaaccccgtcatgctcctgctcccaaaatcccgttagttccggctccccctcttcggcccgcccttcctccgggcccgtcacccacaaccccccaccactttctcacccccccaggaaaaaccaccaacaaatcccccgcccaccgcaaacaaaatcacccctcccccattctccctcccggtcgtcgaaagcctccggcgtaaacccttttccacaggaacctccttataccaccaacccctcttactagtcacccacggtacacgcgggtaatctcgtttaaaatccccccgcattccttcccctcggacctccccgnccacattctccccgctctcccctccctctgaccccacctcctttcctatattgggaatttcgaatatcacccctccgctatcattccccctcagctcc

SEQ ID NO: 81899 - DNA, 807 bp, Zea mays
  misc_feature: Ceres CLONE 1567546
  misc_feature: Encodes the peptide sequence at SEQ ID NO. 81900
  misc_feature (538)..(538): n is a, c, t, g, unknown, or other
  misc_feature (547)..(547): n is a, c, t, g, unknown, or other
  misc_feature (548)..(548): n is a, c, t, g, unknown, or other
tggagctccccgcggtggcggccgctctagaactagtggatcccccgggctgcaggaattcgtctcacccctagaaaaaaccaccgccaccgccaccgccggctcctgctgccaccgcccgctggctggcttagcgcgtaggctgtgactgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcggcttccgcttctcccgcctcatcgtcttcctcctcttcctgcccaccccgcccatcaaccccgccgcgcacctcgtctcgctcgtgtcctcgccccgcgtggcgctcgcgggggccaacgcccacggcacgatcaccangaccaccanncaccacaacacggttacacccaccacaacaacggtggccgccgacatcggggggggccacccgaaccaacaccaccaccggcaaggccccgttttttgttggccggccacccgattccgggtccccgccctgggcccccccggaaccccagggaggttccttaagggggcaccgatatcctcccccccctgtcataaaagggcgaggggagaccaccaaacccccggggggggggaacccccagagggcccgttttttc

SEQ ID NO: 81900 - protein, 186 aa, Zea mays
  misc_feature: Ceres CLONE 1567546
  misc_feature (97)..(97): Xaa is any aa, unknown, or other
  misc_feature (100)..(100): Xaa is any aa, unknown, or other
MKLPLLRPLWPGLGPAAAGPPDAAPEPAKPSLPATWLLLHALFCATSMAVGFRFSRLIVFLLFLPTPPINPAAHLVSLVSSPRVALAGANAHGTITXTTXHHNTVTPTTTTVAADIGGGHPNQHHHRQGPVFCWPATRFRVPALGPPGTPGRFLKGAPISSPPCHKRARGDHQTPGGGEPPEGPFF

SEQ ID NO: 81901 - DNA, 804 bp, Zea mays
  misc_feature: Ceres CLONE 1567548
  misc_feature: Encodes the peptide sequence at SEQ ID NO. 81902
ctccccgcggtggcggccgctctagaactagtggatcccccgggctgcaggaattcgtctcacccctagaaaaaagccaaacccccaagaacacaccgtctcgggatatcccagagtcccggcttccgatctcttcccttccccccgccgccggaaagatcccggctttttgggttccgcggcgagggataggccccaagaaggaggagggggcctcacggcggcggccttgcggtcgatgcgatcggttgacgcggcgggggcggagagctcggatcaccacaacctcaagaagccgcgcctggaacccaggaccaagatgccgctcgcggatgccgttgcggccggtgacagcggcgggggtgtggatgccgcggcggcgggcgccaacttctttggcatgacggtcgaggagatcgtgcagcacccgctgccgggatacggggcgccggcggttctcagcttcagccccgacgaccgccgggtcgcctacctatacagccccgacggcacgcttcaccgtaaggtgtttacccttcgatcccgcgcggcgtttgccaggaattgctctttcgggccccccgacggtggcgggggtccaggaaggggaacctctccgcccaagaaccctctgcggggccgagcccccccgggaagccccggctccggggcccccgcctacaagtgggcctctcgcccttctgggggaaacccccccgcgccggcttttgtcggcccccctcccttccgggggtttaccttccggaattttttcggcttctaaaccaatggcgggaaacaaca

SEQ ID NO: 81902 - protein, 154 aa, Zea mays
  misc_feature: Ceres CLONE 1567548
MPLADAVAAGDSGGGVDAAAAGANFFGMTVEEIVQHPLPGYGAPAVLSFSPDDRRVAYLYSPDGTLHRKVFTLRSRAAFARNCSFGPPDGGGGPGRGTSPPKNPLRGRAPPGSPGSGAPAYKWASRPSGGNPPAPAFVGPPPFRGFTFRNFFGF

SEQ ID NO: 81903 - DNA, 2051 bp, Zea mays
  misc_feature: Ceres CLONE 1567551
  misc_feature: Encodes the peptide sequence at SEQ ID NO. 81904
aattcgcctctgcgcgcaatgcagtgatctccccccccccctctctctctctctacctaactcttgtctgttgatgctgttcatcaggacctgtgctgagctttggagcagctagtaattaagcctagagcgctagcagtccttttggatttcggttcggaagcaaggcgtgccggactcccaaatcccaatcccaagcaagcagtgtgcagatggcaacgcagtggttctccaacatggtgatggacgagccgagctttttccaccagtggcagtccgacacgctgctggagcagtacacggagcagcagatcgcggtggcgttcggccagggggagccggtggaccacgccgtggcggcggccctggcgacggcgatgcccatgcagctgcagcagcccgcggcggccgagcagccgcaccaccgcccgcgcaaggcggccaaggtcaacaccagctgggactcgtgcatcacggagcagggctcccccgccgcggactcctcctcgccgaccatcctctccttcggcggccacaccgcgttcgccaaggccgagccgacgacgcaccagccgcccagcggctgcgccgggtactacggcgccgccgccgccgcgaaggcgccgaagcaggagatgatggacgccgccgcgatgccgccgttccagcaggcgcgccaggccaagcgttcctacgacgacatggccacggtggccgaggccgccaacgcgcgcccggcctcccagaaccaggaccacatcttggccgagcggaagcgccgcgagaagctcagccagcgcttcatcgccctctccaagatcgtccccggcctcaagaagatggacaaagcatcggtgctcggcgacgcgatcaagtacgtgaagcagctgcaggaccaggtgaaggggctggaggacgacgcccggcggcgcccggtcgaggcggcggtgctggtcaagaagtcccagctgtcggccgacgacgacgagggctcctcctgcgacgagaacttcgttgccaccgaggcttccggcactctgccggagatcgaggcccgggtgtcggaccgcacagtgctggtcaggatccactgcgagaaccgcaagggggtgctcatcgccgccctctccgaggtcgagcgccttggcctctccatcatgaacaccaatgtgctccccttcacagcctcctccctcgacatcaccatcatggccatggctggtgacgacttctgcttgtctgtcaaggatattgtcaagaagctaaatcaagcgttcaaatcatccttctgatgggtttagcttctgaccaaacttaatctaggccaacctttttttccattagccttaaggatttgaggctaatggtaaggttttcaggttcttccttgccttgcttccgaagagagttgcttgctgtcccccaacagtgccccccaaagatagccatttccactgttttttgctgcatgggtgcagaggtttattacctagttacccaccatcctattttctctccctccagttttttacatggtttgatcctgtcactccatgtttttgggagggagcagattgtaaaaaaaacaaaaacaaaaagaagtgaccagcctttttctagggctttgctatataggccggggagttcctaattttcctctctcccctttgccagtatgtttgccctttcaccttgtttttccatgagaggattgtgtttgtcaaacacaaaaaaaaccctacctttgccgtcctctcaatcttgatcacactgctcccaggaaagcttcaattgtggagaaaatggcaccatcttttttttttcagctctgagggggactttgcaagccttgatttggaagtactgtaggggtgccacttccttttttttttgagggtcctacaggttggccaccacttgatggaccctttgcttatagttccacatgtgagctttgttgtcacaggatcaatgtgtagttgttgctgtttactctcacacaagcataaaaataaataaatgtgcttgtttgccaaaaaaaaaaaaaaaaa

SEQ ID NO: 81904 - protein, 359 aa, Zea mays
  misc_feature: Ceres CLONE 1567551
  misc_feature (178)..(227): Pfam Name: HLH Pfam Description: Helix-loop-helix DNA-binding domain
MATQWFSNMVMDEPSFFHQWQSDTLLEQYTEQQIAVAFGQGEPVDHAVAAALATAMPMQLQQPAAAEQPHHRPRKAAKVNTSWDSCITEQGSPAADSSSPTILSFGGHTAFAKAEPTTHQPPSGCAGYYGAAAAAKAPKQEMMDAAAMPPFQQARQAKRSYDDMATVAEAANARPASQNQDHILAERKRREKLSQRFIALSKIVPGLKKMDKASVLGDAIKYVKQLQDQVKGLEDDARRRPVEAAVLVKKSQLSADDDEGSSCDENFVATEASGTLPEIEARVSDRTVLVRIHCENRKGVLIAALSEVERLGLSIMNTNVLPFTASSLDITIMAMAGDDFCLSVKDIVKKLNQAFKSSF

SEQ ID NO: 81905 - DNA, 817 bp, Zea mays
  misc_feature: Ceres CLONE 1567553
  misc_feature: Encodes the peptide sequence at SEQ ID NO. 81906
  misc_feature (543)..(543): n is a, c, t, g, unknown, or other
  misc_feature (553)..(553): n is a, c, t, g, unknown, or other
  misc_feature (554)..(554): n is a, c, t, g, unknown, or other
  misc_feature (559)..(559): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (576)..(576): n is a, c, t, g, unknown, or other
  misc_feature (584)..(584): n is a, c, t, g, unknown, or other
  misc_feature (624)..(624): n is a, c, t, g, unknown, or other
  misc_feature (639)..(639): n is a, c, t, g, unknown, or other
ctccccgcggtggcggccgctctagaactagtggatcccccgggctgcaggaattcgtctcacccctagaaaaaatcctcgcccgcaacaccatttccgaacgggtcgcgcccgagcccgatatgcccgcgaagcccaggcccagccagacccaaagcgatgcgacggagatcgtgagatcgcgcgccgcagcctcctcccccgcccccgccgccggcgatgacctccgcagtcctcgccggccggaatgaggtccaccaggcgcatcagcaccaccgccaatgggctggcgcccgcgtcccgctcatgcccaagccgtcctccaaccctaaccctaggcgccaccgcgcgggcccaaaccctatccccagtggctcgccgccggagccgcgggccgctccggccgtcgcggccgagccctcgccgtcgccttcggggcacctgaacttcaggccgtcggaaatgacccccgccgaggcccggcacctccgcgcgcggctcaccagcgagctctgccgcgtccgcgctttcctctccgcatcnactgtgcgannggggnnannggccccnnntncnggggcccngccgccccccggggggcgggccgccccccgccgccggggncggggggggggcccngccgcaggcggcggggcggcccccccgcattgccggggggccaagccgggacaaaaagggtggggtggcaccccccccggtttccacctttaagggccggaaggctttaaaagaaccccgggccagatttctccgggagatccacacgggttgccctgggcccgtgataagaacctcc

SEQ ID NO: 81906 - protein, 89 aa, Zea mays
  misc_feature: Ceres CLONE 1567553
  misc_feature (31)..(31): Xaa is any aa, unknown, or other
  misc_feature (33)..(33): Xaa is any aa, unknown, or other
  misc_feature (34)..(34): Xaa is any aa, unknown, or other
  misc_feature (37)..(37): Xaa is any aa, unknown, or other
  misc_feature (38)..(38): Xaa is any aa, unknown, or other
  misc_feature (41)..(41): Xaa is any aa, unknown, or other
MTPAEARHLRARLTSELCRVRAFLSASTVRXGXXAPXXGAXPPPGGRAAPRRRGRGGGPAAGGGAAPPHCRGAKPGQKGWGGTPPGFHL

SEQ ID NO: 81907 - DNA, 793 bp, Zea mays
  misc_feature: Ceres CLONE 1567554
  misc_feature: Encodes the peptide sequence at SEQ ID NO. 81908
ggagctcaccgcggtggcggccgctctagaactagtggatcccccgggctgcaggaattcgtctcacccctagaaaaaggtctacatcgaatggctggcgtcccatccagagttggctattgactcagagatggaggaacagcatgcaaatgccagatctttcttctggaaccaatgtatctcatttatgaataagttgatccttaccaaccttgcttctatggaggacaatgacgatgaggcttgcttttctaatatgagcatttatgaggagggtgaaactgggaacaggcttgccatttgggaagatcttgaattgagaggttttttgcccttggttcctgcacataccattttggatttctcaagcaaacacacatttggaaatgttggaagcaccaaggagaagaaagcacgggttcaacgaatttttgctgcaggaaagtcactgctgaactttgttcagattgatcagttgaggatatattttgatccatctttgaaaaagtttgtcttggccaagaactctcctgtttctagaactaacacccctcttcatgaatctcctgatgcacttaaaacaaatgggactgaaatggatcacaaggctgctagaagatttgattcagtttcttctaatgtgggctcactgcagtctaaagtgcagttttgtcctgatggtgatgatgaagaagaaattgttttcaagccaacagcttatgagaagttttcaaaagtttcttcagatctgtcagttaatggatacgtccatcctgtaccagtgtctgctgct

SEQ ID NO: 81908 - protein, 221 aa, Zea mays
  misc_feature: Ceres CLONE 1567554
MEEQHANARSFFWNQCISFMNKLILTNLASMEDNDDEACFSNMSIYEEGETGNRLAIWEDLELRGFLPLVPAHTILDFSSKHTFGNVGSTKEKKARVQRIFAAGKSLLNFVQIDQLRIYFDPSLKKFVLAKNSPVSRTNTPLHESPDALKTNGTEMDHKAARRFDSVSSNVGSLQSKVQFCPDGDDEEEIVFKPTAYEKFSKVSSDLSVNGYVHPVPVSAA

SEQ ID NO: 81909 - DNA, 907 bp, Zea mays
  misc_feature: Ceres CLONE 1567558
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (414)..(414): n is a, c, t, g, unknown, or other
  misc_feature (417)..(417): n is a, c, t, g, unknown, or other
  misc_feature (426)..(426): n is a, c, t, g, unknown, or other
  misc_feature (427)..(427): n is a, c, t, g, unknown, or other
  misc_feature (432)..(432): n is a, c, t, g, unknown, or other
  misc_feature (459)..(459): n is a, c, t, g, unknown, or other
  misc_feature (462)..(462): n is a, c, t, g, unknown, or other
  misc_feature (479)..(479): n is a, c, t, g, unknown, or other
  misc_feature (485)..(485): n is a, c, t, g, unknown, or other
  misc_feature (487)..(487): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (516)..(516): n is a, c, t, g, unknown, or other
  misc_feature (587)..(587): n is a, c, t, g, unknown, or other
  misc_feature (591)..(591): n is a, c, t, g, unknown, or other
ctccccgcggtggcggccgctctagaactagtggatcccccgggctgcaggaattcgtctcacccctagaaaactccgcatccgcttgctgctgccgcccctgctccggctgggacgagcgagcctcctctccctccttgtcgcgtcccacataactgtgcctcctcgccgctgcgccccacctctgctcaggcccacactgccctgatcccgccggagtgcccgcacgcgcgcccttgcctgggccggccgccggcgaggggtctgggcggtcggtcgacgtgcccccccccccccccaaannnnnnnnnnnnnnnnnnnnnnnnnnnnnnnnnnnnnnnnnnnnnnnntnnnnnnnnnnnnnnnnnnnnnnnnnnnnnnnnnntnnnnnnnnnnnntnntnnnnnnntnntnttnttttttttnnttttntttttttttttttttttttttttcttnttnttttttttttttttttntttttntntttttttttttttcttttttnnntttttnttttttccttttatttttctttttctttctttttccttcttccctttttccctttctcctttttccccccncccnattttcctcctctttccctttcttttccaatcccaactcctttctaccccaccttttattaatcacaccccaaacaaatattttcttatctaaaagtatcttcaaatataaataacatataacctatatattaaaaaccttcattttaacaccctaccccttcttatttcataatctttttaccaactcataccccaaaaaaagagcgttatactccacctaaaagataaaaataactcaaattactcaatctcattcccttctttggtgaaaaatggaccgcggcctgtggccctacactaaaagagaacctctc

SEQ ID NO: 81910 - DNA, 857 bp, Zea mays
  misc_feature: Ceres CLONE 1567560
  misc_feature: Encodes the peptide sequence at SEQ ID NO. 81911
ccccgcggtggcggccgctctagaactagtggatcccccgggctgcaggaattcgtctcacccctagaaaaaaaaaaaaggcacgccccacccagtccagtccccaccaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagcggtggtggggggcccgcgttcgtgggccaggtgttcaccatgctcgacccatccggggaacgggctcatggccgttaccacacgcttcgaggtcccgcgcttcctcaccaacaggactcctatgtggttcaaaaggatgctatcaccgtcaaagaagactgaaaaaagtcccgtatttagggtttttatgggatctgaatgaaggcatattcttattgaaaagcgaccaaaatgtcccaaccggcattgggggggggcctttttcccccttgatgttgcctttttgaacattttccagggaaaaagccccccccagggtttccaatttttgtccccaaaatgaaaaaaaaaggggccccaggctcggccaaaaaaaagttttttggaaagttcccctttccaacaaaagggggggcaaaaaaaggaaaaaaaaaacttttgtgggggggttttccccgggtttt

SEQ ID NO: 81911 - protein, 134 aa, Zea mays
  misc_feature: Ceres CLONE 1567560
MPCSSSSSSNPFHSLASAFPFLSSTSPPPSPPASPAPAAPHLAVPLLLPVSSASESRRGAQPLPGTRMVGAGATGGGNMASGGGGPAFVGQVFTMLDPSGERAHGRYHTLRGPALPHQQDSYVVQKDAITVKED

SEQ ID NO: 81912 - DNA, 1130 bp, Zea mays
  misc_feature: Ceres CLONE 1567562
  misc_feature: Encodes the peptide sequence at SEQ ID NO. 81913
  misc_feature (1)..(1): n is a, c, t, g, unknown, or other
  misc_feature (836)..(836): n is a, c, t, g, unknown, or other
ntttttagtttttgtccccgttttttttcgggtcggggggcccccgggggatattttccccaaaaatatttatattaaaagctggagctcaccgcggtggcggccgcagacgcggcgggggcggccgtgtccgcctggagggcgtacgcggcggcgggcgaggagagcgacgtggtggtggtgggcggcgggcccggagggtacgtggcggcgatcaaggccgcgcagctggggctcaagaccacctgcatcgagaagaggggcactctcggcgggacctgcctcaacgtcggatgcatcccatccaaggctcttttgcattcatcacatatgtatcatgaagcaaagagttcttttgccacccatggagttaagttttcaaatctgggaatggagctcccagccatgatggctcagaaagacaaagctgtggcaggactaacaagaggaattgaaggggttctttaaaagaaacaaggtgacttatgttaaccgcccttgggaaaactgttattcccccctcaaaagttgtccactttgaatttttattttgatgggtgggttaccccccccttttgtccaaaggggccaaaaacctttaaaaaattttccaaccctgggggcctcttgaagggtaaaaaaatccccccttccccccgcaaaaataagagaaatttttgatttgtgacgaatagcaaaaaggtttgggtctcctccacatcctatacctgggggttggcgccccctctgggggggccttgtgtttctcccagaaaaggatttctcccgccaaaaaaaaaaacactgtggaggcggggtagaactccccgggagancccagggtgtttatatttttttgggccccctttttgaaaaaacgggggagtttcaaccctctttggggcaaccccccgcccctctgcgggtttcataaaaaggctcccccgggcctcccttttaaaatatttctgccccccccggaacaatatttctcccccctccgctgtggggctctcgtgtgaggcggtaggggaagactagttttcccccaccgctcttgttaatagaaaaaaacaaagatatttctccgttcctcccgcccaaaagacaaagagcttttttggcgggcg

SEQ ID NO: 81913 - protein, 45 aa, Zea mays
  misc_feature: Ceres CLONE 1567562
  misc_feature: SWISSPROT Homolog: EC 1.8.1.4 Dihydrolipoyl dehydrogenase
MYHEAKSSFATHGVKFSNLGMELPAMMAQKDKAVAGLTRGIEGVL

SEQ ID NO: 81914 - DNA, 846 bp, Zea mays
  misc_feature: Ceres CLONE 1567565
  misc_feature: Encodes the peptide sequence at SEQ ID NO. 81915
ctccccgcggtggcggccgctctagaactagtggatcccccgggctgcaggaattcgtctcacccctagaaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctcctattcgaggtcatggagtaccatctcctcaccttggtgtgcccctgtctcatcctctcgctggccatcctcttcctgtgggccaatgcctccccttttgtcaacaagtccccccgaacatttcctgagggcaaaatccccgaagatgtggctgtttaagttgccccttcccctgaaatatgagatcaacaggggcttttgctccctttaaggaaaatggggcctggcccctttctttaaaaaattccaaatgggttttggcgggtccttgggcttctttaacgttccccggaggccggctgaacacttcctggaacacgtttttatttttggtctttttgggcacttgttcccctgtacacaattctgttttggaaaaaaataagga

SEQ ID NO: 81915 - protein, 148 aa, Zea mays
  misc_feature: Ceres CLONE 1567565
  misc_feature (72)..(149): Pfam Name: Reticulon Pfam Description: Reticulon
MADHKEEPVPESVMDKITEKFHGGDSSSSSSDSDDEKKGSSLASAAEAMKAKIYRLFGRERPVHSVLGGGKPADLILWRNRKISGGVLAGATAIWLLFEVMEYHLLTLVCPCLILSLAILFLWANASPFVNKSPRTFPEGKIPEDVAV

SEQ ID NO: 81916 - DNA, 824 bp, Zea mays
  misc_feature: Ceres CLONE 1567566
  misc_feature: Encodes the peptide sequence at SEQ ID NO. 81917
  misc_feature (528)..(528): n is a, c, t, g, unknown, or other
  misc_feature (550)..(550): n is a, c, t, g, unknown, or other
ctccccgcggtggcggccgctctagaactagtggatcccccgggctgcaggaattcgtctcacccctagaaaaacccttctgctttgccttttccccttcctctctcccctgtcccccctccgtcccagccgagcgagaaagcgaaggggccaaaaaagccgcaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgcgatcgccgaggaggtggcggaggaggagaggatcatcgaggtcgacgaggtgatgcgtagcgaagggatggcggcggtggcgccgtcggaggcggatgggtgggttgaggcggagaaggcgccggcggtggtcgtcgcggaggtgaaggagccggagagccttgcccgaggaggagggggttcccgtgaaggctgttcgggaggtgcgctgctttccgnaaagtggaggaggggagggacngtgggtggccgcccttaacccgccctgattggacccccgcaactgttgttggcggggggggggggcttaaaccgaaccaactggggttcggggccctaaagttgggccccaaagaagggttctggggcggcagggtttggaggaaacaaacccctggcaggaatttttggggaaaacccatttttaactggggggggcaggagggtgcctcttttgtcccccttgaaatttttcccaaagcggggccggggaaaagcgggggatttataaattg

SEQ ID NO: 81917 - protein, 125 aa, Zea mays
  misc_feature: Ceres CLONE 1567566
  misc_feature (113)..(113): Xaa is any aa, unknown, or other
MELFYELLLTAAVTLLAALLLATLFAANDSHRRTDRAAAAIAEEVAEEERIIEVDEVMRSEGMAAVAPSEADGWVEAEKAPAVVVAEVKEPESLARGGGGSREGCSGGALLSXKWRRGGTVGGRP

SEQ ID NO: 81918 - DNA, 747 bp, Zea mays
  misc_feature: Ceres CLONE 1567569
  misc_feature (316)..(316): n is a, c, t, g, unknown, or other
  misc_feature (336)..(336): n is a, c, t, g, unknown, or other
  misc_feature (626)..(626): n is a, c, t, g, unknown, or other
  misc_feature (670)..(670): n is a, c, t, g, unknown, or other
  misc_feature (674)..(674): n is a, c, t, g, unknown, or other
ctggagctccccgcggtggcggccgctctagaactagtggatcccccgggctgcaggaattcgtctcacccctagaaaaaaggacgacgaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtnggctgcagatgcagagcgcngtccgaaatctcgatcttaagtcccccagttgcagggaattggattcccggaaacaaacagggatccccctttaaaaggaaaacccccaaagtccaaaaaccttggggaaaaacccccccctttggaaaaaaaaaacccgggggggaaaagggggcccccccggggggggggaaataaaggaggggggggctccccccccggaaaaaaatttttttttgggggaaaaaaaaacccccccccctttttttccaaaaaagaggggggggggggggtctcttctcttcttttntgtgggggggggggggcgccccccccttctccttctttttttangcgntttacagagggagaaggaaattgttggttgcgggggaggttggggtgtgtctcaccacccacgcgcggtaaag

SEQ ID NO: 81919 - DNA, 863 bp, Zea mays
  misc_feature: Ceres CLONE 1567570
  misc_feature: Encodes the peptide sequence at SEQ ID NO. 81920
ggagctccccgcggtggcggccgctctagaactagtggatcccccgggctgcaggaattcgtctcacccctagaaaaaacgtccgcacgccgctcttcttcccctgcttgctctgggttcctccattcctctccagtctccatcacaggagcacgcgacgcgcgccacaggaaggaagggaaaaaacatggcggcggcgaacggggacgcgtgccgcagcgtcggcggggtgccgcgcccgacgaaccccatggtgacgccgctgctcaccgacctgtatcagttcaccatggcctacgcctactggaaggccggcaagcacctcgaccgcgcagtctttgatctctacttccggaaaaatccatttggcggggagttcaccatcttcggtggcctcgaggaatgtataaggttcattgctaacttcaagttcacggaggaggaaatcaaatttcttcgatctgtcatgcctgcatgtgaggatgacttctttgagtacctccgttcgattgactgctcagacgtggaggtttatgccataccaagagggtatgctgtgttccctaaagtccactgatgagaattgaggacctgttgctggttgtcagcttcttgaaactccatttcaaatcttggcaactttgcttctttggtacccacaaatgcggcccgccccccattgttacctgggaagtcaaaaaattttccttaaatttggacttcaccgggcctcaggccctgttgggggaaatcccggccccacaatatttttttttggggggggtttttttaaaccaaacaatatttcccccaagaaaaaattttttgggaaaaccaaaagggggggaaccttctccgctttg

SEQ ID NO: 81920 - protein, 129 aa, Zea mays
  misc_feature: Ceres CLONE 1567570
  misc_feature: SWISSPROT Homolog: EC 2.4.2.11 Nicotinate phosphoribosyltransferase
MAAANGDACRSVGGVPRPTNPMVTPLLTDLYQFTMAYAYWKAGKHLDRAVFDLYFRKNPFGGEFTIFGGLEECIRFIANFKFTEEEIKFLRSVMPACEDDFFEYLRSIDCSDVEVYAIPRGYAVFPKVH

SEQ ID NO: 81921 - DNA, 817 bp, Zea mays
  misc_feature: Ceres CLONE 1567572
  misc_feature: Encodes the peptide sequence at SEQ ID NO. 81922
  misc_feature (420)..(420): n is a, c, t, g, unknown, or other
  misc_feature (474)..(474): n is a, c, t, g, unknown, or other
  misc_feature (817)..(817): n is a, c, t, g, unknown, or other
ccccgcggtggcggccgctctagaatagtggatcccccgggctgcaggaattcgtctcacccctagaaaaagtctcctctctacctcgaaagagaggtcgcagacggaacccttccaccctcccgacaccaccttcgattcctctgcgatttccccccgcgcgctcgccgattccttgatcgactcccgcgtgattcgctttctggtcggattctctctcctcaagcatgcagtcggatcagcctgtgatcagcttgcgccccggcggcggcggcggcccgcgcgccggccgcctcttctcccccgcctttgccacctccgtttccggagacttcctccgcctgcacgtcggtgggcgcctccggcatctccaagatcggtgattcacattttgagccacgtgagcgtggtccgtacacnagagatcacttctcaagctgcttgagcttggtgatgtgtctgaggacatttttnggctcagccaaaaattgaaattaggcttccgggggaaaaaccgaacctggattcccaggattccactggtcagggaaaagtcccagggcaaaaccaagcccaaaaatcggtttgcttgaaacgggaaaaccgggaattggggggggcccgggtttgaaaaaaacccccttttgggttaaagaaaaaaaaaatttttggggaaacaacctttcgcggggggggtaaaaaaagcccccacccccctctctggggggggggggggacacaaggggggcgagggttataaaacaaaaaaaaaaaaacgtttttaagccccccccccccctttttttgtttttccaan

SEQ ID NO: 81922 - protein, 51 aa, Zea mays
  misc_feature: Ceres CLONE 1567572
MQSDQPVISLRPGGGGGPRAGRLFSPAFATSVSGDFLRLHVGGRLRHLQDR

SEQ ID NO: 81923 - DNA, 928 bp, Zea mays
  misc_feature: Ceres CLONE 1567578
  misc_feature: Translation starting site: 161
  misc_feature: Pfam Name: Myosin_head Pfam Description: Myosin head (motor domain)
  misc_feature: SWISSPROT Homolog: EC 4.1.1.49 Phosphoenolpyruvate carboxykinase (ATP)
ccccgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcgggcggcgcccagcacgcccaagcggtcggcgcccaccacgcccatcaagggggggtggccactcgcccctttcgccgtcgcgatattccgaaggaggagccccacacgccagccagatgcagtcccatcaagtggcgtccgttgggcgtcccctggaccccgtgaaaacccggggccccaaaatggggttcaagggggcgaaccccgggccccccataaagggggaaaaggcccccccccgcccaggggggggcgccccttttctaacagcccgaaagggggggccccccagggtggggtttcgggggcataccccccggggggggccccccggcgcaattatttgcccgggtgtgtgggggaaaagagcctcccccccccccaaaggtgttcccaccccccggtggggggggggaaaaaaaaacaacacttttctcggcccccgggggggtggaaggccgttggttaaaacaaaacaggagggggggccctcttcttttgatggtaccatcaaaaaaaggaggaggggggggggtttgtttttattaatacataaaagtcatgaccgcccggcctgttgggtccaccatgtggtggggttaagaaaatgggttttaagtctgtgggtggg

SEQ ID NO: 81924 - DNA, 845 bp, Zea mays
  misc_feature: Ceres CLONE 1567583
  misc_feature: Encodes the peptide sequence at SEQ ID NO. 81925
  misc_feature (774)..(774): n is a, c, t, g, unknown, or other
  misc_feature (815)..(815): n is a, c, t, g, unknown, or other
ctggagctccccgcggtggcggccgctctagaactagtggatcccccgggctgcaggaattcgtctcacccctagaaaaagattcctttccctttccgttagcaggatagagagggagaggagcagaagagagcagagggccagaggcgcagaaggcagtcgcggacaggaggaagaggaagaagaagcggcagcgagcgaggatgccgtgcctgaacgtgtcgaccaacgtgaacaagaagcttagtgctggcatcgcttctatcctggagtcaaagctgtctgttcccaagtcgcgcttctacctcaagttctatgactcgaagcgctcggacttcggttggaacggctccaccttctagacttgaggtctgcagctgaaataaaagaaattcgtggaatcatggtacctaatgcccatggctattgcctattaaggacaatgtcataagatgtgtcttaatcggtgctgaactgagaaacagtaactgttgtcgtggaactggaagtggggtgctggcgtgtcagagtgcttgcttcctacctagcatagcatgcctgtgctatcttgttattggtattggcttgatatcagtctatattatcagcatccacttcgcccgcccgcccgctgcctgactgccattattgcctcccggtcttcgctgtccatccgaccgtccgtggcttctccctccggtccccgctacccgccccgccccgccgaagaagcttcgggctagctagcaagctagctagccacctacccgtgcnttgggtttcggttggtttggcgccatagccattgccgaagnagcgagggagcagcccggcggggagtcagg

SEQ ID NO: 81925 - protein, 52 aa, Zea mays
  misc_feature: Ceres CLONE 1567583
  misc_feature: SWISSPROT Homolog: EC 5.3.2.1 Phenylpyruvate tautomerase
MPCLNVSTNVNKKLSAGIASILESKLSVPKSRFYLKFYDSKRSDFGWNGSTF

SEQ ID NO: 81926 - DNA, 869 bp, Zea mays
  misc_feature: Ceres CLONE 1567584
  misc_feature (738)..(738): n is a, c, t, g, unknown, or other
  misc_feature (739)..(739): n is a, c, t, g, unknown, or other
  misc_feature (741)..(741): n is a, c, t, g, unknown, or other
ctccccgcggtggcggccgctctagaactagtggatcccccgggctgcaggaattcgtctcacccctagaaaaacatgggaccgcccctcgtccctcgccccagagaggcagatcagcgtgcggctatggtatgatagacgccggctatggctgtagcgctgctggcggcgctggtcgcttctccagctcttgttcatgttggtggtgaccgccagctcgtcgcccgcagaggggatcctgtcccctgtccagaatcggcgtgaacttggactccgaccaaatgcagccgtcggcctacgtgcggatgactcagttattcctcagctacgcacgtgagatacatcagacttggtgacctgtgaagtactgcctgtaagacccatcggaaggatacttgatttggcaaattcagtttcggtttgaactacaaatggttcagctatgtgtttcaaacctgtcggacaaggttaagaaccctttttccttgtcggagacccctttggggtttaaatttgggcccagctaaaccttgcggaaaaaaaaccctattttttttgggccaggggagaattgttccccccccccccccccttttgtggtcaccctgggggccccggggggaatttttttctccttttaggcggggttttttataggggggggggggggcctctcctgggggccccccaaaagctcgttgttttccagagaagtttttctcgggggaggcccccccnntnttttgtggtgtttttttaagaagaaaaacaccccccccccccggggggggcgcccacaaatttaaatttttctcccccccccccccctcttttttttttttttaatagggaggggagagaaaaaaacg

SEQ ID NO: 81927 - DNA, 821 bp, Zea mays
  misc_feature: Ceres CLONE 1567586
  misc_feature: Translation starting site: 228
  misc_feature: SWISSPROT Homolog: EC 3.6.3.8 Calcium-transporting ATPase
  misc_feature: SWISSPROT Homolog: EC 3.6.3.9 Sodium/potassium-exchanging ATPase
  misc_feature (314)..(314): n is a, c, t, g, unknown, or other
  misc_feature (769)..(769): n is a, c, t, g, unknown, or other
ctccccgcggtggcggccgctctagaactagtggatcccccgggctgcaggaattcgtctcacccctagaaaaaagatgatgaacgacaaggcactcgtccggcaccttgcagcctgcgagaccatgggctcagcgacctccatttgcagtgacaagacaggcactctcacaacgaaccacatgaccgttgtcaaagcctgcatctgtggtaagatcaaagaagtggatggtgtttcggatatcaagaacctgttctctgaactcccagactctgtcatggcgattctctcccagtccatattcaacaacactngggggagacgttgtcttgaaccaggatggcaaacgtgaaatactggggacacctactgagacagcgattctagagttcgggctgtcacttggtggagactttttggcggtgcgcaaagcaagcactcttgtaaaggtggagccgttcaactctgccaagaagagaatgggagtggtaatccagctcccagagggtgcactgcgagcacactgcaaaggtgcatcagagatcatactggcatcttgcagcaagtacctgaatgaagatggcaatgtcatccccctggatgcaggaaccattgatcacttgaaggccacgatcgatagcttcgcgaacgaggcacttcgcactctctgtcttgcctacatagaagttgaggatgggttctcagtcaatgatcagatcccacggatgggtacacctgcattggcattgtggggatcaaagaccagtgncgcctggagtgaaggaatcagtgctatctgcagggtcgcaggtatacagtca

SEQ ID NO: 81928 - DNA, 761 bp, Zea mays
  misc_feature: Ceres CLONE 1567594
  misc_feature: Encodes the peptide sequence at SEQ ID NO. 81929
  misc_feature (43)..(43): n is a, c, t, g, unknown, or other
  misc_feature (734)..(734): n is a, c, t, g, unknown, or other
  misc_feature (756)..(756): n is a, c, t, g, unknown, or other
ctcacccgcggtggcggccgctctagaactagtggatcccccngggctgcaggaattcgtctcacccctagaaaaacaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaaagaaagcaaaagcgattcccgtagtagcggcgagcgatatggggagcagccctaaaccgtgaaaaacggggtttgtggggaagagcaaataccaaggcgttttggcttgcttaggcgaaacccggtttgaattgccccccccccccttaaaaggggctaaaagcccccggttaagccccaaaaaagccctccccctttgggttttaaacccctctttggaacccccaagttataccacttggggggcccccccgggggaaaaaacccccccgcggggggggaatacctcccccgggggggggccccccccccttttttgggggggggggggtaaaaaaaataaccccccccccggggcggggggggggacccccccctattttttgcggaggaataaataaatttttttttcctccccccccgcggaggggggggggggaaaagaaaaaaaaatntggtggttgtttaaaagaaatncgcaa

SEQ ID NO: 81929 - protein, 87 aa, Zea mays
  misc_feature: Ceres CLONE 1567594
SPAVAAALELVDPPGLQEFVSPLEKQKRKGLRWIPRHPETRKGVASDEMLRGVENKHRSGDSQIGQPFELPAESMSRQETTWRTETS

SEQ ID NO: 81930 - DNA, 857 bp, Zea mays
  misc_feature: Ceres CLONE 1567596
  misc_feature: Encodes the peptide sequence at SEQ ID NO. 81931
ctccccgcggtggcggccgctctagaactagtggatcccccgggctgcaggaattcgtctcacccctagaaaaaaactgcaacagcttggaagcagtaagcacgcatcgccgctccccatctcccccgcaccgcgcacctctatggccgccggcgaaggcggaggtggggacatcggcgccgactcggagcggcgcctgcaaaaggctatggataagctctaccacttccccaagcccaagtcgagtagcaccggtggctccaagccctcttcgtcgacctcggctccaagctccgggagagcggtggggaaggcagcggcggaggcagcgaggaggttcggggtggtgcgcgggtcgcgactcccgcatcagatgttggccatggcagcgatctcgccgccaccgccgtgccgcccctgggaccgcgccgacctcatgcgtcgtctcgggtcattcaaagccatgacctgggtcgccaagcccaagggtattagtcccgttaactgtgcaagaagaagatggactaacattgagcccgatgttataacatgtgaagcttgtgggggacaactcctggtctcacctccttctcatggacaacacgccaagttgaaagggtgctgctggtttcagcctgaaactggaccccggaactaaaacaccttggcccgggattgaaaaccatggggaaggaacccctggcttttttcccccaaaaccccccccccggtttttgtggggaaaaaccaaggaaatttttggccccccccgcgggcacttttttgacccccccaaaaaattttcgcgcccccctcccggggacccgtaaaaaaaagaggcccccccctcttagaag

SEQ ID NO: 81931 - protein, 171 aa, Zea mays
  misc_feature: Ceres CLONE 1567596
  misc_feature (92)..(171): Pfam Name: zf-C3HC Pfam Description: C3HC zinc finger-like
MAAGEGGGGDIGADSERRLQKAMDKLYHFPKPKSSSTGGSKPSSSTSAPSSGRAVGKAAAEAARRFGVVRGSRLPHQMLAMAAISPPPPCRPWDRADLMRRLGSFKAMTWVAKPKGISPVNCARRRWTNIEPDVITCEACGGQLLVSPPSHGQHAKLKGCCWFQPETGPRN

SEQ ID NO: 81932 - DNA, 788 bp, Zea mays
  misc_feature: Ceres CLONE 1567598
  misc_feature: Translation starting site: 326
  misc_feature: Pfam Name: PRP4 Pfam Description: pre-mRNA processing factor 4 (PRP4) like
  misc_feature (374)..(374): n is a, c, t, g, unknown, or other
gagctccccgcggtggcggccgctctagaactagtggatcccccgggctgcaggaattcgtctcacccctagaaaaactccactggggacggaggcgaggccgagtacgaagtctccgacgaccaccgcgccgcgcgggagcgccacgagcgcgcggtgcaggagctcctccagcggcgccgcgcctacgccatggccgtacccaccaacgactccgctgtgcgggcccgcctccgccgcctcggcgagcccatcacgctattcggcgagcgcgagatggagcgccgcgaccgcctccgagccctcatggtccggctcgaggccgatggccaggtcgaccgtctcctccgcgcgcaggaggacgaccaggccgncgcgcatcggcgaggaggaggaggaggagcagatcgagtaccccttcttcaccgagggctcgcaggagcttctcaaggcgcgccttgacattgcacggtactcgctgccccgtgccaaggccaggatcgagagggccaagcgacgccacgaggaccctgatgaggatccagaggcggaggccgaactcgtcgtcaagcaggccggggagtttgtgctcgagtgcagtgagattggagatgatcgcccgctcactggctgttccttctctcgtgatgcatcgatgctcgccacaaggtacttccttttaacataaggaattaaatgtgcgttgttcttgtatgtctcaaacattgctgtgacgcagggatgcagaaacccgttacctattactaaccttatatgtgatttcagaa

SEQ ID NO: 81933 - DNA, 913 bp, Zea mays
  misc_feature: Ceres CLONE 1567600
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (190)..(190): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (204)..(204): n is a, c, t, g, unknown, or other
  misc_feature (210)..(210): n is a, c, t, g, unknown, or other
  misc_feature (211)..(211): n is a, c, t, g, unknown, or other
  misc_feature (240)..(240): n is a, c, t, g, unknown, or other
  misc_feature (250)..(250): n is a, c, t, g, unknown, or other
  misc_feature (252)..(252): n is a, c, t, g, unknown, or other
  misc_feature (272)..(272): n is a, c, t, g, unknown, or other
  misc_feature (273)..(273): n is a, c, t, g, unknown, or other
  misc_feature (280)..(280): n is a, c, t, g, unknown, or other
  misc_feature (281)..(281): n is a, c, t, g, unknown, or other
  misc_feature (305)..(305): n is a, c, t, g, unknown, or other
ccccgcggtggcggccgctctagaactagtggatcccccgggctgcaggaattcgtctcacccctaggaaaacctgtgatgtgaggcaggtcaggcagacgccgcgtctcctctttccagcctctctacctgtacctcccccccccccccaaaaaaggannnnnnnnnnnnngnnnnnnnnnnngggggnggggnnnngggggnggaggnnggggggagggggggggggggggggggggngggggggggngnggggggaggggggggggggnnggggganngagaaagaagaggggggagaaaangggggagggggggagggggggggggggaggagggaaggggggggaaggggggggggggggggggggagagggggaggggagggggagagaggagaagggagggggggaaggagaaagggaaggggggagagagaaaacagagggggagagggggggggggggaggaaagaaaggggaaaagcggggggggggggagaggggggggaggggggagggggggggggagggaaggggagaggggcaaaggggcgggggagggaggaggaggagaagaaagacgcggggggaggggagagaagcgcgggaggagggggaggagagggagcaggcgacggggacaataaacgggggggagagaggggggggggaggaagaaagccggaaggagggggggggaaatagggcggggagtgggacagggacgagagggggggagaggggggagaaaggcgaggaagaggggaggggggagaagagagagggggtgggggggggggacgggggagagggggggagggaaagggaggggggaggggggaggagagggaagggggaggggggatagggggagaggagtggtcggcggtggtggtatgagaaggggggtg

SEQ ID NO: 81934 - DNA, 828 bp, Zea mays
  misc_feature: Ceres CLONE 1567604
  misc_feature (828)..(828): n is a, c, t, g, unknown, or other
ctccccgcggtggcggccgctctagaactagtggatcccccgggctgcaggaattcgtctcacccctagaaaaagagctccgtcttgccttctcttctctacctgccgcacccgcacagacacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggtttgcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacacactctcgacctttatgctgtctcatttattttaactgtcaaggatagcaagtgacctctggtgtgcatacaccaccaccatacttagcataccacggccccagatggaaaaccataaagggaaactttctcttggacaagtttgaaaatggggaaaattgcttgggccaaggcccctttggcaaaggtttacccatggttcgtaaacaagggcaacttctgaaaaagggtgccggttccaagtgggtttgan

SEQ ID NO: 81935 - DNA, 1026 bp, Zea mays
  misc_feature: Ceres CLONE 1567607
  misc_feature: Encodes the peptide sequence at SEQ ID NO. 81936
ctgctggagctcaccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgcccacgaccaggggaactgcaccacccgtcctatgtcggcttcacccacaccaattgtttcccccgccacggggggggggggggggggggccttaaacccccaccaacaccttctttcaatggcaagggggttaatcgggcagggggggttcttctaaccccctccactgcaaaagggaacttgaacccctattggcccgtttcaaaggggcatcccccggggggccggggaggaacaaaccccccggggtgtggggaggcccacctctgccaaggggtcggaaggacaaaaatactcttttggtcttcctcggcaacggaaaaaacttggcgctctctatgggagtcctgttgtttcggagggtgagggagagggggtgaacttgtcgccggcgacaccctcatgcgcccctggggtggcgcgcccgcattatacagaagaagggcacggagcgcgaggagggagcaacctctcgagccactaacggaggagcggccgacggggccgcagaggtagggtggggtgacgcggcgcggggacagatgcggcgggcggtagagacagttgtgtgtgcctccgggcggggtttggcggcccctgttgtggcgcgcggcacccgcgcccgcagtgcgggaggttatgggagtggcagcacttgctctaacggtgggctggcgagacggtgttctgccgaggcagtgcgtttgcgcgtgtgaaaataaccgacttc

SEQ ID NO: 81936 - protein, 83 aa, Zea mays
  misc_feature: Ceres CLONE 1567607
MAKSEGPAIGIDLGTTYSCVGVWQHDRVEIIAHDQGNCTTRPMSASPTPIVSPATGGGGGGALNPHQHLLSMARGLIGQGGFF

SEQ ID NO: 81937 - DNA, 797 bp, Zea mays
  misc_feature: Ceres CLONE 1567608
  misc_feature: Encodes the peptide sequence at SEQ ID NO. 81938
ctggagctccccgcggtggcggccgctctagaactagtggatcccccgggctgcaggaattcgtctcacccctagaaaaaaactcatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaagtgatggaggcgggagctgctgtaacagatgccggcgccccctggcggtgggcggacgatgcatgggaagacttctttcaaatgcctccctcgggtttgctcggggccggttagggaataaaattgggggctggggggggggggccccccagggagaaaccgcgcccccccccttttcccccccgggggctttccggggggcggggcccctcccccaaatataataccccggggggttttcgcggggggaaaaattatggggcccccccccccgggcggggaaatccccgggaaat

SEQ ID NO: 81938 - protein, 125 aa, Zea mays
  misc_feature: Ceres CLONE 1567608
MVEAAAGRRTGTSRRRPSGSGGEHRHLVALAVAARVAMVTTRSVGPAAVAESDGGGSCCNRCRRPLAVGGRCMGRLLSNASLGFARGRLGNKIGGWGGGAPQGETAPPPFSPPGAFRGAGPLPQI

SEQ ID NO: 81939 - DNA, 1011 bp, Zea mays
  misc_feature: Ceres CLONE 1567611
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (15)..(15): n is a, c, t, g, unknown, or other
  misc_feature (20)..(20): n is a, c, t, g, unknown, or other
  misc_feature (23)..(23): n is a, c, t, g, unknown, or other
  misc_feature (24)..(24): n is a, c, t, g, unknown, or other
  misc_feature (30)..(30): n is a, c, t, g, unknown, or other
  misc_feature (61)..(61): n is a, c, t, g, unknown, or other
  misc_feature (62)..(62): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (84)..(84): n is a, c, t, g, unknown, or other
  misc_feature (88)..(88): n is a, c, t, g, unknown, or other
  misc_feature (96)..(96): n is a, c, t, g, unknown, or other
  misc_feature (97)..(97): n is a, c, t, g, unknown, or other
  misc_feature (131)..(131): n is a, c, t, g, unknown, or other
  misc_feature (162)..(162): n is a, c, t, g, unknown, or other
  misc_feature (163)..(163): n is a, c, t, g, unknown, or other
  misc_feature (170)..(170): n is a, c, t, g, unknown, or other
  misc_feature (171)..(171): n is a, c, t, g, unknown, or other
  misc_feature (176)..(176): n is a, c, t, g, unknown, or other
  misc_feature (1011)..(1011): n is a, c, t, g, unknown, or other
nnnnnggggcgcccnccgcnaanncagaanaaaagagaaaatccccacaaagagggccccnngggggggnnnncccaggctggnactncgggcggnnggcggccgcattcatcaacgcggacccccgggcngcataacacccacgcaggggagaaaaaaccnncaccgcnncacgnagcagcaagaaaaagaaagaaacaaaaaagagagagagagacagagatggcttgcaccttgaaacgccgaaacccaccatgaaaaaagaccggcgcgggcccctgaccctgagagagagttgctgttgctgccattcggtcggtgcctccttttcggtacgccgctggtatgtggtatcactggtatgggtgttctcccatcccaaggcgacgagggaataggaagctagaaagttcgtcagcagtcagcacctaagcccatggccaaggcgccgagcgcaggccgaagcacaacggccggccatgggccagggaggcagaaacccagccggccgagccagcccgcaccacacacaacacacgccccgccacgcacggggccccggagaaacggccggcccccgggggaccggagaagcaaaggccaggccacccaaagggcccggcaccggcaaccacaaaaggccggggccaaccgagaggcaagggccccggggacaccgggaaaggaaaaccagggagcccggcgggggggggcgccggccccgggaaaggggcacgcaaaaaacccggggcaaaaaaagaaaggggcaaaagtggaggggcggagaaagaacacaggggcgagggcgagggacaagggaaaagagaagaggggccggggaaaaacaaccccgcccgggaaagggggggaagaaggccccaaagaggcacaggggggcgccgaggcggcagccacgccagaggggggggggccacaaagaaaggcggggaggggagacagggagggaaggaggaaaaccgccgagagggaagaggacagacgagggcacgn

SEQ ID NO: 81940 - DNA, 813 bp, Zea mays
  misc_feature: Ceres CLONE 1567614
  misc_feature: Encodes the peptide sequence at SEQ ID NO. 81941
agctccccgcggtggcggccgctctagaactagtggatcccccgggctgcaggaattcgtctcacccctagaaaaatctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaagccgccgccgccgacgacgacgacaagagcgacggccgccggagactcctctggtacccgccgtaccctggatacgatgagcccggccaccaccgccgtttcctcgccggcgcggctccggacgacaactactgcagtgaccaaggcaaggtgtccctcatctcctcggccggcgtccaccagctgcacatcttcatcttcgtgctcgcggtgttccatatcgtctacagcgtcgccaccatggcgctggggcgtctcaaaatgaggaaatggaaagaatgggaatcggagaccaactccctgggatacaa

SEQ ID NO: 81941 - protein, 202 aa, Zea mays
  misc_feature: Ceres CLONE 1567614
  misc_feature (5)..(201): Pfam Name: Mlo Pfam Description: Mlo family
MAGGGGGRDLPSTPTWAVALVCAVIVLVSVAMEHGLHKLGHWFHTRQKKAMREALEKIKAELMLMGFISLLLAVGQTPISKICIPAKAGSIMLPCKPPKAAAADDDDKSDGRRRLLWYPPYPGYDEPGHHRRFLAGAAPDDNYCSDQGKVSLISSAGVHQLHIFIFVLAVFHIVYSVATMALGRLKMRKWKEWESETNSLGY

SEQ ID NO: 81942 - DNA, 844 bp, Zea mays
  misc_feature: Ceres CLONE 1567617
  misc_feature: Encodes the peptide sequence at SEQ ID NO. 81943
ctccccgcggtggcggccgctctagaactagtggatcccccgggctgcaggaattcgtctcacccctagaaaaaatttccatttgccgcgctcggcttcgtccgccccactccactccattccaacgcaacgggctcaccccgctttataggtcgccgcccgcgccacatcgcaaccgtctggcaccgtcgcggccacccattctctctcgtcaatagcatcgctccggctcccagcgcaatcgatccatccggccctaggagtgcttcagctatgcagctaaccagcgcgcttcccctagacggaaaagcatgaatgagcccaatgaggagaggcagcggacgttatgggagagaaaagataaggatcaactgctgcaacatcaggcgcaaaaaggcactgaagaggatgcgtctcatagcaaggcgagctgtgagcaacacacaacgtgcgctcacatgatatgcaggtccagacactcttgtaatacaaacatcctgtccgacgaattaagccgatcataatgaactcactaccaacattgaatgatggggtgactagacatcacaatctccctctcacaagcacaagggccacccctgctgaacatattgtaagatgtacacgcttattgatatcaacatgagcaaatgtgccaacagcggcaaagacaatatatgtgtgatgactcagtacaactcatctgcacactaccagcacattaatcgcacataactcggcgtgcggatcgacttcacatgagagatccgctgaagcgctggatgcaacacacatgcctaaggaagctgctgagatagatcatagcacagcagactacgttaga

SEQ ID NO: 81943 - protein, 48 aa, Zea mays
  misc_feature: Ceres CLONE 1567617
  misc_feature: SWISSPROT Homolog: EC 2.7.7.27 Glucose-1-phosphate adenylyltransferase
MSPMRRGSGRYGREKIRINCCNIRRKKALKRMRLIARRAVSNTQRALT

SEQ ID NO: 81944 - DNA, 804 bp, Zea mays
  misc_feature: Ceres CLONE 1567621
  misc_feature: Encodes the peptide sequence at SEQ ID NO. 81945
ctggagctccccgcggtggcggccgctctagaactagtggatcccccgggctgcaggaattcgtctcacccctagaaaaaacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatccggaaaggatactggacgggagcaattcagacattggagcgaattcgtaccatatgtacaaaacggacgtcagattgctcaaggaaatgggcatggacgcatataggttctctatctcttggcccagaatactgccgaaggtaacaaaagaagaggtattaccccggatgggcatcaagtactacagaaaacctcctccaacttgttggctgaaaaccgcttaaaagccttttgtaaccatttttccacctgggaatgtaccctcagccccttaaaaaaaaaattcccgggggcttcccctaattaaaaagccctaaaaaaacca

SEQ ID NO: 81945 - protein, 123 aa, Zea mays
  misc_feature: Ceres CLONE 1567621
  misc_feature (9)..(124): Pfam Name: Glyco_hydro_1 Pfam Description: Glycosyl hydrolase family 1
  misc_feature: SWISSPROT Homolog: EC 3.2.1.21 Beta-glucosidase
MLSPSEIPQRDWFPSDFTFGAATSAYQIEGAWNEDGKGESNWDHFCHNHPERILDGSNSDIGANSYHMYKTDVRLLKEMGMDAYRFSISWPRILPKVTKEEVLPRMGIKYYRKPPPTCWLKTA

SEQ ID NO: 81946 - DNA, 879 bp, Zea mays
  misc_feature: Ceres CLONE 1567622
  misc_feature: Encodes the peptide sequence at SEQ ID NO. 81947
ggagctccccgcggtggcggccgctctagaactagtggatcccccgggctgcaggaattcgtctcacccctagaaaaagccccctccacttcaccgccgccgcgtagatccgtctccgcctcctggaagcgctaccagtggaccaacgccgagccggcggagttagcggcgttagggttgcggttgggaattgattgcgggggacgcagcggtggcgcctggcatggcgggggcgcccggggtcgggccgggtgcggggggtgggggcggcgccgctgctgggctcaagacttacttcaagacgcccgaggggaggtacaagctgcagtacgagaaggcgcactccgcggtgctgcactacagccacggcggcaagaccgtctcgcagttgacagtggcatacctcaaggagaagcctgctagccagggctctcagccatcaacaccaagcgccagcagtgggatgcggtctgcagcagcaaggctgctgggcactgggaatgggagcaaggcactttagctttggtggcggtaatggtgcaaagccgagctgttgctggaagcacccgtgtaggaggcggccttgctacacctaccaggccttggtggattacaggggggcacaaattatgatggcaaagggtacatataattgaattcaatggctgctggaaacactatttcctcagtggatctccaattcccaaggaagaaggatccacttaaaggtcccatcccttttcagcaacttcaaaccccctggggccctggcatttccacccccaaaggcccaaaaaaggggaacccaaccctggatcatttggggaatgggggaacacgggggaatttcctttttccaaatgtcccccttgagaggaa

SEQ ID NO: 81947 - protein, 98 aa, Zea mays
  misc_feature: Ceres CLONE 1567622
MAGAPGVGPGAGGGGGAAAGLKTYFKTPEGRYKLQYEKAHSAVLHYSHGGKTVSQLTVAYLKEKPASQGSQPSTPSASSGMRSAAARLLGTGNGSKAL

SEQ ID NO: 81948 - DNA, 834 bp, Zea mays
  misc_feature: Ceres CLONE 1567624
  misc_feature: Encodes the peptide sequence at SEQ ID NO. 81949
  misc_feature (776)..(776): n is a, c, t, g, unknown, or other
tccccgcggtggcggccgctctagaactagtggatcccccgggctgcaggaattcgtctcacccctagaaaaaagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatcagtgaagaggatgatgatgatgattctgtttcggagagctcttcagcatcattggccaaaccagctggaactttggatcttggcaagctgacagaggaaccacagcctcaccgcagtgtggatccaaaccattcgtatgatcaagtgtttattagatccactcggttactggagaggagatcccagaaacgcaacggcggccacagggctttggataatggtgtggcngtgcagtggtgtgaactcaaagagaaaagacaagtttggcagaagtcttgatccagac

SEQ ID NO: 81949 - protein, 180 aa, Zea mays
  misc_feature: Ceres CLONE 1567624
MIHDTSSSRASTACHYSPSLVAEEQLHGSKDTLTLKGEKALLELLLGMALDQHVDGRKLITQQEAEDSDFESYLREATSRVLYQPTFISEEDDDDDSVSESSSASLAKPAGTLDLGKLTEEPQPHRSVDPNHSYDQVFIRSTRLLERRSQKRNGGHRALDNGVAVQWCELKEKRQVWQKS

SEQ ID NO: 81950 - DNA, 828 bp, Zea mays
  misc_feature: Ceres CLONE 1567626
  misc_feature (498)..(498): n is a, c, t, g, unknown, or other
  misc_feature (499)..(499): n is a, c, t, g, unknown, or other
  misc_feature (547)..(547): n is a, c, t, g, unknown, or other
  misc_feature (557)..(557): n is a, c, t, g, unknown, or other
ctccccgcggtggcggccgctctagaactagtggatcccccgggctgcaggaattcgtctcacccctagaaaaaaagtcgcagcgcagtcaagcaaggcacgtcggtccaagagcacgacgagcagacgacgctgccggcccggccgtgctgctcctctgagtccgagatctgaaggcgcggcaggaaggaaacgggcgggcgagaggatccagcagccctcccccacgcgcgcgcgacggttagcgcgtcccagatctcggtgcggcgcctcccgcccggccctgccggcgagagcgcggcccgatgaggcggcggccgttcctggagcagcggcggccttcgttcaagcgccggtggcagcagcgcccgtggtgggtgcgcctcgcgctttccctccttctcgccctcgcatgcgtcctcctcctcgccgtcctcctcggctcccccgaccccggcgcctcgccgtccacctcccgcgcgtcctccggatctgagnnacactccctcactctccctcgtcagagaacttacctggagggaatcancgatgcgctncacatgactgacgaaatgctgagcgcccgctcgttctcgaggcagctcatggaccagatttatctagcccaaacatatgttcgtcgttggcaaggaggccaacaacctgcagttgggggcggaagcttagtgcccaggtacggcgggggccaaaaattcctttgcccattgctaaacccattgggggccccggtgttttgacccggaaccccaaaaagggtttccggggattttgccggggccggcctttccaggggcgaaaatctttggt

SEQ ID NO: 81951 - DNA, 853 bp, Zea mays
  misc_feature: Ceres CLONE 1567627
  misc_feature: Encodes the peptide sequence at SEQ ID NO. 81952
ggcggccgctctagaactagtggatcccccgggctgcaggaattcgtctcacccctagaaaaacttttcctcctcctcccctttgcggcttctcgcagcgctgcgaatcccaatccgcaccgatccgacgcgaatcgatcgagaggcagggggcagcactaatcgaatcgagactagcgccatgaacccgagaggctatcgtagcaacagaacttctctcttcgatggcattgaggagggtggaatccgagcaacatcctattcttctcatgagatagatgagcaagaaaatgatggagctattgatggactgcaggatcgtgtcagcattctcaagcggttgtcaggcgatatccatgaagaggtggagactcataacagaatgctggacccaatggggaacgatatggatacttcaaggggttttctgtctgggaccgtggacaaattcaagatggtatttgagaccaaatcaagccggaggatgggaaccctcgtcgcatcattcgtcgcccttcttctgctgggtttactacttgaccaggtagaagacatggacatggctggaaaatgggtcatcctcctcatctgcgtgcccggcccgtatagaatagataccttgaaaaacccacccgcccctgagtgccaaagtatatggttgatgtggcctgggggtggtttcgtccaactctgccctggacaaacaacgacctaccgccgtgcggggctggggcccaatcccaattaacctggtggttggccggaaattcaaagttttggtgggcccctttctcttacccttttgggcattttaggagcagcatatagggggcgccgggcactcccttaaaaa

SEQ ID NO: 81952 - protein, 188 aa, Zea mays
  misc_feature: Ceres CLONE 1567627
  misc_feature (36)..(98): Pfam Name: SNARE Pfam Description: SNARE domain
MNPRGYRSNRTSLFDGIEEGGIRATSYSSHEIDEQENDGAIDGLQDRVSILKRLSGDIHEEVETHNRMLDPMGNDMDTSRGFLSGTVDKFKMVFETKSSRRMGTLVASFVALLLLGLLLDQVEDMDMAGKWVILLICVPGPYRIDTLKNPPAPECQSIWLMWPGGGFVQLCPGQTTTYRRAGLGPNPN

SEQ ID NO: 81953 - DNA, 929 bp, Zea mays
  misc_feature: Ceres CLONE 1567630
  misc_feature: Encodes the peptide sequence at SEQ ID NO. 81954
  misc_feature (415)..(415): n is a, c, t, g, unknown, or other
  misc_feature (446)..(446): n is a, c, t, g, unknown, or other
  misc_feature (483)..(483): n is a, c, t, g, unknown, or other
  misc_feature (512)..(512): n is a, c, t, g, unknown, or other
ctggagctccccgcggtggcggccgctctagaactagtggatcccccgggctgcaggaattcgtctcacccctagaaaaaatcggcaggacatccacaccaacccgtgctcaaggaaaaaaaaccggggcggcgaaaaccctcgaaccctaatccttacgcccctcatggcggacgctgatgcggcgctgccaacgccgcctccggaggtagtagcccccgaggagcatcccgtgggcgccgaatccaccgtcgccgcgccggccgaagtcgataacaagcggaagctagaggaggtcagcgccgacgcggaggtgaaaggcaccagcgaggacgccaagcgcccgcgcgtggacggcgagcccgacgccgcaacaggggttgagcagcaaatcgatgggtcctccgtgaatgcngatcccgcagctccggaggataaggctgctncttacgttggcgcagcaatgggatgtgataatgaaanggcttggtcccggttcccgttcaaaaatnggaaggggggttcctgacaaaaaacccgcttgaaaccaccagcctaaaacctcccaaccaggaaaggggatgcccccacctgcctgaaaggggaaattttccccgtaaaaatccaaaaggccccaaccgccagaggttggggggccctttttgggaaaaaacggggggaaaacaatccgggaaacttgcaaaaatccccccgggggggcaaaaaaccccattcccccaggggattccgaaaggggactccaaatgccccttaatcccggccgggggaaaactattgtggaaaaccccgggccccgttttaaaaaaaccgagacccttttttaaaaagggtctcaacgcgagagggagggcgggggggtgcccccgcccctttttataaaaagatttttagagggaccaccctcttac

SEQ ID NO: 81954 - protein, 120 aa, Zea mays
  misc_feature: Ceres CLONE 1567630
  misc_feature (94)..(94): Xaa is any aa, unknown, or other
  misc_feature (106)..(106): Xaa is any aa, unknown, or other
  misc_feature (116)..(116): Xaa is any aa, unknown, or other
MADADAALPTPPPEVVAPEEHPVGAESTVAAPAEVDNKRKLEEVSADAEVKGTSEDAKRPRVDGEPDAATGVEQQIDGSSVNADPAAPEDKAAXYVGAAMGCDNEXAWSRFPFKNXKGGS

SEQ ID NO: 81955 - DNA, 787 bp, Zea mays
  misc_feature: Ceres CLONE 1567632
  misc_feature: Encodes the peptide sequence at SEQ ID NO. 81956
tggagctccccgcggtggcggccgctctagaactagtggatcccccgggctgcaggaattcgtctcacccctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcgatcgccacagcgatccacacgctcgcacacgtgacctgcgacttcccaaggctgatcagctgcccgacggacaagttcatggccaccttggggtccaacttccactacaagcagccgacttacctgggcttgctggagagcacacccggggttaccggaatcctcatgatcatcataatgtccttctccttcacgctggcaacacattccttcaggcggagtgtggtgaagctgccatcgccgctacaccaccttgccggtttcaatgccttctggtacgctcaccacctgctggtccttgcgtatgtcctgctggtggtgcactcctacttcatattcctcaccagggagtggtacaagaagacgacatggatgtacctgattga

SEQ ID NO: 81956 - protein, 188 aa, Zea mays
  misc_feature: Ceres CLONE 1567632
  misc_feature (9)..(166): Pfam Name: Ferric_reduct Pfam Description: Ferric reductase like transmembrane component
  misc_feature: SWISSPROT Homolog: EC 1.6.3.1 NAD(P)H oxidase
MGYCVCVAKGAAEILKLNMALILLPVCRNTLTTLRSTALSHVIPFDDNINFHKVIALSIAIATAIHTLAHVTCDFPRLISCPTDKFMATLGSNFHYKQPTYLGLLESTPGVTGILMIIIMSFSFTLATHSFRRSVVKLPSPLHHLAGFNAFWYAHHLLVLAYVLLVVHSYFIFLTREWYKKTTWMYLI

SEQ ID NO: 81957 - DNA, 819 bp, Zea mays
  misc_feature: Ceres CLONE 1567633
  misc_feature: Translation starting site: 133
  misc_feature: SWISSPROT Homolog: EC 1.3.3.4 Protoporphyrinogen oxidase
  misc_feature: SWISSPROT Homolog: EC 1.4.3.4 Amine oxidase (flavin-containing)
  misc_feature (450)..(450): n is a, c, t, g, unknown, or other
  misc_feature (694)..(694): n is a, c, t, g, unknown, or other
ctccccgcggtggcggccgctctagaactagtggatcccccgggctgcaggaattcgtctcacccctagaaaaaatctcgtcgtgtcatccactccgccgcacaggcgctcagctccgcaacgccgccggaaatggtcgccgccaccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctnctgggaggagggtcccaacagcttccagccctccgaccccgttctcaccatggccgtggacagcggactgaaggatgacttggtttttggggacccaaacgcgccgcgtttcgtgctgtggggaggggaagctgaggcccgtgccatccaagcccgccgacctcccgttcttcgatctcatgagcatcccagggaagctcagggccggtctaggcgcgcttggcatccgcccgcctcctccagncgcgaagagtcagtgggagaagtcgtgcgccgcaactcggtgctgaggtctttgagcgctcattgagccttcctgctcagtggctatgctggtgatccctctagctcagcatgaagctgcaattg

SEQ ID NO: 81958 - DNA, 787 bp, Zea mays
  misc_feature: Ceres CLONE 1567635
  misc_feature: Encodes the peptide sequence at SEQ ID NO. 81959
ctccccgcggtggcggccgctctagaactagtggatcccccgggctgcaggaattcgtctcacccctagaaaaaaccgcaaggatccaccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatggggcggcacggcgggccgggactacgccgtgcccagccctgttctcagatatttttccgtgatcccgctttatggcgcccccacagcatttggcccccttgctgaaacctggatggacaaccttgggcggggggcgggcccccggggcccttgcgggtgcccccccttgggctgggaaccccctaaggggaggaccaagggagggccccttccacccctgaagggggggaaacttgccccgggcccctggggggaaaggaaccccccctccaaggggggttgggggggggaaccaaaaaaaacccccccggggggttgtttaaaagggggccaaaggggccccaaaaaaagggggggttttatccccagggggaaaaaaaagggagaaaccccccgcgggttttccccaaaaaaaaaa

SEQ ID NO: 81959 - protein, 88 aa, Zea mays
  misc_feature: Ceres CLONE 1567635
MASIVASRRAVPLVRALEKLIAASSAPGTGSALRPVAVAGGLRGYNTGAPLRRYEGAESEDDSVREYDGAARRAGTTPCPALFSDIFP

SEQ ID NO: 81960 - DNA, 924 bp, Zea mays
  misc_feature: Ceres CLONE 1567636
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (492)..(492): n is a, c, t, g, unknown, or other
nnnnnnnnnnnnnnnnnnnnnnnnnnnnnnnnnnnnnnnnnnnnnnnnnnnaaaannnnnnnnnnnnnnnnnnnnnccttttnnnnnnaaaagctggagctccccgcggtggcggccgctctagaactagtggatcccccgggctgcaggaattcgtctcacccctagaaaaaacacacccggaccccggtctgcgtttgtccctgcgggctgcggccctgcctcttctcttctcccgttcccctcgccgcgtgagctctctctctctctctcctctgtggtgacgactgggcgcccgcacccccggcagccgccgccgcccagtccccgtcgggcccttcggcaggtcttcttcggccccttcgccggcgacgagccgcaccaggcgtacatgtgtacacccaggccccttaactgcgcccgcccctgcgactggtttttcctgctggggtttgtgtgaatttgggctgcccggaaagaatttggtgcaanccttttaagggaatcaccggttagaatttcgccctggtggaaaatccccaaaagggggtggcctccaagggtttcaatttttttggggggggggaacccacgccgccccatgaaaaaaacattgggggggcctttttaaaaaaacttccggggggaaaaaaccctcttttttttttaaaaagagccccctttggggccccccccccctaaggaattttttttagaaaaccccccccgggggcttttttaaaaaaaaaaaagagaaaaaacccccctcccttcccccggtgttttgagaccccccccgggggaaaacccccctccccccccgtgtgtaaaaaatataaaaaaacccccccccccctctttttttaaaaaaaaattttttggggggggggtttttgttgggccccccccccccaccaaaaaaaa

SEQ ID NO: 81961 - DNA, 828 bp, Zea mays
  misc_feature: Ceres CLONE 1567637
  misc_feature: Encodes the peptide sequence at SEQ ID NO. 81962
  misc_feature (742)..(742): n is a, c, t, g, unknown, or other
acccgcggtggcggccgctctagaactagtggatcccccgggctgcaggaattcgtctcacccctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcgatcgccacagcgatccacacgctcgcacacgtgacctgcgacttcccaaggctgatcagctgcccgacggacaagttcatggccaccttggggtccaacttccactacaagcagccgacttacctgggcttgctggagagcacacccggggttaccggaatcctcatgatcatcataatgtccttctccttcacgctggcaacacattccttcaggcggagtgtggtgaagctgccatcgccgctacaccaccttgccggtttcaatgccttctggtacgctcaccacctgctggtccttgcgtatgtcctgctgggtggtgcactcctacttcatattcctcaccangggagtggtacaagaagacgacatggatgtacttgattgtccctgtcctcttctatgccttgtgaagagtcatcagggaatttcgt

SEQ ID NO: 81962 - protein, 187 aa, Zea mays
  misc_feature: Ceres CLONE 1567637
  misc_feature (9)..(166): Pfam Name: Ferric_reduct Pfam Description: Ferric reductase like transmembrane component
  misc_feature: SWISSPROT Homolog: EC 1.6.3.1 NAD(P)H oxidase
  misc_feature (176)..(176): Xaa is any aa, unknown, or other
MGYCVCVAKGAAEILKLNMALILLPVCRNTLTTLRSTALSHVIPFDDNINFHKVIALSIAIATAIHTLAHVTCDFPRLISCPTDKFMATLGSNFHYKQPTYLGLLESTPGVTGILMIIIMSFSFTLATHSFRRSVVKLPSPLHHLAGFNAFWYAHHLLVLAYVLLGGALLLHIPHXGSGTRRRHGCT

SEQ ID NO: 81963 - DNA, 835 bp, Zea mays
  misc_feature: Ceres CLONE 1567639
  misc_feature: Encodes the peptide sequence at SEQ ID NO. 81964
  misc_feature (509)..(509): n is a, c, t, g, unknown, or other
ggagctccccgcggtggcggccgctctagaactagtggatcccccgggctgcaggaattcgtctcacccctagaaaaaaacatctccggcccatcgcccgtgctctgcactgtctcgcctccgacctccgcgccctctcaaggtctcaccggagaccgcgctgcggtccgcgggctttgggtagcgcgggatggcctccgtggggtgggctgcacgcgacgcgtacgacgaggaggccgcagtccgccgccctctcgagctcgagggccgtggcgtcgccgcatcgtcctccgaccaccggcccggcgggaatgtcatgcctaggtatcaagtgggctcgacaaagggtgattcaagtagtagacgacactctgaggagtggcggcaacctagcacagatgatgtgcgcatgagcaagccggggtcgagatatttcacggcgtttggggtggatctgtcccctgataatatggcagttgccattgtatattttgtgcaaggggttttangtcttgcacggcttgctgtgagcttttacttgaaagatgatcttcatctagatccagctgagactgcagtggtatctggtttctcgtccttgccggtggctgatcaagcccctctatggcttttatcaagtcccacaaatcctcccaccatctaaattctttcctgatgggtaacttgggagcactttccttgaagctttaatgggccccagttattgaagcaagtaaatacaagcgcaagcattctcctatttcttccctgggcccacctttctggttgccccttcccaagaatgtgggaaaggggaatttccatgggggggttg

SEQ ID NO: 81964 - protein, 157 aa, Zea mays
  misc_feature: Ceres CLONE 1567639
  misc_feature (107)..(107): Xaa is any aa, unknown, or other
MASVGWAARDAYDEEAAVRRPLELEGRGVAASSSDHRPGGNVMPRYQVGSTKGDSSSRRHSEEWRQPSTDDVRMSKPGSRYFTAFGVDLSPDNMAVAIVYFVQGVLXLARLAVSFYLKDDLHLDPAETAVVSGFSSLPVADQAPLWLLSSPTNPPTI

SEQ ID NO: 81965 - DNA, 785 bp, Zea mays
  misc_feature: Ceres CLONE 1567644
  misc_feature (248)..(248): n is a, c, t, g, unknown, or other
  misc_feature (727)..(727): n is a, c, t, g, unknown, or other
ctgagctccccgcggtggcggccgctctaaactagtggatcccccgggctgcaggaattcgtctccccctagaaaaaaatcttctccaccctctgcccctctcgatttcttcttcccatctcccgatccatcgcaacccaaaccctactccaggcagatctccgtctccgccgccgctgccggcgtgagcacagcatcagatccgctgtgatggcgttccgccgcatcctatccaccgcggtgcgccngcccgctcggccgtgcccgccgccggcgggccggggaaaccccccgccgaagccctccaacgcccgtccctttgcgggcgcccagggtgggggtctcgccccccaatggccgaacccccgggggcgccccccccccggtaataccccctttaaaaaaccccctttccccccaaagggcccttaaaaaaccccaaggggccccccggggggggttttgggagccccccaaaaaccccgcgggttttttttcccccctaataaaacccaaaccccccccggtgggggggtccccccccccgggggaaaaaaaaaagggggggggcccccccccttttgtgggggggcgccccaaaaaaaaaaaaacacggcggggggggcccaaaaaaacattttgtgccacaaaaaagagggggggggggggggttgtttttcccccccgcagaggagaggattttttttttctccccgccccccccccncgaaaaaaaggtttaatttatttttgggtggggggggggcgggttggggagagaaaaa

SEQ ID NO: 81966 - DNA, 781 bp, Zea mays
  misc_feature: Ceres CLONE 1567646
  misc_feature: Encodes the peptide sequence at SEQ ID NO. 81967
ctcaccgcggtggcggccgctctagaactagtggatcccccgggctgcaggaattcgtctcacccctagaaaaactccacgcagctccactccacgggctagcagcagcagcagcttccccatgcatgcaatggcgtggtggggcggcgaggagggcgagccgttattcccgtccgtggacaagtgcgacgcgtcccgcctcggtcgggactccacgctggtggcggacctggacggcgcgctgctccgctccccggacgccttcccctactacgcgctcgtcgccttcgagacgggcggcgcggcgcgcctggcgctgctgctgctgctggcgccgctggccgcggcgctgcgccgcgcggtgtcggagtccgcgggggagcgggtgctggtgttcgcggccacggcgggcgcgcgcgtcgccaacgtcgagtccgcggcgcgcgccgtgctgcccaggttctacgccgccgacgtgcgccgggacgcgtggcgcgtcttctccgcgtgcggggggcggaggctggtgctcaccgccgcgccgcgggtcatggccgagccgttcctgcggcggtacctcggcgccgacgccgtcgccggcacggagctcgccgcgtggcggggacgcgccacgtggttgggtggacgcgcgccgcggcggcgtgctcgtcggcgagagcaaggccaggcgctgcggcagatgctcgacgcccgggaggtgcccgatgtcgggctcggccacgggagatcggaattacgccctcattgagtttctgcaagc

SEQ ID NO: 81967 - protein, 212 aa, Zea mays
  misc_feature: Ceres CLONE 1567646
  misc_feature: SWISSPROT Homolog: EC 2.3.1.15 Glycerol-3-phosphate O-acyltransferase
MAWWGGEEGEPLFPSVDKCDASRLGRDSTLVADLDGALLRSPDAFPYYALVAFETGGAARLALLLLLAPLAAALRRAVSESAGERVLVFAATAGARVANVESAARAVLPRFYAADVRRDAWRVFSACGGRRLVLTAAPRVMAEPFLRRYLGADAVAGTELAAWRGRATWLGGRAPRRRARRREQGQALRQMLDAREVPDVGLGHGRSELRPH

SEQ ID NO: 81968 - DNA, 786 bp, Zea mays
  misc_feature: Ceres CLONE 1567647
  misc_feature: Encodes the peptide sequence at SEQ ID NO. 81969
  misc_feature (411)..(411): n is a, c, t, g, unknown, or other
  misc_feature (575)..(575): n is a, c, t, g, unknown, or other
ctcaccgcggtggcggccgctctagaactagtggatcccccgggctgcaggaattcgtctcacccctagaactaattgagactgatgcagaggcatgccttgatcgaaatgatccaaattatgacagtggtgaggagccatatgagttagttgaggcccctgtttcaaccccactagaagactacaagaaatctgttgtccctttaattgaggaatatttcagcaatggggatgtaaaattagctgcttctgatcttaaagagttgggtcatgatggtttccactgttactttgtcaagaagcttgtttccacagcaatggataggcatgacaaggagaaagagatggcatcagtgcttctgtcgtatctttatggcaacgtggtcagttcaactcaaattaggctggganttgtgctgctattagaggctgttgatgacttggctgttgacatacctgatgtggttgatgtgctcgcccttttcattgcacgtgcagttgttgatgacattctgccacctgcttttctcagcaatgcaaaagtgagtctgtcaggatcttcaaggggtatgcanggtggaccaaatggcgaagaaaacctatctttcagcccccccccctgccaaatttatttaaccgacaatgggggtgtttcaacccccttccctttaaaaaaggggaaaaagaggattgccttattctttgaaaggaaaaccttcaaaaattgggggatacccctaagggttgtagggtgccattaaaaaaatttggggggggcccttttta

SEQ ID NO: 81969 - protein, 252 aa, Zea mays
  misc_feature: Ceres CLONE 1567647
  misc_feature (61)..(172): Pfam Name: MA3 Pfam Description: MA3 domain
  misc_feature (137)..(137): Xaa is any aa, unknown, or other
  misc_feature (191)..(191): Xaa is any aa, unknown, or other
HRGGGRSRTSGSPGLQEFVSPLELIETDAEACLDRNDPNYDSGEEPYELVEAPVSTPLEDYKKSVVPLIEEYFSNGDVKLAASDLKELGHDGFHCYFVKKLVSTAMDRHDKEKEMASVLLSYLYGNVVSSTQIRLGXVLLLEAVDDLAVDIPDVVDVLALFIARAVVDDILPPAFLSNAKVSLSGSSRGMXGGPNGEENLSFSPPPCQIYLTDNGGVSTPFPLKKGKKRIALFFERKTFKNWGIPLRVVGCH

SEQ ID NO: 81970 - DNA, 1024 bp, Zea mays
  misc_feature: Ceres CLONE 1567648
  misc_feature (392)..(392): n is a, c, t, g, unknown, or other
  misc_feature (1024)..(1024): n is a, c, t, g, unknown, or other
gagctcaccgcggtggcggccgctctagaactagtggatcccccgggctgcaggaattcgtctcacccctagaaaaaacgcacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcccttgcctcctgatccgggaagcgcccctaaatggccgggggcggaagcggccgttcctcttcttaaccaccaccactttcacccccaccccgtcaaggattttttccccccccctgggggggagagggggggggttcccccatnacccaaattccttcctacgtgggatgccaaccttacccggccgtggcttggggcccccccttcaatctaaccaacctccacctttgttccccccaatcggcagggaaaactttctaggcaacactgtcacgggatttacagcgaaattctggctggtccctatggcgggggaccgaaaatccgcgattccggcaccacaggagctctcccggggcacagcgtggcgggccgatatcaacttctcatcccggccgctattactctaggcccatctatgttacgcgcgtccgcaccatattagtgtccaccacaccctcagtgaggcgggagcgttactcagctcggcgcccaaggcccgcactatgccaccgaaactgaaacgcccgttcgttcttctccccacctctcgttccatataatcccagcccgttttatgttcttctacgcccgcccggccgagctttattggtcgccgaaggagatgttttcacccgctcttccccaacatattccctcgccggtatgatctcccattaccgccccggtggggctccgcccacgacttgctggcgtgcgtggagcgcgcgcgcgaggccggcggcgggtgcgtgccgtcccccgacgcggccgcn

SEQ ID NO: 81971 - DNA, 943 bp, Zea mays
  misc_feature: Ceres CLONE 1567649
ctccccgcggtggcggccgctctagaactagtggatcccccgggctgcaggaattcgtctcacccctagaaaaaccctctccctctccctctccctgcatgccggcagccgctggaggcacagacgacaaggcatcggccccggatcgagcccgacccctcttctcgtctcgtctcgtctctgcgctgggaacgccggctgccatggctgtaagtgcccctctccttctcctcctccctcggttcgccttccaatcttccatggcatcagccagtcctggatgcttcggtttcgacggtttatatagtttggttgtgacttgtaccccacagctttttcggtagaattttgtaacccccctcttaccttgtgtccctgaaactttcctattatgcatggacaaaacaactcttttccccgccaagaaatttgggtggtttcccgggggggttcccccccaaaccatgggcgtttattttcctcccccccttatgggttttcccggatggcgccgaattctaaggcggggggattttggaacccccaaaattttttccccccccccgcgcattttctcccccccccttggggttaaagaccccgtttttttttgtccccgagagagagtttttttcctcacatttttgtttggggggcggtgtgtataaaaggatttccccaaaaccccccgccggaaaaaacttttttttttgttattgaaaaaaacccggcggaaaaaaaatttgttttttcccgcgggagccaaaaattttttttgttccccccccgaaaaaaatctttcccctccctccccccgacagaaatgtttgttgtgggggggccccacaaacccacccacaaaaaatagaggggggccccggcggtggaactccgggggggtgggagagataaagaacccgcccccaccccctctttttttttg

SEQ ID NO: 81972 - DNA, 848 bp, Zea mays
  misc_feature: Ceres CLONE 1567652
  misc_feature: Translation starting site: 154
aaagctggagctccccgcggtggcggccgctctagaactagtggatcccccgggctgcaggaattcgtctcacccctagaaaaacctctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcatccaacctcgggaccatcgccagggcccgggaccccaggagttctgggaagccccttggctgcccggcgcctaatggtgtccatgaatgggcccagttccggggtccggttttctacttcgggccatacccccggccgccgaaaaaaagatggcccggggaccccccgaagacccacccgatgcacggaggctattccctgtggggggaagcccccaaggcgggggcgggcgccgtgtcccgcgggaacacccgggacccccccctcgggggagagcccctttgagtctgtggccccccccgagaaaccgcccagcggtcccctcccggggggccgaacacaggggggagggcgccccccgcggggggaatgtggaccccctcacggggggactcgtaatctaagaaaaccgcccccg

SEQ ID NO: 81973 - DNA, 805 bp, Zea mays
  misc_feature: Ceres CLONE 1567653
  misc_feature: Encodes the peptide sequence at SEQ ID NO. 81974
  misc_feature (448)..(448): n is a, c, t, g, unknown, or other
  misc_feature (456)..(456): n is a, c, t, g, unknown, or other
  misc_feature (483)..(483): n is a, c, t, g, unknown, or other
  misc_feature (513)..(513): n is a, c, t, g, unknown, or other
ggagctccccgcggtggcggccgctctagaactagtggatcccccgggctgcaggaattcgtctcacccctagaaaaatctggcaatccccatccccaaatctcccatggcttcttcccctccccagccactcacccgcaccgtcctcgccgctaccctgctcctcctcctgcacaatgccgccgccagagccgacggcgcgtcgccggcggtgaacccattcacggcgaaggcggcattcatccgatactggaaccgcaaggtgcccaacaaccgcccgcacccggccttcttcgtcgccaaactctccccgctcccggccgctgactccgcctccttcccatccgcgctgcccgacatccgcgccagcctacccgcgctctgctcaaagccgcgctcctctgccccgggccggctaccacccgatgcggcgtcgctgggtgcatcnggccgcanggggcggggggcccttcaaggctacancaacgccaactttctcaactacgaaccggngggctagcggggacccactccttccaaattactccccgggactaaaaattgccccgaaagtttccgcgctacggcggggactctttgggaacccccaaaaggtttaccttcttaaaagacaaaagggaaattttggacccccaaatgcccctcctaacccgggggggccccacggggggggtttggttttttttgccccctaacccccgaaaaaaacaaagtccccggttcccccttttccaaaaaataaaaccccccccccaaaaggcccgggggggggaaaacttcctcc

SEQ ID NO: 81974 - protein, 137 aa, Zea mays
  misc_feature: Ceres CLONE 1567653
  misc_feature (117)..(117): Xaa is any aa, unknown, or other
  misc_feature (126)..(126): Xaa is any aa, unknown, or other
  misc_feature (136)..(136): Xaa is any aa, unknown, or other
MASSPPQPLTRTVLAATLLLLLHNAAARADGASPAVNPFTAKAAFIRYWNRKVPNNRPHPAFFVAKLSPLPAADSASFPSALPDIRASLPALCSKPRSSAPGRLPPDAASLGASGRXGRGALQGYXNANFLNYEPXG

SEQ ID NO: 81975 - DNA, 915 bp, Zea mays
  misc_feature: Ceres CLONE 1567654
  misc_feature: Encodes the peptide sequence at SEQ ID NO. 81976
aaggctggagctccccgcggtggcggccgctctatgaactagtggatcccccgggctgcatgaattcgtctcacccctagaaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgaggcctctgcggtgacccgcagaccgagcagctggccttcgagggctacaggagggcgctgctgcagcccgagttccggctggagaagaagacggccaacgcgctgaccctgcagctgatcagggagaagcagtggggctccctggagctgctggtcgaggacttcagggcccacggcgtgctcccggagaagcggacgtgcgcgcggctcgtcgcctggtgcatcagggcgggggaggttcgggcctcccgaacgaggggctccggggttcttccaaggccaagaaagggaagcccccggctggcattggcctttcagccccggcccagtgcagggggtaacaaacagggcttgcccaatggttcccgggaagaaaccggggcctttcttggtaacgggcgaaggggggaaagggtggggccctccccccgtgccgcctttgaaaaaccccggacagccctctaactcgggtgggccgcaacaaagagtgcggcggctgtttcgcccggccccacacacagggcgcccaa

SEQ ID NO: 81976 - protein, 239 aa, Zea mays
  misc_feature: Ceres CLONE 1567654
MAKCYSDWPPIPPFHPSRRTPPQSHASPITIRRQLASFVLHCSRSCAPLLEPKNLPDEFEAVPATPPPPLPDAAPKLGISNKFIRGLCGDPQTEQLAFEGYRRALLQPEFRLEKKTANALTLQLIREKQWGSLELLVEDFRAHGVLPEKRTCARLVAWCIRAGEVRASRTRGSGVLPRPRKGSPRLALAFQPRPSAGGNKQGLPNGSREETGAFLGNGRRGERVGPSPRAAFEKPRTAL

SEQ ID NO: 81977 - DNA, 804 bp, Zea mays
  misc_feature: Ceres CLONE 1567655
  misc_feature: Encodes the peptide sequence at SEQ ID NO. 81978
  misc_feature (724)..(724): n is a, c, t, g, unknown, or other
ggagctccccgcggtggcggccgctctagaactagtggatcccccgggctgcaggaattcgtctcacccctagaaaaaccctttccgccacttcgctccgctcccatgcctcctgccccctctcgccgtggaggcaccccaaaccctagcccctgaaaccctagatcctcctcccctgttccgatggcgggggccgcggcgtccccagcggcgggccacgtggtggagcggttccgctcgcggctgcgcgaggaagcgggcggcggcgagccgggcgccgccgcggtcgtgcacgtgtacgcggaggcgctccgtgagctaaccttcaactgcaagccggtcatcaccgagctcaccatcatcgcgggccagcacgccacgctcgccgcccggggaatcgccgacgccatctgcgcccgcgtcgccgaggtgccaccagatcagatattaccatctttgtatctgctagatagtattgtgaagaacataggtggggaatatgtagagcattttgcaactaggttgcgaagtgtatttgttgatgcatactacagagttcatccaaaccagtatacttcaatgaggcgcctctttcgtacctggtggccagtgttcccttcttctgtgcttcgcagcattgaggatgaccttcaattttctccctcggagaataaccgccccaccacatcaacaaatctgcatcaaacagagtcgttatctcctnaggcatctcatggcatacatgtaaatcctaaatacctggaaagcacacataagttcaagcaggccaatgtggtgcaccag

SEQ ID NO: 81978 - protein, 207 aa, Zea mays
  misc_feature: Ceres CLONE 1567655
  misc_feature (181)..(181): Xaa is any aa, unknown, or other
MAGAAASPAAGHVVERFRSRLREEAGGGEPGAAAVVHVYAEALRELTFNCKPVITELTIIAGQHATLAARGIADAICARVAEVPPDQILPSLYLLDSIVKNIGGEYVEHFATRLRSVFVDAYYRVHPNQYTSMRRLFRTWWPVFPSSVLRSIEDDLQFSPSENNRPTTSTNLHQTESLSPXASHGIHVNPKYLESTHKFKQANVVHQ

SEQ ID NO: 81979 - DNA, 807 bp, Zea mays
  misc_feature: Ceres CLONE 1567657
aaagctggagctccccgcggtggcggccgctctagaactagtggatcccccgggctgcaggaattcgtctcacccctagaaaaaaccaccgccaccgccaccgccggctcctgctgccaccgcccgctggctggcttagcgcgtaggctgtgactgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcagcttccgcttctcccgcctcatcgtcttcctcctcttcctgcccaccccgcccatcaaccccgccgcgcacctcgtctcgctcgtgtcctcgcccgccgtggcgctcgcgggggccaacgccacggccacgatcaccaagaccaccaccaccaccacctccgtcaccaccagcaccaccacccgtgggcgccgacatcggcggggcccacacgcaccaccaccaccaccgccacggctcccgtcttcgtcggacgccacccgatccgcgttcgcgcctggccccacccggaccccagcgagctcctcaaggggcacgcatcctcgccgccgtccagaaagcgcagcgcagcacaaagcgcgcggcccgggaccccccaagccccgttatccgcgtcaccccga

SEQ ID NO: 81980 - DNA, 796 bp, Zea mays
  misc_feature: Ceres CLONE 1567661
  misc_feature: Encodes the peptide sequence at SEQ ID NO. 81981
ggagctccccgcggtggcggccgctctagaactagtggatcccccgggctgcaggaattcgtctcacccctagaaaaagcactgcatgcctctcactctccctctccctagcggtctccacatgtgagaaacgcctctctagtaattaagcagcatggcagagaaggtgatgatctctctctctctctctctctctctctctctctctctctctcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccctctctgcactatccacggacactcgaggctgatcccggggctcccggatgaggtctctctgcagatcctcacgaggatgccgcggatggggtacctcaaggccaagatggtctcgcggagctggaaggcggcggtgaccggcgcggagctgtaccggctgaagaaagagctctgcgtggccgaagagtgactgtacatactgacgaaggcggcggcaggtgggcagaagctggtctggcacgctctcgatccggttagcaaccaatggcagaggctgccgctcatgccttgggatccagtgcaggaatggccgcttgtacgggctgggc

SEQ ID NO: 81981 - protein, 97 aa, Zea mays
  misc_feature: Ceres CLONE 1567661
  misc_feature (44)..(91): Pfam Name: F-box Pfam Description: F-box domain
MGASLGSAASKNRQQEHGGEAPRPDPCKKTRLSTPLCTIHGHSRLIPGLPDEVSLQILTRMPRMGYLKAKMVSRSWKAAVTGAELYRLKKELCVAEE

SEQ ID NO: 81982 - DNA, 826 bp, Zea mays
  misc_feature: Ceres CLONE 1567662
ctggagctccccgcggtggcggccgctctagaactagtggatcccccgggctgcaggaattcgtctcacccctagaaaaagcccccaccagagcagaggccgccacgcgctctcgtcccttctcaacccctccttctcctccgctccccccgcgcggcgcggaagagagaccaaaggggacggcagccaggaaggaagaggaggcttcgagatttttgcggaacccccacgccacccccctctgcacaccaccacaaccttctcctcatagcctgcctctcgcgtagggtttgcgcgcgccaccgtctccactccaatcccagcaccacccgtcctaccgccgccgcattcggagctctgcatctgcctgcagcccgattcgccaatcgccaccgagcctcgagaagcctcgccgtaccggtttggggatttctggtttccctttctcactgttactgttgctgggatctgaggagtgtttgtattggtgctaattgtttctgccgatttgggcgtgattatccaggctgagtggtattggtgatgtcggctgattagatttggggggtatggttaaaaggggaattcgttttttttggaggagggggacttctggacgtctaccttctctgctattggattgggctccgtgatcgagactgctccgtgaagtttttggtcctagggattgtgttttttttgatcggcccggaccaggaaatagagggttcttctcttgagaagatctagggccgcgtgtttctatcgtcgtctggagatgaaatccaaagataaaagaaaaaaggaaaattggagagggagaaaa

SEQ ID NO: 81983 - DNA, 781 bp, Zea mays
  misc_feature: Ceres CLONE 1567663
  misc_feature: Translation starting site: 688
  misc_feature: Pfam Name: UPF0061 Pfam Description: Uncharacterized ACR, YdiU/UPF0061 family
ggagctccccgcggtggcggccgctctagaactagtggatcccccgggctgcaggaattcgtctcacccctagaaaaaagcacggacggggcatgggattgacccacacacccgccctccgccccgcaagccaaatacgccgtggcacgcgtcgccatgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgaacgtggggggaagggggcgctggcgccccgcggcggctcgtcctggaggagctaccctgggaccattccttcgtccgcgagctgcctggcgacccgcgatcggacactatcccgcgggaggtcctgcacgcctgttactccagggtgtctccctctgccaaagtggacaaccccaagctggttgcgtggtctgattccgtggccgatctactcgatctggatcacaaagagtttgaaagacctgatttccctcagtttttctcaggagcaactcccctagtggggagtttgccctacgcacagtgctatggaggacatcagtttggtgtatgggctggtcagttggggggatggaaagaccgatagctctttggagaagttgtcacactcccgaaggtgaa

SEQ ID NO: 81984 - DNA, 835 bp, Zea mays
  misc_feature: Ceres CLONE 1567665
  misc_feature: Encodes the peptide sequence at SEQ ID NO. 81985
  misc_feature (687)..(687): n is a, c, t, g, unknown, or other
  misc_feature (832)..(832): n is a, c, t, g, unknown, or other
ctggagctccccgcggtggcggccgctctagaactagtggatcccccgggctgcaggaattcgtctcacccctagaaaaaacacctctctgcttgccttccaccgcagtgcgctgcacttccttccttccttcccgtctcttcttcccacttccttccacttcttggccctgctcctgttggttttagcatcctgctcggtcgaattctggatcagaggttgcagcaaaggtagtaagtcgcttctcgtatttcccgtcagagagggacaggggggagaacccccaaccgaggcgctgcaagttccccacggccgggccgggcttctcttgcgggaacatgaggaagctgttgttcatctccttcgtcctctcgctgtccgctgcagcagttcacggtgaagacggcgcgtacattggcgtgaacattggcacggccatgtcgtcggtgccagcgccgacgcagatcaccacgctgctccggtcgcagaacatccgccacgtgcgcctctacgacgcggacccggcgatgctggcggcgctgtccaacaccggcatccgcgtcatcgtgtccgtgcccaacgagcagctgctggccatcggcaactcgaacgcgacggcggccaactgggtggcgcgcaacgtggcggcgcacttccccgccgtgaacatcacggccatcgccgtgnggtccgaggtgctctcggcgcagccgagcgcggcgccgctgctcatgcccgccatgcgctacctcagaacgcgctggtggccgcggcgctggaccggtacatcaaggtctcgacgccgcactcgtcgtcatcatcctcgactcgntcc

SEQ ID NO: 81985 - protein, 164 aa, Zea mays
  misc_feature: Ceres CLONE 1567665
  misc_feature: SWISSPROT Homolog: EC 3.2.1.39 Glucan endo-1,3-beta-D-glucosidase
  misc_feature (117)..(117): Xaa is any aa, unknown, or other
MRKLLFISFVLSLSAAAVHGEDGAYIGVNIGTAMSSVPAPTQITTLLRSQNIRHVRLYDADPAMLAALSNTGIRVIVSVPNEQLLAIGNSNATAANWVARNVAAHFPAVNITAIAVXSEVLSAQPSAAPLLMPAMRYLRTRWWPRRWTGTSRSRRRTRRHHPRL

SEQ ID NO: 81986 - DNA, 907 bp, Zea mays
  misc_feature: Ceres CLONE 1567667
  misc_feature (44)..(44): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (611)..(611): n is a, c, t, g, unknown, or other
tttttgttttttggtttgtggtctttgtgggcggcggccgaggnaggggacctgtggtcagactgggaggccttttttnnnnngnnnnnnnnnaaaagtggagctccccgcggtggcggccgctctagaatagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctcccagcgatgtcgggggcgatcgggggcgccgaggtcacggcttccggggcgcagcggcccaactcccccggtcgcgggtgctcggaaggcgaaccgggtggcggcaccccgcgcgggcccggccgggcgggggcgtccccgggggaagaatacccccccgttttccccgcccctgccaaaaaaaggggagccttccttaaaattttaaacccgaaaaaccggggggtttaaaaaaatatttcccggggggggaaaaaaagggggattcttttttttcttcctccggggggaacaccccccttttttttttaaacacacccccgggggggggggnttttggtggggccccccccccacccccaagaaagggaggggcccccccccccccaaaataaatatttttttctcccccccccccaaaaaaaagagggcgggctctctttttttttctccccccccccgctaataaaaataaaaagaggtttttttttttgtcgggggaggaaaacagttctcctccccccctaaaaaaaaaatattttttccccccccaagaaaaaattttttcctcccgcggggggggggcggaaaaaaaaaaaaaaaaaaacaccccccccccctttttaagac

SEQ ID NO: 81987 - DNA, 809 bp, Zea mays
  misc_feature: Ceres CLONE 1567670
  misc_feature: Translation starting site: 591
  misc_feature: SWISSPROT Homolog: EC 1.10.3.2 Laccase
  misc_feature (809)..(809): n is a, c, t, g, unknown, or other
ggagctccccgcggtggcggccgctctagaactagtggatcccccgggctgcaggaattcgtctcacccctagaaaaaagagatgccccggaacgagaccgaccccgtttcctcggatgtgtagtttatcgttggacaatggttgactcctgtcctccatgactcggtcttctgtatacggcgagcggctaggctacagccctagtgtagcgtggcgcggtaccatagatggggagaccaatggagggcaccttcctcgccggcgacgctcgtctgcctcctcctcctcggatggctgctcctgcaggcacgagccgatgacccctagaggatctacacctggaacgtcaccttgggagatatctaccctgtcggcgtctagtacgatgggatactgatcaacggacacttcccggggccgcagatcgacgccgttactaacgacaacatcatcgtgaacggtcttcgacaacctgccggtccgcttcctcctgctctgggagggaattcagcaccggaggagctcatggcacgacggcgtgtacggcaccaactgcccgatccatccgggcggcaatttcacttacaacatgcacctcaaggaccagatcgggagctactactacttcccttcccttctgtttcacaatgcagctggcggttacggtgccatcagggttctcatccgggcgaggatccctgacccgtttgaccggttctgccggggatatcatcatattggcggggtgactgggttcaagcgtcagccacaccgtacctgaaaggccattctgggacaaatggcaatn

SEQ ID NO: 81988 - DNA, 794 bp, Zea mays
  misc_feature: Ceres CLONE 1567671
  misc_feature: Encodes the peptide sequence at SEQ ID NO. 81989
ctccccgcggtggcggccgctctagcactcgtgtatgctccggggtgacggaattcgtctcacccctagaaaaacaggatatgctcgccgatcatccctccctcttgtacggatttctgcgcgagttcagccttcagatttccatttcctacgcgacggtgatagaagagctgccatccggtagagtaaaccctacccgccggttgcccggtgctcgggcgaaatcccgggatgagatctgtggcgcggcacctggcatggcgagctcccgactcggttaccctcaccgcttctatcctgccgcggcttacgcagggttcggatgccgtggggccgcctcctccgaagatatctgctgctttcagaagtaggtgcccctcttcgtcaacggactgatcctactggtcactcgctgggccatggtatgggccccaggctcgggcgtggaaccccgtgaagcacagaaaaaggactgactggcgtagactaggacgacataccttcgtgctaggcgatgcttcttttggtggatggctgatgagacgaagattctgcatggtactctaaggtccctgaggtcaaccctgcagcctgttggtgatattccgatgcttaacccacaagacgagccccaccgtgtaccggcttcaacaaactggaacgtcgtttgctgaacccgatgatcgtatctgcagaatggtaggttctgtgtagactcaagaactatgattttatttctgggaagggccttacactggtaatctctcaaggatgagcggaactccctttatctg

SEQ ID NO: 81989 - protein, 37 aa, Zea mays
  misc_feature: Ceres CLONE 1567671
MASSRLGYPHRFYPAAAYAGFGCRGAASSEDICCFQK

SEQ ID NO: 81990 - DNA, 686 bp, Zea mays
  misc_feature: Ceres CLONE 1567672
  misc_feature (264)..(264): n is a, c, t, g, unknown, or other
  misc_feature (278)..(278): n is a, c, t, g, unknown, or other
  misc_feature (565)..(565): n is a, c, t, g, unknown, or other
  misc_feature (566)..(566): n is a, c, t, g, unknown, or other
ctccccgcggtggcggccgctctagaactagtggatcccccgggctgcaggaattcgtctcacccctagaaaaaattttcctggggctgctgcgccgcgcttctctctctcgccttctccctcttcgcggcgatccgggttccgctgcaacggcccctgtcgactgtcgtcttctcttctccctcacggcgctcgatccctccggattgccgcgtagcgggatcagtggtttagaggagaggaagcgctgattgacgctaaccngggtgttcttaccnatttttagatttcagctggtttgaaccaggacctagtaaaagatggtccatcagaaaggggaaaacaaaaaaattgtggccctaaaatgaaaacctttttgtccccggggggaatcctggcccaaccccaaaattttccgggggggggaaaaaaaggccccaaaaacgccctggggccccccccccccacaggggggaaaatatttttgggggggccccccccccccggcccttttttttaaaaaaccccccccccccccccccaaaaaaaaggggggttataaaanncccccccccccccccccccaaaaaaaaaaaaacggggcccccccccccccgcgtttttttttttttttttttataaaggggggggggggggcccccccaaaaaaacaagaagagaggggg

SEQ ID NO: 81991 - DNA, 1085 bp, Zea mays
  misc_feature: Ceres CLONE 1567673
  misc_feature: Encodes the peptide sequence at SEQ ID NO. 81992
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (54)..(54): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
attttttnnnnnnnnaacttaataaaaaaaaaacgtaaaatgaaaattaaaganggcngnnnnnnnnnnnnnaaaagctgggactccccgcggtggcggccgctctagaatagtggatcccccgggctgcaggaattcgtctcacccctagaaaaatactcaccttcacaaacattggaaaagcactcctctcttcgtcctccccctccctcctccatcccattccataccattccgccaaagaagaaccacagacgctcgctcccaactcccaagccaagccggatcccaaaatcggcacagcgcacccactccgctcagtccattcgttcacccccatccatccagccagccagccagccatgggcggcaaggactgcggcaaccacggcgaggacgacctgcggcggtcgtgccggcgcctgctagcgatcctcctagtcctgggcctgatcgtgggcgtgatcgcgctgatcatctacctggtggtccgccccacgcacccgacgcttctacctgcaggacacgtcgcttgagcaggctagacctctccaacgccatcaccaccacccaccaactccgacgttcctcgtcccttcctcttacaagacggttggcaggtggaacgctgaggcctccccgccaaccccttaacctaacctccgtggggggggtgaaaactaacggaaccgggctttgggaacgtggaaaaacctcctttgcgtaaaaaagattacccacagccagggttggaaaccgggttggggccccgaccgggattacctttacccgaatcccggttgtaaacccaagggggcccaattgggccgaaaccttgggaaaccccgggggggattcgcaccacggtagatatctttcgcgggccccccggggaaatactcccactttttaaaggctctctataaccttaccgccaaaaagatgcgtgtttggccacagggaaatgtccccagggggggggggataaaacgttgcgccctatccaagaggttacagagtgtctataaagagccctctcttgtgttaaatgaaaaaaggccacggcaagcttgggaatattcccc

SEQ ID NO: 81992 - protein, 57 aa, Zea mays
  misc_feature: Ceres CLONE 1567673
MGGKDCGNHGEDDLRRSCRRLLAILLVLGLIVGVIALIIYLVVRPTHPTLLPAGHVA

SEQ ID NO: 81993 - DNA, 906 bp, Zea mays
  misc_feature: Ceres CLONE 1567674
  misc_feature: Encodes the peptide sequence at SEQ ID NO. 81994
  misc_feature (681)..(681): n is a, c, t, g, unknown, or other
  misc_feature (682)..(682): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (754)..(754): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (822)..(822): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (834)..(834): n is a, c, t, g, unknown, or other
  misc_feature (836)..(836): n is a, c, t, g, unknown, or other
  misc_feature (837)..(837): n is a, c, t, g, unknown, or other
  misc_feature (851)..(851): n is a, c, t, g, unknown, or other
  misc_feature (896)..(896): n is a, c, t, g, unknown, or other
ctccccgcggtggcggccgctctagaactagtggatcccccgggctgcaggaattcgtctcacccctagaaaaaggctctgcattctcccctccggccctcccctcgtcttctcttctcttctccccgcggagcgagcgagagaagcaaggccgctccgtgcccccaaccccgctcactgagcaaagcggaaaaagcgaggaaaatatcctgctccagcgaagcaccgcaggccgcagccgcagccgcagcagaaaagagcagacgccatcgcccgccgccgccgcccccggagaatggtgcgggccggaccgcgaccgggcgaagagggcgccgcgggccccggcggcccccgccgccccctgataatagatccacctgctgctaccagccatctgaaaaggacactggtcgcacgcgaggggcccccgatattattttgggggataaaggcggcgggggagatactaccgagcccccctctttgtggcgcctggtgtctctgggttccggggccgcggggcccctttgccgcctttgttggaagacccgaaggcgtgggtcccggggccctttttgaaaattttggggatagggggcggggggggcccaaagagggggaaataaccaccgtgggttttttgtgtcggggaaccaaacccacacctttgtcgtggaaccnncccagaaaaaaaggggggggaggggattcttttttcctctcctcgcacgggnnnnggaaccggacccccggnccggtcccccgggcggggttnnnnnnnnnggggggggggcccttgctcaatnnnnnnccannnnnagntcccnnnnnacntnnttttagcgggcggntagcccgagtcaatacccactacaaggggggggaaatcactcctnccggggctgg

SEQ ID NO: 81994 - protein, 203 aa, Zea mays
  misc_feature: Ceres CLONE 1567674
  misc_feature (129)..(129): Xaa is any aa, unknown, or other
  misc_feature (147)..(147): Xaa is any aa, unknown, or other
  misc_feature (148)..(148): Xaa is any aa, unknown, or other
  misc_feature (160)..(160): Xaa is any aa, unknown, or other
  misc_feature (161)..(161): Xaa is any aa, unknown, or other
  misc_feature (162)..(162): Xaa is any aa, unknown, or other
  misc_feature (163)..(163): Xaa is any aa, unknown, or other
  misc_feature (171)..(171): Xaa is any aa, unknown, or other
  misc_feature (172)..(172): Xaa is any aa, unknown, or other
  misc_feature (174)..(174): Xaa is any aa, unknown, or other
  misc_feature (175)..(175): Xaa is any aa, unknown, or other
  misc_feature (176)..(176): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (186)..(186): Xaa is any aa, unknown, or other
  misc_feature (201)..(201): Xaa is any aa, unknown, or other
MVRAGPRPGEEGAAGPGGPRRPLIIDPPAATSHLKRTLVAREGPPILFWGIKAAGEILPSPPLCGAWCLWVPGPRGPFAAFVGRPEGVGPGALFENFGDRGRGGPKEGEITTVGFLCRGTKPTPLSWNXPRKKGGGGDSFFLSSHGXXNRTPGPVPRAGXXXXGGGPLLNXXPXXXPXXXXFSGRXARVNTHYKGGEITPXGA

SEQ ID NO: 81995 - DNA, 854 bp, Zea mays
  misc_feature: Ceres CLONE 1567675
  misc_feature: Encodes the peptide sequence at SEQ ID NO. 81996
ggagctccccgcggtggcggccgctctagaactagtggatcccccgggctgcaggaattcgtctcacccctagaaaaaagcccgccccgtccgcccgcccgagtcacactcacacagagccgagccgagcccaggcaggcaggcaggcggcccaggcgcccagcccacccccctacccccgcggcgccgccggagccagagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatggccgtcgtcatctccggggtgcgcctgctccgcctccgccccgaccgccgctaccgctgcgaccccctccccgaggacgacccggagctgggctcctccgcgttccccgtcgtgctcgtccagatccccatgttcaacgagcgcgaggggtaccagctgtccatcggcgccgtgttgcggctgtcgtggccggcggaccggctggtgggggcagtgctcaacgactccccggaccaagtgattaagggaaatggggcggatggagtgcaaacggcggcgcctcgaaggggaacaaccttaacgtaccagatccggggaggaccgccagggggtaccaaggcccgcccccctttcgggcggggaataaagcacccctttccttggcctgactgggaaataacggggcccattttgtaaggcgcgaaattccggcccgagcccggaagtacctttagagggcccactttccttgatcccttgggccaaaaccacggagaaaaaccccctctcctccagggggga

SEQ ID NO: 81996 - protein, 179 aa, Zea mays
  misc_feature: Ceres CLONE 1567675
MDALPEAWSQVRAPVIVPLLRLAVAVCLTMSVLLFLERVYMAVVISGVRLLRLRPDRRYRCDPLPEDDPELGSSAFPVVLVQIPMFNEREGYQLSIGAVLRLSWPADRLVGAVLNDSPDQVIKGNGADGVQTAAPRRGTTLTYQIRGGPPGGTKARPPFGRGIKHPFPWPDWEITGPIL

SEQ ID NO: 81997 - DNA, 1235 bp, Zea mays
  misc_feature: Ceres CLONE 1567678
  misc_feature: Encodes the peptide sequence at SEQ ID NO. 81998
  misc_feature (9)..(9): n is a, c, t, g, unknown, or other
  misc_feature (14)..(14): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (463)..(463): n is a, c, t, g, unknown, or other
  misc_feature (907)..(907): n is a, c, t, g, unknown, or other
  misc_feature (1235)..(1235): n is a, c, t, g, unknown, or other
tttttgttnccccnccccctcaaaaaaatgaggtatannnccccccnnnnnnnnnnnnnnngatatnnnnnaactataatgggtcccccggtggcggccgctctagactagtggatcccccgggctgcaggaattcgtctcacccctagaaaaaacccatcccccttcctcgcccgccgtcataaatagccagccccatccccagcttctttccccaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggctcagatccaggacaaggaagggattcccccggaccagatttttttccccccccccctggggggggggggggggggggggntcccccttctttcctaactaccaccccccaaaaggagagacccccccccccttggtgctcccgccccccccgggaataacattcccaatcttttgttcacaacaccctcccccgggaaagacctcggccccccctcgcggggggtgagttttctctcgaaccccgccttcctccaaatttctttttcgggcccatgagacccccggtggaccgaggttggtttgtccatctccgcgcccgagcaggcgacggctctgggtcgcaggaaatattaatgcagtgcaccagggagagacgtatcggcgccgtccatcgatctcgccgcggtcgttctatcgacgcacccctcgcttttcccgcgacataccaccccgtagtctcggcctgttggacgctcgagtgatcgcgcggggtgagcggcccacgtcacatcacttatatccnctgtctgtccgctgagccacttctccagcgtcttctctcggtgatgatgcacctatcatcgacctcgccttgatctgtacccgctgacacacccgcttgtgagaggtcgacgtcggtatgttagagagagcacccagttgctatctcgccgcgctgtccatatctgtccccgccctgcttgtgatgacagtttagaacgccaggtctgatgtggggctcggcgcgtcggcgccagtgtcccgcgggaccgggaacctgacagcctcctgcgcaccccactcgtcgacacgcagtcgccgcccgtgtatggtctgcgccgcgcatccgn

SEQ ID NO: 81998 - protein, 59 aa, Zea mays
  misc_feature: Ceres CLONE 1567678
  misc_feature (55)..(55): Xaa is any aa, unknown, or other
MQIFVKTLTGKTITLEVESSDTIDNVKAQIQDKEGIPPDQIFFPPPLGGGGGGGXPLLS

SEQ ID NO: 81999 - DNA, 791 bp, Zea mays
  misc_feature: Ceres CLONE 1567680
  misc_feature: Translation starting site: 200
  misc_feature (615)..(615): n is a, c, t, g, unknown, or other
  misc_feature (640)..(640): n is a, c, t, g, unknown, or other
  misc_feature (724)..(724): n is a, c, t, g, unknown, or other
ctccccgcggtggcggccgctctagaactagtggatcccccgggctgcaggaattcgtctcacccctagaaaaattccttccacttccactctctctttgcttccccgccctctccgccgcgcttttgctgatccgtgtgctgtgtgtgtgtgtgtgcgcgcgcgcgcgcttcaacttgaagaagcgcgggcgatcgagatggcgcacgaccccagcctgggcttcgcggactacttctcggcggcggcggcggctgcggcggcgggcgccacggcgatggacgacgacgtcggggcgccggagctctatggcctgcatgccgacgacatggagttcctcggcatgcgtggcctggccgccatgccccctgccgcggcacaccaccaccaccaccaccatcacggccacagcaaggccggtgcgctcctcgacgacgacgacgcgggggtggggccagacgtcagcggctccgcggacgacgccaccatgcgcttcctgagcgagcagcagcagcagcagcagcaccaggcgccgctgtcgctgtcgctgtgccggccggacgtgacgacgacgttgcacgagcagcaccacctcgccggcggcggctcctcgtnccggtaccatcaggagcagcagccnggcggcgtgggtgcagcagcagcagcacgactactcgccgtcgccgcagcagcacgcgtggcacctgcgcagctccaggttccntcgtccggcgcagcaggtcttgcaggagttctgcagccctcccgtggacagcagcagcgctgccgcc

SEQ ID NO: 82000 - DNA, 843 bp, Zea mays
  misc_feature: Ceres CLONE 1567681
  misc_feature: Encodes the peptide sequence at SEQ ID NO. 82001
  misc_feature (603)..(603): n is a, c, t, g, unknown, or other
  misc_feature (633)..(633): n is a, c, t, g, unknown, or other
  misc_feature (648)..(648): n is a, c, t, g, unknown, or other
ctccccgcggtggcggccgctctagaactagtggatcccccgggctgcaggaattcgtctcacccctagaaaaaacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctctggggcagcggccgactgcgttggtaggaagcccatgctggtcgcctcggctgtcctctacttcgtcaatgggctggtgatgctctgggcgccaagtgtgtacatcntgcctcctcgcaaggctcattgatgggttncggattcgtttggcnggtcacaactggtcctctctaattttccaaaatggcgccaacgacattcgggggctggttaaacccttgccccaattcatgggggcaaggaggagttccccccccaacgaagggggtttgggaagcccccccggcccaacccaattgggaggccctgccctgaattttggaaaaccccccccttttaactttgga

SEQ ID NO: 82001 - protein, 105 aa, Zea mays
  misc_feature: Ceres CLONE 1567681
  misc_feature (99)..(99): Xaa is any aa, unknown, or other
MGGAVMVAIAASIGNLLQGWDNATIAGAVLYIKKEFNLQSEPLIEGLIVAMSLIGATVITTFSGAAADCVGRKPMLVASAVLYFVNGLVMLWAPSVYIXPPRKAH

SEQ ID NO: 82002 - DNA, 874 bp, Zea mays
  misc_feature: Ceres CLONE 1567687
ccccgcggtggcggccgctctagaactagtggatcccccgggctgcaggaattcgtctcacccctagaaaaaacaccaacccaacacctcttcttcctccgctctcagcttaccccaccacaggcgagggaggcgactccttcctcgcggctacccgctccggccccgatcgcatctcctttgcacgccacggcccgcgcgcagtgtccaccggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcccgtccaccgacgaatttccccacagagcatttagagcaattatcttggagttgcagatctgtacctgaagattcatattgaaatctgggaaggtccctgctgttgagtaccagaaaaatatttcttgccttttggaggaagactgcaaacccccctaaaatgggaaacctggtttccttttcctggccacccccgaaatggccgacaaaactccgccccctcccctttaccttagcctgaagggtcgtacctgggatccaaacccccgaggaatgggagcagcgccaccagggggtaaggtgggcccctgaaacccctaaattggaaatttcccaaggggaaaaatggggccccccctggcttcccggtttccccccaaagggcgtgggaaaagagaacaacccttgaaaaaattcaaattcttgtgggaaaaggccctttcaaacaaaaacctctaagatcc

SEQ ID NO: 82003 - DNA, 826 bp, Zea mays
  misc_feature: Ceres CLONE 1567689
  misc_feature: Encodes the peptide sequence at SEQ ID NO. 82004
  misc_feature (653)..(653): n is a, c, t, g, unknown, or other
  misc_feature (657)..(657): n is a, c, t, g, unknown, or other
  misc_feature (749)..(749): n is a, c, t, g, unknown, or other
ctccccgcggtggcggccgctctagaactagtggatcccccgggctgcaggaattcgtctcacccctagaaaaatgctttctcttggtaggtgttctctgcctgcctcctccaaccccggcccctcactagaattcttgtcgcaagcacacaccatgatctgttacatgctgtggttagcggcatgctgcctcctcctcttgtacagcgttcgattcaggtccggctggagccatggcaacggccccaggagctaccccgtgattgggtgcctggtcgacttctacaagaaccggtggcggctgctggactggtacactgagctgctggcggcgtcgccgacgcagacgatcgtggtggaccggctgggcgcccggcgcaccgtggtgaccgcgaaccccgtgaacgttgagcatattctcaagagcaacttcggcaactaccccaaggggaagcccttcaccgacatcctcggcgacctgctgggcaccggcatcttcaacgtcgacggcgagctgtggtacgcgcagcggaagctggtgagccacgagttctcggcgcgcgcgctccgggagctggagttcgccgtgctcgaggacgaaggcgcggagcgccttgtgccccgccctgggctggcggctgcgcgcggcgacntccntaacatgcaggacctgctccggcgcttctcgttcgacgtcatctgccgcgtgtcgctgggcgttgacccccgggtgctggaccctgcattgncgggcccgaagcctggccgcggcttcaacccggcggggggggatcatcgccagggcgcggcgcggcccccgtggccc

SEQ ID NO: 82004 - protein, 224 aa, Zea mays
  misc_feature: Ceres CLONE 1567689
  misc_feature: SWISSPROT Homolog: EC 1.14.14.1 Unspecific monooxygenase
  misc_feature (167)..(167): Xaa is any aa, unknown, or other
  misc_feature (168)..(168): Xaa is any aa, unknown, or other
  misc_feature (199)..(199): Xaa is any aa, unknown, or other
MICYMLWLAACCLLLLYSVRFRSGWSHGNGPRSYPVIGCLVDFYKNRWRLLDWYTELLAASPTQTIVVDRLGARRTVVTANPVNVEHILKSNFGNYPKGKPFTDILGDLLGTGIFNVDGELWYAQRKLVSHEFSARALRELEFAVLEDEGAERLVPRPGLAAARGDXXNMQDLLRRFSFDVICRVSLGVDPRVLDPALXGPKPGRGFNPAGGDHRQGAARPPWP

SEQ ID NO: 82005 - DNA, 819 bp, Zea mays
  misc_feature: Ceres CLONE 1567690
  misc_feature: Translation starting site: 151
ctccccgcggtggcggccgctctagaactagtggatcccccgggctgcaggaattcgtctcacccctagaaaaaaacctccgccatcaccgacgctgactcccacaccggccgccgcgcgagccccggcaccatctccgcacgagcagaaatgggggatgcgtgtttctcaacacagctaattgatggagatggggtcttcaacgtctctggattggagaacttcatgaaggatgtcagattgggtgaatgcgggctctcctatgctgttgtatcaataatgggcccgcaaagtagtgggaaaagtacacttttgaatcatctttttggcaccaattttagggagatggacgccttcagaggaaggtcacagactaccaaaggtatatggttagcgaaggcccagaatattgaaccatgcacccttgtaatggatttggaaggaactgatggaagggagagggggagaggatgacacagcatttgagaagcaaagtgcattgtttgctttggccgtttcagacattgtgttgattaatatgtggtgtcatgacattggtagagaacaggctgcaaacaagcctcttttgaagactgttttccaggtcatgatgaggttgttcagtcctcgtaaaacaacattggttgtttgtcattcgtgacaaatcaaggacacccctagaaaatcttgaaccaatttttaagggaagacatttcaaaagatatggggatgctggttccaaaaaccccatgcccattaaagaaactccacctttagcgaaatttttcgaatgtgacaagttggggggcaactgttcct

SEQ ID NO: 82006 - DNA, 1303 bp, Zea mays
  misc_feature: Ceres CLONE 1567691
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (71)..(71): n is a, c, t, g, unknown, or other
  misc_feature (1089)..(1089): n is a, c, t, g, unknown, or other
  misc_feature (1303)..(1303): n is a, c, t, g, unknown, or other
nnnnnttaaaataaatccctttttatttttttcagctgtgcccccatggttcacggccgnnnttttattanaaaaaagtggggctcaccgcggtggcggccgctctagaactagtggatcccccgggctgcaggaattcgtctcacccctagaaaaacctcgcgatccggaaacctctcccttcctatccgcctcctgcaagttccagagctcatgaatctgcgccatgggcgagtaacacagacaccttcgtttttcaaggtgagatctaccacgtgctctcactcatcacccaactaccttctactccaacaaggaggatttttctccggggagcttatctccaacttggaccgatggcgctgggacaatatccaggttagaagaggctcacctgatcaagggcaagcctcgatgccgcaccccttaagctatttcatccatcccgtggtcccacaacaaggtccacgaaacgctgcctggtccattcatccaccagcggggcctttggacctcccccaaaatctgggaccccctgggtccttacaaccgttgcgagcctccactcggctcacgggttccgggggaaccgccatgttaacttctataggagaggtatcggtcggaattgctcgcagcgcccatgaatggttcgctaccaatctagtgtgggccctatttgtgccgtgccgttacttttggtaccccatgctcccttggcgtcgttgcacttaggggcaattgtcgcaggactaacacgccttcttgtggcgatgacgtagcctcgccgcgctcggacaatgtcgtaacgtgatatacgcgcgcgcggacggagcgagcgagtcatgacgcgataacagcgatgcgtaaagcccctctccgcgtctggagcccaccccctcgcgtgagattcacgtcttctgacccgtctcgtagcgatccgactcctggagaggttctacctgctagcctgtcgcggttgacccgccgcagatggtatatgtgtcggacgactgcgagatctacacttccgaatagcctacgccacgaacctggtcctctctcttgtctcagcgtgggctgcgacgncactgcgtgcttccgtgaggcagacgccgacgtttcttcccctcggttataatgcggctcagatgtcttcccatgcgcgactacctccgcgcagcggttatatatcacgcacccgcacactataataggctcccactgtaaagcctctagaggtgtcagataccggcgcgcctttgtgtgagcaatcctctgcagcacacatcgactcccgcgn

SEQ ID NO: 82007 - DNA, 1188 bp, Zea mays
  misc_feature: Ceres CLONE 1567694
  misc_feature: Encodes the peptide sequence at SEQ ID NO. 82008
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (53)..(53): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (691)..(691): n is a, c, t, g, unknown, or other
  misc_feature (926)..(926): n is a, c, t, g, unknown, or other
nnnncccggttttttttcctccgaccgtcgcgtcgtncatccatgannntgtnttagnnnnngggtnnnnnnnaaatgctggagctccccgcggtggcggccgctctagaatagtggatcccccgggctgcaggaattcgtctcacccctagaaaaaaaaaaaaaaagccctcacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggtaggggcatccgatgaaaccgcaccgggtgcggatgacgcactcgctgctggcgcgctaccccccccccgaccaaatgcagggggtccggccccaaacccgggccccgcgaccgcgacctctggccgcttcccccgccgaaagacatacatcaaagttgccatggggctcccgtcaccgcccgggagacccccggcgggggcccaggaatcccgccctggctcaaaaccgcctttcaaaccagtttggggcgaaaggaactgggccccccgtntcttttaccaacagaggccgcttcttatcaagacctgttcgtgggccccaagaaaccgcctaagtgtctggaggggggagtctctcatccaccttctccagcggagggagtgggcctcgcttctcacagagtggtttgcgaacgccctcccgagggggcgcgccggcaacatgtcgggccggaaatcgcacaacctgtggacacccagagagggtgggtcctctgtgtgtacctnctcctacacccatgaataaagagggcggagagggacttgtctcaccgacgggagtttccgtgtcgtatgcacgcgacacagaagaaaactggtgagaggctgcgcccaattaattctgcgacacgagcgcgtggcgagggtgcttaagaaaaagagaaaatgttattctcggtaactcgccgtatatgggaaaagtgcccacccccagtgggagagttggagggaggcagggcgagatctcttttctctccacacgaaagcg

SEQ ID NO: 82008 - protein, 39 aa, Zea mays
  misc_feature: Ceres CLONE 1567694
MDPSSAGSGGNSLPSVGPDGQKRRVCYFYDPDVGNYYYG

SEQ ID NO: 82009 - DNA, 827 bp, Zea mays
  misc_feature: Ceres CLONE 1567696
  misc_feature: Encodes the peptide sequence at SEQ ID NO. 82010
ctccccgcggtggcggccgctctagaactagtggatcccccgggctgcaggaattcgtctcacccctagaaaaagctcgctctagtcctccgactccaagacctcgagtcctcttcctctcccctcacctccctcaacctgcagcttcgacgtcacctcctctcttcccgtctgcgctctctcccctggtgcgccgggctacaggtttcctccagggctgcaggaagcagcttctgttgcagcttgaatcgagaagtggcgtggtaacatcaccagggagaagttggattgttccgccagagtgctcgatgacagatcatttcgctctaggtctaggtgctcttcttcttttgctgctaagtagcagctgtttcagttccgaccttgatgtcccatgcctgagagacgttaagcaatcagtgaccgatcctactggcatactaaaatcttcatgggttttcgataatacctctgtgggggttcatatgcaaatttcctgggtgtggaaatgctggtacccctgatgaagaaccgaaattctcccaattgcgtcttcagcaaactttgggccttcaggggcccaattcccctaaaaggcctcaaaaaacctgtcccagttttgaactaccccgggaacccggtcgaagtaaaaagctttccaagggggcccatttccctttcaaaaatcccagaaagaaaaggggccgtttttttaaaaaattctttgggaaccccctccctaaaaagagggtgtttctcgggggggaaatatcccaagggccctcttttcttataaaacacccccggtgccctttaaaaacccccct

SEQ ID NO: 82010 - protein, 71 aa, Zea mays
  misc_feature: Ceres CLONE 1567696
MTDHFALGLGALLLLLLSSSCFSSDLDVPCLRDVKQSVTDPTGILKSSWVFDNTSVGVHMQISWVWKCWYP

SEQ ID NO: 82011 - DNA, 852 bp, Zea mays
  misc_feature: Ceres CLONE 1567699
ctcctcggtggcggccgctctagaactagtggatcccccgggctgcaggaattcgtctcacccctagaaaaattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctagatagaagggaaatcaaaaaatcccccagccgacagccgccgagcaaaccggctcctccggtcggtcatccactcatcctcatcccctggcccctgcccatccgatccgatcggtcatcccctacccctacctgatcggatccccctgctcttccgccgagcaccaccaggcagcaggctgcagccgtcgagcaccagcatgagcacgggcaaggaggacgacgccccgcatccttgcctctttctctgctggctggagcttcctgcttgccaggagcacggccatgaagggacgacgccccctggctgctgcccggttggaaccggttgatctggcttgcgcccccccatcccttgccttctttctccttcccttttttggggcttcggccctcgaatctggctggcctaggtaaatgac

SEQ ID NO: 82012 - DNA, 1213 bp, Zea mays
  misc_feature: Ceres CLONE 1567702
  misc_feature: Encodes the peptide sequence at SEQ ID NO. 82013
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (27)..(27): n is a, c, t, g, unknown, or other
  misc_feature (28)..(28): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (830)..(830): n is a, c, t, g, unknown, or other
  misc_feature (978)..(978): n is a, c, t, g, unknown, or other
nnnnntttttttggggtgaccaacaannccatacaaaaaaaaaaananntnnnnnnnnnnnnggccnnnnnnnnaaaagctggagctcaccgcggtggcggccgctctagaagtagtggatcccccgggctgtaagaattcgtctcacccctagaaaaagctgattgccatgatggtgggggtcctggcctcccggattgctccgggggcctccgccccatgctcaactccgcctggacctctgaatcgtcgagcaccgcgccgggtgcacaactgctacaggatctctccccgtgcttccacgtgaacctccacgccgccagcgccgccatcgaccaagcggtgggggaccacctcgccatccacctcgtcgacttcgacgtcagcttcgcgcaacacgcggttctcatcaagtacctcgccgatccacccctgcagggcaggtccgcgggagtcactgccgtctccaaacctgacccccccgcgtggcccattctctaacccgcatcggctaccatgccttccctggcaccggctgaaagaaaggtcggcctaaccggacctcggcggggtgagtacccgcttttttcagtgggggtcaatgttgcccaagccaggctgggaccctagggattgccttgcccaaggtcattgtagccttcggtgaactccacccgcggggacaggtcgtggcttcgccccgtgtttataaaagattagtgggcccttgtagaagccgagctttcgttgacggccagaccgcgttcgagctcctcgtgtattcggagaaggaagggcggagtgcccgtgcggctcacccgcgggggggngtaaaaacctcgcttctcggtcgcttaactgagaggaggctggttcttttccctccgctcctatagcgtattggatcgtgattttagctgcttgtcgggagatctctctagtgacaacgtgtgcggttgcgaatacgccaggtcggtntttggggtagcctctagggcaactcgtttaatcatgagcgctagatgtgagtggcgtcttccacaagactgggtaggggagcaaggacgccccttctccgagaagaccaccgagtggtcacggcggtttcataaaagtggcacgtcatatcctctcgtaaaatatcccgagtgtacaacggcaattacggtatggcacgctggagatacacggcggagcgcctacgcgccccgcc

SEQ ID NO: 82013 - protein, 93 aa, Zea mays
  misc_feature: Ceres CLONE 1567702
MLNSAWTSESSSTAPGAQLLQDLSPCFHVNLHAASAAIDQAVGDHLAIHLVDFDVSFAQHAVLIKYLADPPLQGRSAGVTAVSKPDPPAWPIL

SEQ ID NO: 82014 - DNA, 837 bp, Zea mays
  misc_feature: Ceres CLONE 1567703
  misc_feature: Encodes the peptide sequence at SEQ ID NO. 82015
  misc_feature (700)..(700): n is a, c, t, g, unknown, or other
ctggagctccccgcggtggcggccgctctagaactagtggatcccccgggctgcaggaattcgtctcacccctagaaaaaagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatcagtgaagaggatgatgatgatgattctgtttcggagagctcttcagcatcattggccaaaccagctggaactttggatcttggcaagctgacagaggaacacagcctcaccgcagtgtggatccaaacattcgtatgatcaagtngttattagatccactcggttactgggagaggagatccaagaaacgcaacggcggccacaggctttggataaatgtgtggcgtgcagtggtgttgactcaaagagaaagacaagtttggcagaagtcctgatccagat

SEQ ID NO: 82015 - protein, 133 aa, Zea mays
  misc_feature: Ceres CLONE 1567703
MIHDTSSSRASTACHYSPSLVAEEQLHGSKDTLTLKGEKALLELLLGMALDQHVDGRKLITQQEAEDSDFESYLREATSRVLYQPTFISEEDDDDDSVSESSSASLAKPAGTLDLGKLTEEHSLTAVWIQTFV

SEQ ID NO: 82016 - DNA, 868 bp, Zea mays
  misc_feature: Ceres CLONE 1567704
  misc_feature: Translation starting site: 229
  misc_feature: SWISSPROT Homolog: EC 5.5.1.4 Inositol-3-phosphate synthase
  misc_feature (32)..(32): n is a, c, t, g, unknown, or other
  misc_feature (45)..(45): n is a, c, t, g, unknown, or other
  misc_feature (49)..(49): n is a, c, t, g, unknown, or other
cttagctggagctccccgcggtggcggccgcngtccaacggaganattnccccgggctgcgttcaaaagaagggggtctagaaaaaacacggtccacacagcccaacaaaggagctcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgcggtccccaagctcggggtcatgcttgtggggtggggaggcaacaacgggtccacgctgacggctggggtcattgccaacagggaggggatctcatgggcgaccaaggacaaggtgcaacaagccaactactacggctccctcacccaggcttccaccatcagaataggcagctacaacgggggaggagatatatggcgccgttcaagagcctcctacccatggtgaacccagacgaccttgtgtttggaggctgggacatcagcagcatggaacctggcagatgccttgaacaagggccaatgtgctggaaattgaacctggtgaaacagcgcagggcccaaaaggagagccatggggggcccttgcccgggtgtttatgatccgggaacttcatcggcccgtaaccaagggctgtgggtgccaagcaatgtcaactaagggcacaccataaaataacaaggttgaa

SEQ ID NO: 82017 - DNA, 1206 bp, Zea mays
  misc_feature: Ceres CLONE 1567705
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
tttgtgggttcnnnnnngnatagagttaggaaaataatattaaaaaaaaaaaaaattnnntttnnnnnnnnnnnaaaagctggagctccccgcggtggcggccgctctagaactagtggatcccccgggctgcaggaattcgtcccacaccttataaaaaaaacatcctaatccaaaaataaatataatgcaaagttgcctgatcaaatcttgccagtttaagtgagcagtacttactagactctacacgaatacccttcaaaaaagaataacagtataagtacgtagtaacttagagaaagatgtaaatcatagaacttcaacctcaagagcccctgcatgcggcattgcccaaaaaacaacaaatatgattaccaattcacaccatcaataacatgtgagcgattactacgtaaaagactaaaaggtaataaaacaaggaaaaaaaagataacaacaaaatattaattataagggtatttttgcccccccgtttaaacattcaacaagtatgatatgtaagataaaaaaatgggcaaacactaattaaacattataaaaaaattaaacaaaacaatctaaagagtaaaaaaaaaggaaacaaaagaaagaaaaaaaaataaaaaaaacataggaccaaaattagtaatataatggtaatataaattattgatttcatttttaaacccctaacatataaaataaaatttataactataaaataatgatatctcgaatgggaatgaagtaaaaaatagcttatgttaacaaccaaaaataaatttcatttaaactatataacatgataaatatttataaaatcagtgtcattacgatttactatttacgatatatagtagagaaaataaatctatgagtagaataacatacggtaagcaatagtatgtttttcgagagagaaatatatgaaaaataaatattaataaagatagaactattcatgacaaagcgggcttaagtaaataatattgacacaccataagattaaataattggtggatgtcgtaagtttgtacctaatactagataaaatatcttttaataattgtttatctaaccattctacttagattgttatgtatacataaataatcagcaagtaagcatttggagaaataaagtttatacagctgactcatatgaaatatacatacgaaagcatagtagtaatagtagatttttaaa

SEQ ID NO: 82018 - DNA, 833 bp, Zea mays
  misc_feature: Ceres CLONE 1567706
  misc_feature: Encodes the peptide sequence at SEQ ID NO. 82019
ccccgcggtggcggccgctctagaactagtggatcccccgggctgcaggaattcgtctcacccctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcgatcgccacagcgatccacacgctcgcacacgtgacctgcgacttcccaaggctgatcagctgcccgacggacaagttcatggccaccttggggtccaacttccactacaagcagccgacttacctgggcttgctggagagcacacccggggttaccggaatcctcatgatcatcataatgtccttctccttcacgctggcaacacattccttcaggcggagtgtggtgaagctgccatcgccgctacaccaccttgccggtttcaatgccttctggtacgctcaccacctgctggtccttgcgtatgtcctgctggtggtgcactcctacttcatattcctcaccagggagtggtacaagaagacgacatggatgtacctgattgtccctgtcctcttctatgcctgtgaaaagtcatcaggaaatttcgtgagaacac

SEQ ID NO: 82019 - protein, 206 aa, Zea mays
  misc_feature: Ceres CLONE 1567706
  misc_feature (9)..(166): Pfam Name: Ferric_reduct Pfam Description: Ferric reductase like transmembrane component
  misc_feature: SWISSPROT Homolog: EC 1.6.3.1 NAD(P)H oxidase
MGYCVCVAKGAAEILKLNMALILLPVCRNTLTTLRSTALSHVIPFDDNINFHKVIALSIAIATAIHTLAHVTCDFPRLISCPTDKFMATLGSNFHYKQPTYLGLLESTPGVTGILMIIIMSFSFTLATHSFRRSVVKLPSPLHHLAGFNAFWYAHHLLVLAYVLLVVHSYFIFLTREWYKKTTWMYLIVPVLFYACEKSSGNFVRT

SEQ ID NO: 82020 - DNA, 745 bp, Zea mays
  misc_feature: Ceres CLONE 1567707
  misc_feature: Encodes the peptide sequence at SEQ ID NO. 82021
  misc_feature (530)..(530): n is a, c, t, g, unknown, or other
ggagctccccgcggtggcggccgctctagaactagtggatcccccgggctgcaggaattcgtctcacccctagaaaaaaagaacagcctcaggttactcgcagaaaagatttattagctcgctgcgggggtcgaaccgaggctcctagctgatcgcgcgcgcacagggcgagcggacaagaaagcttgctttgtgctcaccggcggcacggaccccctgcgatggaagccgtcggcgtcactcctgcccccgtggcggcgccggagaagaagaagctgcttgacctcaaggaccccttccccgccgccgcgaacggcggcgccaaggcgtccccggcggcgaagtgggcgatgaagaagaagctggtgggcggcgacgccggctacgtgctcgaggacgtgccgcacctcacggattacatgccccagctcccgacatacccgaatcctctccaagacaacccggcgtattcagtcgtcaagcagtatttcgtcaacccaggacgaccaccgttcacgcaagagaattgnttgttcaaaaaaaaccaggtggccaggggggcaccccccctttccggggggttgcccgggggccccccggaaaaacgggggggtttttccttcctccccccccccccaaaaggggggggggaaaaaccccccccccccttctttgtcccccccccgggggggggagggggcggatttttcttcttccgggggggggggattttaaaaaacaaaac

SEQ ID NO: 82021 - protein, 174 aa, Zea mays
  misc_feature: Ceres CLONE 1567707
  misc_feature (103)..(103): Xaa is any aa, unknown, or other
MEAVGVTPAPVAAPEKKKLLDLKDPFPAAANGGAKASPAAKWAMKKKLVGGDAGYVLEDVPHLTDYMPQLPTYPNPLQDNPAYSVVKQYFVNPGRPPFTQENXLFKKNQVARGAPPLSGGLPGGPPEKRGGFSFLPPPPKGGGEKPPPPFFVPPPGGGGGGFFFFRGGGILKNK

SEQ ID NO: 82022 - DNA, 824 bp, Zea mays
  misc_feature: Ceres CLONE 1567709
  misc_feature: Encodes the peptide sequence at SEQ ID NO. 82023
agctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctgttcaccgtgcacctgctcaacgccagcaaggtgcggtcgcagcggccgcgcggaagaaaggac

SEQ ID NO: 82023 - protein, 192 aa, Zea mays
  misc_feature: Ceres CLONE 1567709
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFRKARKLFTVHLLNASKVRSQRPRGRKD

SEQ ID NO: 82024 - DNA, 833 bp, Zea mays
  misc_feature: Ceres CLONE 1567710
ctctcctcggtggcggccgctctagaactagtggatcccccgggctgcaggaattcgtctcacccctagaaaaaattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcaaaaaatcccccagccgacagccgccgagcaaaccggctcctccggtcggtcatccactcatcctcatcccctggcccctgcccatccgatccgatcggtcatcccctacgcctacctgatcggatcccctgctcttccgccgagcacaccaggcagcaggctgcagccgtcgagcaccagcaggagcactgccaggaggacgacgcccgcatcctgcctcttctctgctgctggaggctctgctgccaggagcacggccagtaggacgacgcccctgctgctgccgggtgagcggtgatctgctgcgcccccatccttgcctcttctcctccctctcgggctcggctcaatctgctgcctggtaatgttcctttatgaggtac

SEQ ID NO: 82025 - DNA, 815 bp, Zea mays
  misc_feature: Ceres CLONE 1567716
  misc_feature: Encodes the peptide sequence at SEQ ID NO. 82026
  misc_feature (569)..(569): n is a, c, t, g, unknown, or other
ctccccgcggtggcggccgctctagaactagtggatcccccgggctgcaggaattcgtctcacccctagaaaaaatctcacccccggacatttctggtggcaccctcctccggacctcccagccgctaagccctctggaaccttcgagagctcgatcggatcggagcccctgccatggccgactaggcgaaggcgaagggtaatgccgcgttctcagccggccgcttcgaggatgcggcgcggcacttcacggacgccatctcgctcgccccgggcaaccacgtcctctactccaaccggtcggctgcgctcgcctcactccaccgctactccgacgctctcgccgacgcgcagaagaccgtcgagctcaagcctgactgggccaagggctactcccacctcggtgcggcgcacctgcggactcagcgacgccgcctgcaccgtcaccgcatacgagaacggccttgcgctctacccctggaacgaaagtctcaaggcggggctccaggacgcctagaaaggcgccaccgccgcgcctcgtcgcgagtcgtcctgccccgactccagcngccagatgttccacggcacgaactgtgtgagcaagagctcgtccgacgcaccatcagggcgtgcattaacgagcccgactttatgcagatgctgctcgtagtgcagaagaaccaagcagcttcgcatgtacctctgcgatccccgcatgatgcaggtgcgctgcccctgctcaatggtaagatcctgagacccggggccgtcagagcatcccagtctaccccacagccgcaccccaacagcgcaga

SEQ ID NO: 82026 - protein, 54 aa, Zea mays
  misc_feature: Ceres CLONE 1567716
MQMLLVVQKNQAASHVPLRSPHDAGALPLLNGKILRPGAVRASQSTPQPHPNSA

SEQ ID NO: 82027 - DNA, 866 bp, Zea mays
  misc_feature: Ceres CLONE 1567717
  misc_feature: Encodes the peptide sequence at SEQ ID NO. 82028
tccccgcggtggcggccgctctagaactagtggatcccccgggctgcaggaattcgtctcacccctagaaaaaagggcaatattccccccggaccaaactagatcagcgaaacccactccgctctcccgagatcggacacatggcggcggcagcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcgggcagccctcgggcgtcgctgggtgccttcggccgagcccgcggcggacaaggccgcttaaaggggccgggggtcgtggcttctcctgggtggacagggccccccggcggggcaaaatggtcctcctggcgggaatcctttgattaccctcttcggaagcggggccaaaaagggagccccccctgcctttggaattccaagggaaagcccccctgcccgggagttccctaaaagggggcaaaaattgggggaacccccccttttccaaaaactttttggtgttcccccccccaaaaaaacccagggggggaatttcccaaaaatttaaaccccccccccggggaaaagggaaacaaatttttaatacacaccccgggagagagtttttcaaaccaagggttaaaaaacccctcccacacaaactgttaaattttgggagagggaccttttgttgtccccaaattggggggggggggggtgtgtttcaacaccaccatgggccg

SEQ ID NO: 82028 - protein, 121 aa, Zea mays
  misc_feature: Ceres CLONE 1567717
  misc_feature: SWISSPROT Homolog: EC 2.7.1.90 Diphosphate--fructose-6-phosphate 1-phosphotransferase
MAAAAVTSNGGAVAANGPAPGRLASVYSEVQTSRLLHTLPLPSVLRSNFSVVDGPASSAAGNPDEIAKLFPNLFGQPSGVAGCLRPSPRRTRPLKGAGGRGFSWVDRAPRRGKMVLLAGIL

SEQ ID NO: 82029 - DNA, 759 bp, Zea mays
  misc_feature: Ceres CLONE 1567719
  misc_feature: Encodes the peptide sequence at SEQ ID NO. 82030
ctccccgcggtggcggccgctctagaactagtggatcccccgggctgcaggaattcgtctcacccctagaaaaaagaccccctcctcgctcgcactccgttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttggaccttattgtgattcaaatcgagtccctgaacagaagtatggatgtaatgtccctttacttctgatgaactccttcaatacccctgatgacacccaggagatccgttgaaaaagtttcccaactcccacattgaaaatcatactttcaatccagaggcagtatccctcccctttgtttaccgagggaattctttggccctttccagccaaaggaaatctgggaaaaggatgggttggttatccttccaggcccatgggg

SEQ ID NO: 82030 - protein, 151 aa, Zea mays
  misc_feature: Ceres CLONE 1567719
  misc_feature: SWISSPROT Homolog: EC 2.7.7.9 UTP--glucose-1-phosphate uridylyltransferase
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLGPYCDSNRVPEQKYGCNVPLLLMNSFNTPDDTQEIR

SEQ ID NO: 82031 - DNA, 828 bp, Zea mays
  misc_feature: Ceres CLONE 1567721
  misc_feature: Translation starting site: 123
  misc_feature (627)..(627): n is a, c, t, g, unknown, or other
ctggagctccccgcggtggcggccgctctagaactagtggatcccccgggctgcaggaattcgtctcacccctagaaaaaacctcctcagcaggccgcagctactccacggtgacggccgccatgagagccctcctctccctctcccgtctcgcccgacggcttccagcttctctcagccctgtaagggcgccgacaacattactcctccggcacatccatgcggatgcccctccgccgccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttccccaaccatgaccgtgacgtgctcgacgagatgctccgcctcgtcgcggacgccgtgctgtgccgcctcaccgggaccgaccgggggggcgatgctattgagctcaatgacgacctctgggcggccgtatgggaggtcagcgcctccgtgcgcgaggctatgcgccgggatcagggtcgcgccgaccttcgcaataccttcactgcgacgaggtgaggagatgacgcgnttcgctgtcgatgtcggcatcccgcggttcatgcctcgggactcccgctccagtgggccggcgaaaacccgaccaaggcgagtcctttcggggcttgatgaaaagacccccaatgccaaggccgggccccaccggggcccatggccaaggtgaattgtttgcccaaaaagaaaggaaagggaaatttcccatgtacgcggg

SEQ ID NO: 82032 - DNA, 796 bp, Zea mays
  misc_feature: Ceres CLONE 1567722
  misc_feature: Translation starting site: 287
  misc_feature: SWISSPROT Homolog: EC 3.2.1.4 Cellulase
  misc_feature (624)..(624): n is a, c, t, g, unknown, or other
  misc_feature (662)..(662): n is a, c, t, g, unknown, or other
  misc_feature (671)..(671): n is a, c, t, g, unknown, or other
ctccccgcggtggcggccgctctagaactagtggatcccccgggctgcaggaattcgtctcacccctagaaaaagcgccacacccacaccgcactccgcaccaaccaaccccggccggccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaagcggggaagctggagaacaccagatcccgtggcgtggggactcggcgttgaccgacgggaaggaagcgggggctgggatctttccaggggatggtatgatgctggggatcacatgaagttcaccntcccgattgcattcacggcgacggtgctctcctggtcnggtgctggnagtacgggggatcagatgagcgcgggcaaagcaactgggaccctgccctcgatgcactgaaaggggattacagatttcccttattggctgcacatcccctcggaacatgggctgtatattcaggg

SEQ ID NO: 82033 - DNA, 842 bp, Zea mays
  misc_feature: Ceres CLONE 1567725
  misc_feature: Encodes the peptide sequence at SEQ ID NO. 82034
  misc_feature (396)..(396): n is a, c, t, g, unknown, or other
  misc_feature (420)..(420): n is a, c, t, g, unknown, or other
  misc_feature (421)..(421): n is a, c, t, g, unknown, or other
ggagctccccgcggtggcggccgctctagaactagtggatcccccgggctgcaggaattcgtctcacccctagaaaaaatccagagaggctagaacaaacctgaatttctttcatccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaagctcgcttacncggctccggcgattcagagaaacnnttgaggcactctggcatcagaagcacttctaaatgaagaggcggtagtagcagcggcagccgcagaagcagttgctcttgccagagcagctgcccgagctgccccaagaaagtggtcagatagtacaaagaacaacccatcagccgggtaatagaccaaaaaaagtgtgtgggacgactacctggcaaatggaaatccttcccacagaagatgcgattcgagcaagccctgacatggatggctataaatccctttgaatggagtatcttggactccttatggggatcatgggatgccgaaaaaagaatttaaaatgccttatgcccccgtttaccggaaaaacataacctggggaaaaaactgggctccgccaaatcgggaaagaaaaaagcttggggaaaaaccttggaggccgccattt

SEQ ID NO: 82034 - protein, 68 aa, Zea mays
  misc_feature: Ceres CLONE 1567725
  misc_feature (61)..(61): Xaa is any aa, unknown, or other
MACLAPQFKWAPSAAAHMPSSSSSSSYSRCSALRVHCAVTSAAVVEDRTNGSAAQLKLAYXAPAIQRN

SEQ ID NO: 82035 - DNA, 831 bp, Zea mays
  misc_feature: Ceres CLONE 1567730
  misc_feature: Encodes the peptide sequence at SEQ ID NO. 82036
  misc_feature (817)..(817): n is a, c, t, g, unknown, or other
ctccccgcggtggcggccgctctagaactagtggatcccccgggctgcaggaattcgtctcacccctagaaaaaagcacgcccacacagcagcatcaacctcgggtgctctgcggccactggactgccctgccagtgcccgtgcccgcgcgcgctagcctagctgctcctgcctggttcgccgtagcccgtagcacaacaacaacaacaaaaaaaaaaaatctccgcgccgcggggggaggtggtctgttcaccttggggagcagcggcgggccggcggccgagaaatgcccggtggcgccttcctcctcaacggcagcggcggcggcatggcggactacggcggcggcctcaccgtacccgtcgtcgtgacctgcctcatggcggcctccggcggcctcatcttcggctacgacattggcatctcaggaggtgtgtcggagatggaggatttcctgaacaagtttttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcgccaggccgtcatgctgatcggcggcggcctgttcttggccggcgccctcgtcaacgccgccgcggccaacatcgccatgctcatcgtcgggaggatgctgctcggcctggggctcggcttcccggccagcccacgccggtgtacctcgccgaagtggcgcccccgcgctggcgcggcggcttcatctcggccttccccntctcatcagcgtcc

SEQ ID NO: 82036 - protein, 181 aa, Zea mays
  misc_feature: Ceres CLONE 1567730
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAANIAMLIVGRMLLGLGLGFPASPRRCTSPKWRPRAGAAASSRPSPSHQR

SEQ ID NO: 82037 - DNA, 830 bp, Zea mays
  misc_feature: Ceres CLONE 1567731
  misc_feature: Encodes the peptide sequence at SEQ ID NO. 82038
ctccccgcggtggcggccgctctagaactagtggatcccccgggctgcaggaattcgtctcacccctagaaaaacactcttcctcgacgccaccacaacacccccgggacacacacagtcacacacacatacaaaaaaaaaaatcccccctcgcctcggattcgctcgcgcccccgcccgccgacgcaacagcgaggtcgttccgttccaggcttcggacggaggcggggcgacgtaaggaggtgcgcgggaggatccgttcgcgcccggaggaccgggatccggcgcccgtcgtcgtcgacgcccatgtcgggccacctcgatcgcttcgcgcggccatgttttgaagggtgctcaagtcacgatgaacgtagagaccataagtcagactttgaagtctctgaagatgaaaagaagacaagaataagctctttgaagaaaaaagcaatagatgcatcaacaaagattaggcactcattaaaaaagactagaaggaagagtggtagtagggtcctttctgtgtctattgaggatgtgcgcgatctagaggagctgcaagctgttgaagcatttagacaagcattactcttggatgagctgttgcctgcaaggcatgacgactatcatatgatgctgagatttctgaaggcaaggaaatttgatatcgataaagccaagcaaatgtggattgatatgcttcagtggcggaaggagtatggcactgatacaattgtggaggacttcgaatacactgagttgagcaccgttttgcaatattatcctcatgtttatcatggagttgacaaagaggggagaccctgttacattga

SEQ ID NO: 82038 - protein, 174 aa, Zea mays
  misc_feature: Ceres CLONE 1567731
  misc_feature (73)..(142): Pfam Name: CRAL_TRIO_N Pfam Description: CRAL/TRIO, N-terminus
MSGHLDRFARPCFEGCSSHDERRDHKSDFEVSEDEKKTRISSLKKKAIDASTKIRHSLKKTRRKSGSRVLSVSIEDVRDLEELQAVEAFRQALLLDELLPARHDDYHMMLRFLKARKFDIDKAKQMWIDMLQWRKEYGTDTIVEDFEYTELSTVLQYYPHVYHGVDKEGRPCYI

SEQ ID NO: 82039 - DNA, 832 bp, Zea mays
  misc_feature: Ceres CLONE 1567736
  misc_feature: Encodes the peptide sequence at SEQ ID NO. 82040
  misc_feature (790)..(790): n is a, c, t, g, unknown, or other
  misc_feature (792)..(792): n is a, c, t, g, unknown, or other
  misc_feature (832)..(832): n is a, c, t, g, unknown, or other
agctccccgcggtggcggccgctctagaactagtggatcccccgggctgcaggaattcgtctcacccctagaaaaatctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaagccgccgccgccgacgacgacgacaagagcgacggccgccggagactcctctggtacccgccgtaccctggatacgatgagcccggccaccaccgccgtttcctcgccggcgcggctccggacgacaactactgcagtgaccaaggcaaggtgtccctcatctcctcggccggcgtccaccagctgcacatcttcatcttcgtgctcgcggtgttccatatcgtctacagcgtcgccaccatggcgctggggcgtctcaaaatgaggaaatggaaagaatggggatcngnagacaactccctggaataccagtacgcaaacgacccttcn

SEQ ID NO: 82040 - protein, 209 aa, Zea mays
  misc_feature: Ceres CLONE 1567736
  misc_feature (5)..(209): Pfam Name: Mlo Pfam Description: Mlo family
  misc_feature (196)..(196): Xaa is any aa, unknown, or other
MAGGGGGRDLPSTPTWAVALVCAVIVLVSVAMEHGLHKLGHWFHTRQKKAMREALEKIKAELMLMGFISLLLAVGQTPISKICIPAKAGSIMLPCKPPKAAAADDDDKSDGRRRLLWYPPYPGYDEPGHHRRFLAGAAPDDNYCSDQGKVSLISSAGVHQLHIFIFVLAVFHIVYSVATMALGRLKMRKWKEWGSXDNSLEYQYANDPS

SEQ ID NO: 82041 - DNA, 802 bp, Zea mays
  misc_feature: Ceres CLONE 1567739
  misc_feature: Encodes the peptide sequence at SEQ ID NO. 82042
  misc_feature (802)..(802): n is a, c, t, g, unknown, or other
ccccgcggtggcggccgctctagaactagtggatcccccgggctgcaggaattcgtctcacccctagaaaaactagaaaaaatcacacacacacacagtggcgagctcgtcaattgcaggcaagacagcaagcgcatttacacagcacgctgaaagccgggacgcagagcagcttttgcgccttgtcccctcctgctcgtcgcttccctcactctcacagccacgccacgccacgagagaagaatgccgccgacgctgggcctgctcctcgcggcggcggcggcggtcctgctgctgctgctgccgccgccaccatcggcgggggcgcaggagacgtgctggtcggggccggcgccgcggcgcggggcgtggatgtccgtggccagcttcggggcgcgcggggacgggcagacgctcaacacgggcgcgttcgcgcgcgccgtggcgcgcatcgcgcgtcccgggcgccgcccggggcggcacgctgctgtacgtgccgcccggggtgtggctcacgggccccttcaacctcacctcccacatgacgctcttcctcgcccgcggcgccatcgtccgcgccacccaggacacgtcgagctggccgctcatcgacccgctgccgtcgtacgggagagggcgcgagctgcctggtgggagatacatgagcttgatccacggccacggtctgcaggacgtcttcatcacaggtgagaacggcaccatcgacgggcaaggcggcgtgtggtgggacatgtgggagaagcgcacgctgcccttcacgaaggcgcacctgctggagctn

SEQ ID NO: 82042 - protein, 87 aa, Zea mays
  misc_feature: Ceres CLONE 1567739
MTLFLARGAIVRATQDTSSWPLIDPLPSYGRGRELPGGRYMSLIHGHGLQDVFITGENGTIDGQGGVWWDMWEKRTLPFTKAHLLEL

SEQ ID NO: 82043 - DNA, 670 bp, Zea mays
  misc_feature: Ceres CLONE 1567740
  misc_feature: Encodes the peptide sequence at SEQ ID NO. 82044
  misc_feature (281)..(281): n is a, c, t, g, unknown, or other
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggccttgcttcttgggcagctctgctaccagcgctagcatctggaaatgtgggtgcagcnagctccgatactgagagcagattacataaaaattgaacttcagcacccgcttcggcgtaccccccgacaaagtacaaagaagcttcaatcgccttcctggttccgtgcctgggctttggttgaaagcaaaagccggggggggcaaaccggcaagcgggggatcccccccttggccttgggtgcgaaccaaaaaaaaaaaaaccccggtttgggggggtttcaaaaaaatccgtttttccctaaaaaacaatacccacccccgggggggggaaaaaaaaaaggggaagggggggcgccccccccccccctaaaaaacactttttaaaaaaaaaaaagggggggggttttttttccccccaaagaaaaccccccctctttttttttttgta

SEQ ID NO: 82044 - protein, 41 aa, Zea mays
  misc_feature: Ceres CLONE 1567740
  misc_feature (38)..(38): Xaa is any aa, unknown, or other
MKGGTQAVSLMVHLAVPWPCFLGSSATSASIWKCGCSXLRY

SEQ ID NO: 82045 - DNA, 845 bp, Zea mays
  misc_feature: Ceres CLONE 1567741
  misc_feature: Encodes the peptide sequence at SEQ ID NO. 82046
  misc_feature (717)..(717): n is a, c, t, g, unknown, or other
ctccccgcggtggcggccgctctagaactagtggatcccccgggctgcaggaattcgtctcacccctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcgatcgccacagcgatccacacgctcgcacacgtgacctgcgacttcccaaggctgatcagctgcccgacggacaagttcatggccaccttggggtccaacttccactacaagcagccgacttacctgggcttgctggagagcacacccggggttaccggaatcctcatgatcatcataatgtccttctccttcacgctggcaacacattccttcaagcggagttgtggtgaagctgccatcgccgctacaccacccttgccggtttcaatggcttctggtacgctcaccacctgctgggtctttgcgtatgtccctgctggntggtgcactccctacctcatatttcttcacccaggggagtggtacaagaagacgaactgggatgtaccttgatttgtccctgtccttcttctatgcctgttgtaggagtcatccaggaaatttcggga

SEQ ID NO: 82046 - protein, 190 aa, Zea mays
  misc_feature: Ceres CLONE 1567741
  misc_feature (9)..(143): Pfam Name: Ferric_reduct Pfam Description: Ferric reductase like transmembrane component
  misc_feature: SWISSPROT Homolog: EC 1.6.3.1 NAD(P)H oxidase
MGYCVCVAKGAAEILKLNMALILLPVCRNTLTTLRSTALSHVIPFDDNINFHKVIALSIAIATAIHTLAHVTCDFPRLISCPTDKFMATLGSNFHYKQPTYLGLLESTPGVTGILMIIIMSFSFTLATHSFKRSCGEAAIAATPPLPVSMASGTLTTCWVFAYVPAGWCTPYLIFLHPGEWYKKTNWDVP

SEQ ID NO: 82047 - DNA, 829 bp, Zea mays
  misc_feature: Ceres CLONE 1567742
  misc_feature: Encodes the peptide sequence at SEQ ID NO. 82048
  misc_feature (810)..(810): n is a, c, t, g, unknown, or other
  misc_feature (816)..(816): n is a, c, t, g, unknown, or other
  misc_feature (817)..(817): n is a, c, t, g, unknown, or other
ctccccgcggtggcggccgctctagaactagtggatcccccgggctgcaggaattcgtctcacccctagaaaaaatcggtcagcacgatgtcattgacccgatgagaggtcgaagaagggcggatgcttcaagctttctctgctcggttaggttgctgtcgctcgctctgagtctgaggcctcgacgcgctgctagctgagagccgaaagaaggaatcctcggccggcagcaggagaggagagccaccgtttgatcagcgaccgggcaagagcaggccgcggccggccaccccgcccgtctctgtccgaccccgcaccagcgactcgccgagcgcaggcacaagaggggggctccatccatgaggcagccatgctggtgctcatcaacaggtatttcaggagcaggaacagcagcccggccggaggaggcggcgaagagatggcgccggcggcggtctccagcgaccacctctgtttgccgggctgcgtgcccgtgcgcgccaagcgggcctcctcctccgccgccgccgcggccacggccaccacggcgcgggcgtcgcggcacaacttcgtcagggccgcggcgtcgggcctgctggcgggggcgcacttcaccaaccacgagtcgctgccgccgcttccccacgcgtacgccgagttcgtcgcggcgttcccgcagtacgcccacggcgcgctggcgcgggcggacgcgatccggggcgaggagtaccagcacctggaccgccacgtgtgcctggactacaccggcatcaacctcttctcgcacgcgcagatgagcgcctccctggncgtcannctcctcgggccg

SEQ ID NO: 82048 - protein, 153 aa, Zea mays
  misc_feature: Ceres CLONE 1567742
  misc_feature (147)..(147): Xaa is any aa, unknown, or other
  misc_feature (149)..(149): Xaa is any aa, unknown, or other
MLVLINRYFRSRNSSPAGGGGEEMAPAAVSSDHLCLPGCVPVRAKRASSSAAAAATATTARASRHNFVRAAASGLLAGAHFTNHESLPPLPHAYAEFVAAFPQYAHGALARADAIRGEEYQHLDRHVCLDYTGINLFSHAQMSASLXVXLLGP

SEQ ID NO: 82049 - DNA, 1901 bp, Zea mays
  misc_feature: Ceres CLONE 1567747
  misc_feature: Encodes the peptide sequence at SEQ ID NO. 82050
ctaccaaaccgcggtctcggctcgctcgctcgcttgctgggcttgcagtcgcagcctcgcaggacgagataaatagtccacccgcgccgagcgccaccgtctcatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatgggcagcgcggtggagacgctgtgcgggcaggcgtacggcgcgcacaagcaccgcatgctgggggtgtacctgcagcgctcgacggtgctgctcatggccaccgccgtgccgctgaccgtcgtctacgccttctcggagcgcatcctggtcctcctcggcgagtcggagcgcatctccagggccgccgccgtcttcgtctacgggctcatcccgcagatcttcgcgtacgcggccaacttccccatccagaagttcctgcaggcgcagagcatcgtggcgcccagcgcttacatctccgtggccacgctggcgctgcacctggggctcagctgggtcgccgtctacaggctgggcctgggcctgctggggggctcgctcgtgctcagcttcagctggtgggtcatcgtcgcggcccagttcgggtacatcgtcaccagcgcccggtgcagggacacctggacgggattcaccacgcaggccttctcgggcctcggcaccttcttcaagctctcggcagcgtccgccgtcatgctgtgcttggagacttggtacttccagatcatcgtgctcatcgccggcctgctcaagaacccggagctctccctcgactccctctccatatgcatgaacgtgaacgcatgggtgttcatgatctccgtcgggttcaacgccgcggcgagcgtgcgggtcgggaacgagctcggcgcaggcaacccgagggcggcggcgttctcggtgttcatggtgacgtcgctgtcgttcatcgcggcgacggtgtgtgccgtcgtcgtgctgtgcctccgcgaccagctgagctacttcttcactggcggcgaggccgtggcgcgcgccgtgtccgacctctgcccgctcctcgccgccacgctcgtcctcaacggcatacagccagtcctctccggcgtcgccgtgggctgcgggtggcaggcgtttgtggcgtacgtgaacgtgggttgctactacgtcgtcggcgtgccgctcggcgtcttcctcggcttctacctcgacctcggcgccaagggcgtttggagcggcatggtcatcgggggaaccttgacgcagacgctcatcctgctctgggtcaccgtcagaaccgactggaacaaggaggtggagaacgccaaggcgaggctggacaagtgggacgacaagaagcagcccctcctagtcgaagattgaaggaagaatctagtagatcacgcagtgtagcgcgtgctggtggattttttgtgtgtcgtgtgtgtgttttggagtggattgaatggaccatttggcatttgggttttagagagcatgcatgcactcctatcatgaatgctttggccagcaaaaaaaaaaaaaaaaa

SEQ ID NO: 82050 - protein, 513 aa, Zea mays
  misc_feature: Ceres CLONE 1567747
  misc_feature (288)..(451): Pfam Name: MatE Pfam Description: MatE
  misc_feature (67)..(227): Pfam Name: MatE Pfam Description: MatE
MDSTTTAPLLQPSAASSKEGPGPAPAQHGEGSRELEAILADASKPWAWRAWEGARLELPLLLRVALPAVAVYMINFVMSMSTQIFCGQLGNLELAASSLGNTGIQPLAYGLMLGMGSAVETLCGQAYGAHKHRMLGVYLQRSTVLLMATAVPLTVVYAFSERILVLLGESERISRAAAVFVYGLIPQIFAYAANFPIQKFLQAQSIVAPSAYISVATLALHLGLSWVAVYRLGLGLLGGSLVLSFSWWVIVAAQFGYIVTSARCRDTWTGFTTQAFSGLGTFFKLSAASAVMLCLETWYFQIIVLIAGLLKNPELSLDSLSICMNVNAWVFMISVGFNAAASVRVGNELGAGNPRAAAFSVFMVTSLSFIAATVCAVVVLCLRDQLSYFFTGGEAVARAVSDLCPLLAATLVLNGIQPVLSGVAVGCGWQAFVAYVNVGCYYVVGVPLGVFLGFYLDLGAKGVWSGMVIGGTLTQTLILLWVTVRTDWNKEVENAKARLDKWDDKKQPLLVED

SEQ ID NO: 82051 - DNA, 812 bp, Zea mays
  misc_feature: Ceres CLONE 1567749
  misc_feature: Encodes the peptide sequence at SEQ ID NO. 82052
  misc_feature (596)..(596): n is a, c, t, g, unknown, or other
ctggagctccccgcggtggcggccgctctagaactagtggatcccccgggctgcaggaattcgtctcacccctagaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaacgtgacggcgcagctggtcccggccatggccaacgtgcacgccgcgctggccaggctcggcctcgacggggccgtncaggtgtcgtcgcccatcgcgctcacggcgctcgcgtcgtcctacccgtcctcgggcggcgcgttccggggagacctcgcgcagggcgtcatgaagcccatgctcgacttcctgcgcagaccgggtcgtacctcaggtgaacgcgtacccgttcttcgcttactcggcaatgcgggagaatctccctcgactacgcctggtccgcccccaagccgg

SEQ ID NO: 82052 - protein, 226 aa, Zea mays
  misc_feature: Ceres CLONE 1567749
  misc_feature (29)..(225): Pfam Name: Glyco_hydro_17 Pfam Description: Glycosyl hydrolases family 17
  misc_feature: SWISSPROT Homolog: EC 3.2.1.73 Licheninase
MAPPRPLLAAVFLAAAVLLLLSPAEAGTVGVNYGRVANNLPNPAAVVQLLKQQGVAQVKLYDADPTVLRALANTGIKVVVALPNEQVAAAASRASYALLWVRRNVAAYHPATQIQGIAVGNEVFASAKNVTAQLVPAMANVHAALARLGLDGAVQVSSPIALTALASSYPSSGGAFRGDLAQGVMKPMLDFLRRPGRTSGERVPVLRLLGNAGESPSTTPGPPPSR

SEQ ID NO: 82053 - DNA, 940 bp, Zea mays
  misc_feature: Ceres CLONE 1567752
  misc_feature: Encodes the peptide sequence at SEQ ID NO. 82054
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (19)..(19): n is a, c, t, g, unknown, or other
  misc_feature (53)..(53): n is a, c, t, g, unknown, or other
  misc_feature (56)..(56): n is a, c, t, g, unknown, or other
  misc_feature (57)..(57): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
nnnaaaaaaggaaaaaaanaggcaacaagaaaaagggccctttggggggtttnggnnttggggggcttnnnncccatagctggactccccgcggtggcggccggtcaaaaagagaggatcccccgggccgtacaaaaagagggacccctagaaaaatcctgccgtcttgtaaaaaaatccccgccgccggagacgcgcaagctagggctagcaaccgttcttgctgacagagtacccacaggtcctgcaccagcggcggcatgggaaagaagattcgcagcaccgatggcacctcgacgccggccaggtccatgaatcaggccgtgtcgctccgcgaggagacctccgggaggacgcgcgtagacgatgcctccctgctgagggtcaagcatttgcagaggctagcggcgtgggcgggcccggaggccggggtgcgcccgatcggcgcgctgctggggcgccgcctcgccgcgagcgccgaggccgccggagtacccctcaacgccgccactttcctttgccagaggtgtgagacaatcttaaagccaggcttcaactgcactgtccgcataaggaacaagagaaataaagcaaaacgtcggaagaaatcaaactgttgtcagaacagtgtttcctatgcatgccatttctgtggagatcagaacctaatattgggtagtgggaaagggtgttggtccagaggcccggtactggcaagaagggcatgctacccatgaaactcatccaatataatttggggagagggaaaacggtaggcaaacccaagaagcacatgggattaagaaaaggaaggtgctgtgagagcttttctcctaagcaagggaaatttttggccaaagggggaaatcgcatggacccatgcctggttggtagggccagtgtgcgaattaaccgggtaaaaagtggaaagtaagcctag

SEQ ID NO: 82054 - protein, 158 aa, Zea mays
  misc_feature: Ceres CLONE 1567752
  misc_feature (40)..(133): Pfam Name: Rpr2 Pfam Description: RNAse P Rpr2/Rpp21/SNM1 subunit domain
MGKKIRSTDGTSTPARSMNQAVSLREETSGRTRVDDASLLRVKHLQRLAAWAGPEAGVRPIGALLGRRLAASAEAAGVPLNAATFLCQRCETILKPGFNCTVRIRNKRNKAKRRKKSNCCQNSVSYACHFCGDQNLILGSGKGCWSRGPVLARRACYP

SEQ ID NO: 82055 - DNA, 836 bp, Zea mays
  misc_feature: Ceres CLONE 1567753
  misc_feature: Encodes the peptide sequence at SEQ ID NO. 82056
ctccccgcggtggcggccgctctagaactagtggatcccccgggctgcaggaattcgtctcacccctagaaaaaacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtgccatcaccaacatctactgcacctgcagccaaccaagaacctaccactgctgctcctgccagttccccggcaacaggattggggtggtttgttgcaaagtctgggtactacaggcgctgctgctaacagtgaggggttgggttttggtttggatctgccccccctggattagaccaaatgcaacaacagctagctgaaaatccgaacttgatgagggaaatgatgaatatgccactcatgcagaatttgatgaacaatcctgaactcatacgcagtataataatgaacaatcctcaaatgcgcgagctcattgatcgcaatccggatcttgctcatggcctcaatgatccaagcattatgcgccagacttttgaagccagc

SEQ ID NO: 82056 - protein, 131 aa, Zea mays
  misc_feature: Ceres CLONE 1567753
  misc_feature (22)..(90): Pfam Name: ubiquitin Pfam Description: Ubiquitin family
MGGGDADAGGEPADAQATLHIRCTNASKFTVRADLGATVGAFKAIVADSCDVPAPQQRLIYKGRILKDEQTLASYGVETDHTIHMVRGAVPSPTSTAPAANQEPTTAAPASSPATGLGWFVAKSGYYRRCC

SEQ ID NO: 82057 - DNA, 782 bp, Zea mays
  misc_feature: Ceres CLONE 1567758
  misc_feature: Encodes the peptide sequence at SEQ ID NO. 82058
tccccgcggtggcggccgctctagaactagtggatcccccgggctgcaggaattcgtctcacccctagaaaaactaccaaaccgcggtctcggctcgctcgctcgcttgctgggcttgcagtcgcagcctcgcaggacgagataaatagtccacccgcgccgagcgccaccgtctcatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccggctcggcaacctcgagctcgccgcctcctcgctcggcaacaccggcatccagcccttggcctacggcctcatgctgggcatgggcagcgcggtggagacgctgtgcgggcaggcgtacggcgcgcacaagcaccgcatgctgggggtgtacctgcagcgctcgacggtgctgctcatggccaccgccgtgccgctgaccgtcgtctacgccttctcggagcgcatcctggtcctcctcggcgaggcggagcga

SEQ ID NO: 82058 - protein, 172 aa, Zea mays
  misc_feature: Ceres CLONE 1567758
MDSTTTAPLLQPSAASSKEGPGPAPAQHGEGSRELEAILADASKPWAWRAWEGARLELPLLLRVALPAVAVYMINFVMSMSTQIFCGRLGNLELAASSLGNTGIQPLAYGLMLGMGSAVETLCGQAYGAHKHRMLGVYLQRSTVLLMATAVPLTVVYAFSERILVLLGEAER

SEQ ID NO: 82059 - DNA, 806 bp, Zea mays
  misc_feature: Ceres CLONE 1567760
  misc_feature: Encodes the peptide sequence at SEQ ID NO. 82060
cccgcggtggcggccgctctagaactagtggatcccccgggctgcaggaattcgtctcacccctagaaaaagccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggtgaggaccgcgagcggggccggcaccgcagcgttcgggagcaccgggatcgggataaggatgacgggaaggagaaggagaggagccgcgatagccgcgggaaggacagagacagggaagggagagaacgtggagaaggagagggggggacacgcaccggcccagagagagggatgtggaacgggagcagaggagcctgagccgttcggagcggcgccgtatccgaggaagaagacatcggtgagggagctgcgagatggagcgcgagcgcatccaagggaaccccactatccgcaaactttacgtcaaggcgtgggaaaaaatgacgggggcaaaaacccgaaggttgatcccaaaaaggggacccaaaggaccttgtttttgccttcccagcttatctctttaaagggcaaaaccaaaaaaaatggtttttaaaaattcctctcccaaagggcctgggaaaagggtcccgggaagggtccccccctttaaccggggggaccccaaaaccccaagagagtttttctaaagagaaaatgggggggatt

SEQ ID NO: 82060 - protein, 114 aa, Zea mays
  misc_feature: Ceres CLONE 1567760
MEFDEYEYLEKAVEPAPPPANGSGSGEKDRGSRRREGDEGRISKRSRSGEDRERGRHRSVREHRDRDKDDGKEKERSRDSRGKDRDREGRERGEGEGGTRTGPERGMWNGSRGA

SEQ ID NO: 82061 - DNA, 846 bp, Zea mays
  misc_feature: Ceres CLONE 1567762
  misc_feature: Encodes the peptide sequence at SEQ ID NO. 82062
  misc_feature (764)..(764): n is a, c, t, g, unknown, or other
  misc_feature (812)..(812): n is a, c, t, g, unknown, or other
tccccgcggtggcggccgctctagaactagtggatcccccgggctgcaggaattcgtctcacccctagaaaaaatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccggcagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcggcgagaagtccccgtcatcctcgggggagtggtggggatgcgaacccggatcgacgtcatcgggggagggcgcagaggaccggcggccgggtcccaacgatgctcggacgcggttcaccnatcaaacgggcaaggcccggcagacctggtgacaaatgctcccaaccnaaggagactacgaggcaattcccgagtggaagga

SEQ ID NO: 82062 - protein, 227 aa, Zea mays
  misc_feature: Ceres CLONE 1567762
  misc_feature (35)..(151): Pfam Name: Cu-oxidase_3 Pfam Description: Multicopper oxidase
  misc_feature: SWISSPROT Homolog: EC 1.10.3.2 Laccase
MASSSSSRLLLLLLPCLALTLLGAADAEVHHHEFVIQETPVKRLCKTHNIITVNGQYPGPTLEVREGDTLVINVVNRAQYNATIHWHGIRQIRTGWADGPEFVTQCPIRPGGSYKYRFTIQGQEGTLWWHAHSSWLRATVYGALIIRPRENKTYPFAKPSARSPRHPRGSGGDANPDRRHRGRAQRTGGRVPTMLGRGSPIKRARPGRPGDKCSQPKETTRQFPSGR

SEQ ID NO: 82063 - DNA, 937 bp, Zea mays
  misc_feature: Ceres CLONE 1567763
  misc_feature: Translation starting site: 307
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggagctccccgcggtggcggccgctctagaacagtggatcccccgggctgcaggaattcgtctcacccctagaaaaaccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaatattttcccaagagtaatcccatgggtggttgtgtattccaaaaagagagatggtacactagaagaaattgggcgcagtgaagtaattttaaattcattgaacccatttttgacgaccaaaatcagtgtgcagtaccagttttgaggttcttcaagcaattggtgtttcaggtctttgacatccaccagcagttcccgtgatggcagtgaaaagatgcttaagctagaggaaccagagtttcttggaaaagctaccggtctttttggcaaaaggttatccaccaaacgggaaagaactgcctaaactctaaaaacttgggtggccccctgaaacataacctttggcacaaatcccaaaaaaaatttttgggggaagccaaaaccggttttccgggggttgaaaaaaaagaggtttccggggtttccaaaaagggccaatttttgtgggggg

SEQ ID NO: 82064 - DNA, 856 bp, Zea mays
  misc_feature: Ceres CLONE 1567765
  misc_feature: Encodes the peptide sequence at SEQ ID NO. 82065
  misc_feature (856)..(856): n is a, c, t, g, unknown, or other
ctccccgcggtggcggccgctctagaactagtggatcccccgggctgcaggaattcgtctcacccctagaaaaaagacccttcacattcccagttccctctgcgccccgtaaaccctagccgcgattcatggcccgcaagcgccgcgcgccttcgcctcctccgcctccgcaggaggagtcgtcctctgaggaatctggctccgaagagttggaggagcctcctcgcctccccgagctccgtagtcccccgcaggccgcggccaacaacgccgactcgtcggaggcggacacggactccgacaccgacgctcaagctttccagatgcgccaggtgccccgctccctcactaagcatacgcatccagttccccagccagaatccgatcccgaagaggaggagggcgagtcatcggagtcggagcatgagaaccctgtgcctgtggttcagaagaaggctgcggcggcggccgtgttgtccaaggcagagcaggaaaggaagagacccccctcggatcctgctcctaccgggaaggcaaaaaagatgaaggctgtggctacccctcttgccaagggcgaaaaagggcaagggccgatctagagaaagcccggcgcctgaagccactccagcaggaaatgcaaagaagggcaaactgagctagagaagccgacgtttgatgccattccagcaggaaaggcgaaaaagggcaaggcccaggaggcagctcctggaggccacgcccctccgggaagggggaaagaaagatggggaaccaaactagagaattcagccagcgcctagatcccctcacatttcaagacagcaagtcctggagaaacccttgtgcccccccaccn

SEQ ID NO: 82065 - protein, 156 aa, Zea mays
  misc_feature: Ceres CLONE 1567765
MARKRRAPSPPPPPQEESSSEESGSEELEEPPRLPELRSPPQAAANNADSSEADTDSDTDAQAFQMRQVPRSLTKHTHPVPQPESDPEEEEGESSESEHENPVPVVQKKAAAAAVLSKAEQERKRPPSDPAPTGKAKKMKAVATPLAKGEKGQGPI

SEQ ID NO: 82066 - DNA, 831 bp, Zea mays
  misc_feature: Ceres CLONE 1567767
  misc_feature: Encodes the peptide sequence at SEQ ID NO. 82067
  misc_feature (530)..(530): n is a, c, t, g, unknown, or other
  misc_feature (592)..(592): n is a, c, t, g, unknown, or other
  misc_feature (621)..(621): n is a, c, t, g, unknown, or other
  misc_feature (655)..(655): n is a, c, t, g, unknown, or other
ctccccgcggtggcggccgctctagaactagtggatcccccgggctgcaggaattcgtctcacccctagaaaaagcccttcccattcctctccactgcgctgccatcgtctcgcgccggccccccgtggggaactagaactgactccctcgatcccagcggcagcggcggaagcgaacggtgaccgcgacctcccctgaccctgaggctgcatatactcggatcgggtttcacatctccggttttggattggttggttgcccgcggcgatgggaggagagctgtggtggtatccataggggatcctcggttgcgtccttgtgcgatggcttcgacctccgttcctgagttaaccgcggacaagaaatgcgacaaagccatcgcggatacggcggcaccacttacttctcagggacactccgaagaaccgactgggaaagtcagcacactagtgcctgctttgccggttgtaattgcagcaggcgatggggctgcatccagtggggtgatagaaaacagaaatggcatggnacattctgctgatggttctttgaaagcggatgacagtgaaggtgctgagaagagctcgctgncggggagcgtcaaggatagctcggtgtcngctaaatgcagtgacagggcgagcaagcctgtcnaagccaatggggaccgccaaaacaacgggccacctgctgacatgatccaaatgggcaaaaatatctccttcgggcccaggggggaattgatctgagtgataaaacccctgccataccttttcccccatgtgcccaagccctccaagttaaaacgccccaaagggggaaacctttcg

SEQ ID NO: 82067 - protein, 141 aa, Zea mays
  misc_feature: Ceres CLONE 1567767
  misc_feature (69)..(69): Xaa is any aa, unknown, or other
  misc_feature (90)..(90): Xaa is any aa, unknown, or other
  misc_feature (111)..(111): Xaa is any aa, unknown, or other
MASTSVPELTADKKCDKAIADTAAPLTSQGHSEEPTGKVSTLVPALPVVIAAGDGAASSGVIENRNGMXHSADGSLKADDSEGAEKSSLXGSVKDSSVSAKCSDRASKPVXANGDRQNNGPPADMIQMGKNISFGPRGELI

SEQ ID NO: 82068 - DNA, 815 bp, Zea mays
  misc_feature: Ceres CLONE 1567769
  misc_feature: Encodes the peptide sequence at SEQ ID NO. 82069
ctccccgcggtggcggccgctctagaactagtggatcccccgggctgcaggaattcgtctcacccctagaaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgccgcgcgcaaggcgggcccggcgccgggcctggtggcctcggcgggcccatgaacttcggccgctccaagagcaagtt

SEQ ID NO: 82069 - protein, 222 aa, Zea mays
  misc_feature: Ceres CLONE 1567769
  misc_feature (103)..(222): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRRAQGGPGAGPGGLGGPMNFGRSKSK

SEQ ID NO: 82070 - DNA, 789 bp, Zea mays
  misc_feature: Ceres CLONE 1567770
  misc_feature: Encodes the peptide sequence at SEQ ID NO. 82071
  misc_feature (722)..(722): n is a, c, t, g, unknown, or other
ctccccgcggtggcggccgctctagaactagtggatcccccgggctgcaggaattcgtctcacccctagaaaaacccctctcgtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatccccttggatgctgcgagagcattggaagtgctgaactttgctgctcttaacacaagcctatccgggtgatgtattcaaaccgtgatccatagcagccgcaggagtgggatctgctacattttcataaaaaatcttgacaagacaatagacaataaaaacccttcatgagacctttttcttcatttgggtacattnctctcatgttaaggtagcccgtgtatgaagcaagccaatccaaagggctttgggtttttgtttcaga

SEQ ID NO: 82071 - protein, 100 aa, Zea mays
  misc_feature: Ceres CLONE 1567770
  misc_feature (36)..(99): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLGCCESIGSAELCCS

SEQ ID NO: 82072 - DNA, 834 bp, Zea mays
  misc_feature: Ceres CLONE 1567771
  misc_feature: Encodes the peptide sequence at SEQ ID NO. 82073
ctccccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggttgacagggactacctgtcctacgacgagccaaagacggtgttccctgggcgaggcgtgcgacgacctccggcggcgagttctgcgaggcgccgtaccaggacggcgtctccagggagctggcgcacgcctgaagaccctgatccatccatgtctgtccaccacctatgtacgtatgtgtagcagatggtttacatctaacgtgttagaccaactccagcagcactccgcattcggctccggatccctatttttgcggagcctagctcactattcatcagtccagcaggctccgcatcccggctccgtaaaacgcacggcctgtacctgcactccccattttcacgctttctctctcctctcgaaagctctctgcgttcacccgcggctgctcaca

SEQ ID NO: 82073 - protein, 155 aa, Zea mays
  misc_feature: Ceres CLONE 1567771
  misc_feature (1)..(112): Pfam Name: Lir1 Pfam Description: Light regulated protein Lir1
MQAAATAAGFSAVLPAKGRPAARSRVVARVPATRRSVRAAAVVATEAAQIDYSSSVSVFPMEACDLLGGDACNGPMFPEAKPASAAAAASRSVVGVDRDYLSYDEPKTVFPGRGVRRPPAASSARRRTRTASPGSWRTPEDPDPSMSVHHLCTYV

SEQ ID NO: 82074 - DNA, 827 bp, Zea mays
  misc_feature: Ceres CLONE 1567775
  misc_feature: Translation starting site: 229
aaagctggagctccccgcggtggcggccgctctagaactagtggatcccccgggctgcaggaattcgtctcacccctagaaaaaaaaaaaaaaagccctcacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggagacgcagcaggaccagatccgcctgctcaagcgcttcaacgttggcgaggactgccccgtcttcgacggcctctacagcttctgccagacctatgcgggtgcctccgtcggcggggccgtcaagctcaaccacggccacgacatcgcaatcaactgggtcggggggcctgcaccacgccaagaagtgcgaggcgtcgggcttctgctacgtcaacgacatcgtgctcgccatactcgagctgctcaagcatcacgaagagagttctgtatgtcgatatcgatatccacattggcgattgggaatgggaagat

SEQ ID NO: 82075 - DNA, 850 bp, Zea mays
  misc_feature: Ceres CLONE 1567783
  misc_feature: Encodes the peptide sequence at SEQ ID NO. 82076
  misc_feature (764)..(764): n is a, c, t, g, unknown, or other
  misc_feature (850)..(850): n is a, c, t, g, unknown, or other
tccccgcggtggcggccgctctagaactagtggatcccccgggctgcaggaattcgtctcacccctagaaaaagtcggaatatcatacgaaaaccctcgcggcgaggagcgctctccgtcccacacacgcgcgccgcagcctccgcagtccgcacctgcctccacgacctgtcgtgctcgtgcgctactctcctcgagcgcggcgcggagcacggggacatcaaatggcggcagcggcggagatcggtggtttcgcggcggcgagagtggcggtggcaacgctcaggccggctgcacacccagccccggcggcggcggcggcaccgcagcctaggagggcggtggcggcgcagtcgctgcagacgaccgccaccgaggcgctgacggcggatctcgccggcacgaccaacggcgctgtgcatgctcggatgaatagtaaggctacaagtgaaatcacttcacaggcagttactgcaaattctaggagaaagacaaagatagtctgcaccataggtccctcaaccaacactcgtgagatgatttggaagcttgcagagactggaatgaatgtagcgcgccttaatatgtcccatggtgaccaccagtcgcaccaaaaggttattgatttggtcaaggagtacaatgcacggaacactgatgcgcatgttattgccattatgctggacacacagggtcctggagttagaaagtgggatgtttccaagagacaatcatgctgcagggaaggtcaagaagtcaactgncacgattaaaagaaggggtgagcactgaagacactgttcagcggtgaactatgatgacttccataaatgatgttgaagcctgcgan

SEQ ID NO: 82076 - protein, 182 aa, Zea mays
  misc_feature: Ceres CLONE 1567783
  misc_feature: SWISSPROT Homolog: EC 2.7.1.40 Pyruvate kinase
  misc_feature (180)..(180): Xaa is any aa, unknown, or other
MAAAAEIGGFAAARVAVATLRPAAHPAPAAAAAPQPRRAVAAQSLQTTATEALTADLAGTTNGAVHARMNSKATSEITSQAVTANSRRKTKIVCTIGPSTNTREMIWKLAETGMNVARLNMSHGDHQSHQKVIDLVKEYNARNTDAHVIAIMLDTQGPGVRKWDVSKRQSCCREGQEVNXHD

SEQ ID NO: 82077 - DNA, 1928 bp, Zea mays
  misc_feature: Ceres CLONE 1567786
  misc_feature: Encodes the peptide sequence at SEQ ID NO. 82078
agggagagaaagccagacaggactcctcctccttccctcccctaaaagctaaaaacatttggagagagagagagagagagggagatagaggggaaaccgagcaaccaagacgcagacgacgatggagcgagcggacgaggacgcgtgccgggtggcgctgctggacgcggacggcggcggcggcgagggcggcaagaagcagcagcagctcgcggcgcgggtgtgggaggagtcgaggaagctgtgggacatcgtggcgccggccatcttcagccgcgtcgtcacctacagcatgaacgtcatcacgcaggccttcgccggccacctcggcgacctcgagctcgccgccatctccatcgccaacaccgtcgtcgtcggcttcaacttcggcctcatgctgggcatggcgagcgcgctggagacgctgtgcgggcaggcgttcggcgcgaggaagttccacatgatgggcgtgtacatgcagcggtcgtggatcgtgctgttcatgtgcgcggtgctgctgctgcccatgtacttcttcgcggaggacgtgctgctgctgacggggcagccgccggagctggcggcgatggcggggaaggtgtgcgtgtggttcatcccgctgcacttctccttcgccttcctcttcccgctgcagcgcttcctgcagtgccagatgaggaactccgccaacgccgccgccgccgcagccgcgctctgcgtccacctcctcgccagctggctcctcgtctccaggctccgcttcggcctcgccggcatcgccctcacgctcaacttctcctggtgggccaccggcgccatgctcttcgcctacgtcgcatgcggcggctgccccgacacctggcacggcttctcgctcgaggccttcgccggcatgtgggagttcgtcaagctatcctccgcgtccggtgtcatgctatgcttggagaactggtactaccggatcctcgtcttgttgacgggaaacctaaaagatgcagcaattgccgtcgacgctctgtccatatgcatgtcaattaacgggtggcagatgatgattccgttggcgttcttcgcgggcaccggagtgcgtgtggccaacgagctcggcgcgggcaacggggagggcgccaggttcgcgaccatcgtgtcgacggtgacgtcgctggtgatcgggctcttcttctgggtgctcatcatgggcctgcacgacaagtacgcgctcatcttcacctccagccccgtcgtcctcgacgccgtcgaccacctctcggttcttctcgccttcaccatcctcctcaacagcatccagcccatcctctcaggtgtggccgtcggctccggctggcaatccatggtggcctacgtcaacatcggctgctactacctcatcggaatccccatgggcatcctgctcggatggctattcaaccttggcgtgctggggatctgggcggggatgatcggcgggaccgccgtccagacgctcgtcctggccatcatgacagtccgctgcgactgggaaaaggaggccatgatcgcgagcacgcgcatgggcaaactgtcggaagttcggtgatggcaggatctggtgctgcacatctgaacgagcgcccgtgatttttaagctctggcgggatcgtgtgttcccgcgtgttaggttcgtcaaattttgcctcgtggaaaagcaacgcaaggtgctcaggaatcagggacagggtcgccggggcagctcttgaagacgacggaggaggggcttggtgtggctatgatggttttggtgcttttgcttatgggctttatggtggtaacttcaaatcatatagcttgactgtggaccgttgatctggatgtgttttatcatatattacttcatagaaggtaataataaaatttaattgttttaaattttggaaaaaaaaaaaaaaaaa

SEQ ID NO: 82078 - protein, 484 aa, Zea mays
  misc_feature: Ceres CLONE 1567786
  misc_feature (47)..(207): Pfam Name: MatE Pfam Description: MatE
  misc_feature (267)..(430): Pfam Name: MatE Pfam Description: MatE
MERADEDACRVALLDADGGGGEGGKKQQQLAARVWEESRKLWDIVAPAIFSRVVTYSMNVITQAFAGHLGDLELAAISIANTVVVGFNFGLMLGMASALETLCGQAFGARKFHMMGVYMQRSWIVLFMCAVLLLPMYFFAEDVLLLTGQPPELAAMAGKVCVWFIPLHFSFAFLFPLQRFLQCQMRNSANAAAAAAALCVHLLASWLLVSRLRFGLAGIALTLNFSWWATGAMLFAYVACGGCPDTWHGFSLEAFAGMWEFVKLSSASGVMLCLENWYYRILVLLTGNLKDAAIAVDALSICMSINGWQMMIPLAFFAGTGVRVANELGAGNGEGARFATIVSTVTSLVIGLFFWVLIMGLHDKYALIFTSSPVVLDAVDHLSVLLAFTILLNSIQPILSGVAVGSGWQSMVAYVNIGCYYLIGIPMGILLGWLFNLGVLGIWAGMIGGTAVQTLVLAIMTVRCDWEKEAMIASTRMGKLSEVR

SEQ ID NO: 82079 - DNA, 821 bp, Zea mays
  misc_feature: Ceres CLONE 1567788
  misc_feature: Encodes the peptide sequence at SEQ ID NO. 82080
  misc_feature (528)..(528): n is a, c, t, g, unknown, or other
  misc_feature (669)..(669): n is a, c, t, g, unknown, or other
  misc_feature (699)..(699): n is a, c, t, g, unknown, or other
  misc_feature (767)..(767): n is a, c, t, g, unknown, or other
ctccccgcggtggcggccgctctagaactagtggatcccccgggctgcaggaattcgtctcacccctagaaaaagtcaaaccttgcaaagagagttcggtcgacggcgccagccggcgatggcagcgccgcgccaccgccagggccacattgcgcagtgccttggcaggatcctcgcctgccgcggcagcgccaccgccgccgtcgctgccggcccaggcggccgacggctcaccggcgcggagttcgtcgacggcgtgcggagcctggccgctggcctcgccgaccgcggggtgcgccctggccacgtcgtcgccgccgtcgccctcaacagcgtcgagtacgtgcagctgttcctcgccgtcacctacgccggagccatcatcgcccctctcaactaccgctgggtgcgtgcgtgctcctccacttcatctccttttctcggttcttacagcacacagcactcactccggcaaagagtgcaagtaagtttcgtcgtcgtctccccctgttctgaagcagagcttcnaggaggcggcgcaggcggtggagctcgtgcggccgacggcgttcgccttcgacggcgcgttcagctcctgggcgcttcggctgatggagggcgacaggttcccatccatcggcctctacctcctcctgggcgatccttgcnaggacggccgcgctgctgcaggttgtgctngtaccattaccgacgtcacggggagcctcggcggagctacggcagcggcggcgaatgaagccgtgtcngctccagacgacattgctctatatgcttcacatcccggtgaaaaaacaagctga

SEQ ID NO: 82080 - protein, 212 aa, Zea mays
  misc_feature: Ceres CLONE 1567788
  misc_feature: SWISSPROT Homolog: EC 6.2.1.12 4-coumarate--CoA ligase
  misc_feature (137)..(137): Xaa is any aa, unknown, or other
  misc_feature (184)..(184): Xaa is any aa, unknown, or other
  misc_feature (194)..(194): Xaa is any aa, unknown, or other
MAAPRHRQGHIAQCLGRILACRGSATAAVAAGPGGRRLTGAEFVDGVRSLAAGLADRGVRPGHVVAAVALNSVEYVQLFLAVTYAGAIIAPLNYRWVRACSSTSSPFLGSYSTQHSLRQRVQVSFVVVSPCSEAELXGGGAGGGARAADGVRLRRRVQLLGASADGGRQVPIHRPLPPPGRSLXGRPRCCRLCXYHYRRHGEPRRSYGSGGE

SEQ ID NO: 82081 - DNA, 828 bp, Zea mays
  misc_feature: Ceres CLONE 1567790
  misc_feature: Encodes the peptide sequence at SEQ ID NO. 82082
  misc_feature (687)..(687): n is a, c, t, g, unknown, or other
  misc_feature (809)..(809): n is a, c, t, g, unknown, or other
  misc_feature (825)..(825): n is a, c, t, g, unknown, or other
ccccgcggtggcggccgctctagaactagtggatcccccgggctgcaggaattcgtctcacccctagaaaaaacgccatggccgaaatgctcgcccttccgctgcccctccgagcgccggcgccaccgccaccgccgcgtcctacaattcccaaccccatcgtcacccatcgccaacctcacacaccgtcctcctcccctcctcgcctcttctccccgaactccctcctctccacctcccgccccactccagcctcatcctcccgcaaaccgcgcctcggccgcccgctcgacaccttccgcggcgaacagccgtggcacctgcctccgtccctgtccctccccgcccgccgcgcgctcctcgccttgctcgccgacccggcggaacacgcttccccgcgcgacgtcctctcggcgctcccggagaccgatctccccgccgtcgtgaacacgctcgcctcccgagggggccaccccggcatcgctgtcgccgtggtccgcgccgcgcgggacctccacggtgaccgcgctctccaccacccgcgcgtgctgcctactgccatccgcgtgtttgcgcgcgccggctgcctcgccgaggcctctgctatcctcgaggccgcgccggcgcccgacgccagcgcatacactgcgctcgtgtccgcgttctcccgtgccggggaggtccggnacgcggtcgccgtgttccagcgcatggtggatggaggcgtgcagcccgcgctcgtcacctacaacggtggtgttcatgcctactccaagatgtctgtcccgtggaaagaagtcgtggcgctncgtggactcattgaangaa

SEQ ID NO: 82082 - protein, 38 aa, Zea mays
  misc_feature: Ceres CLONE 1567790
MVDGGVQPALVTYNGGVHAYSKMSVPWKEVVALRGLIE

SEQ ID NO: 82083 - DNA, 842 bp, Zea mays
  misc_feature: Ceres CLONE 1567792
  misc_feature: Encodes the peptide sequence at SEQ ID NO. 82084
ctccccgcggtggcggccgctctagaactagtggatcccccgggctgcaggaattcgtctcacccctagaaaaaaaaaggaggaaggaaattttgcttcaattgggcgtcgttgagctaggcccctcctccagctcttgatccggtccatggggctctgccatggcaagccgacgcaaatcccggaggctgaggcggaggaggatccccacgtagcctccggcgcgggcgacggcggggacggggcgacctcgccgtcggcagcggcgcccgcggcgaagccaggcacgccgaaacagcccaagttcccgttctacctgccgagcccgctcccgccgtccagctacaagggctcgccggcaaactcgagcgtctcgtccaccccggcgcgcggcgggctcaagcgcccgttcccgccgccgtcgcctgccaagcacatccgcgctctactcgcgcggcggcacggctcggtcaagcccaacgaggtgcccattcccgagggcggcgagccggagctcggcctggacaagagcttcggcttctccaagcacttcttcaccaagtacgacctcggcgaggagatcggccgcggccacttcggctacacgtgctccgccaaggccaagaagggcgagcacaaggggcaggacgtcgccgtcaaagttatccccaaggccaagatgacaacagctatcgccatttgagatgtgagaagagaagtgagaatactgagttctctggtaggccacaataacctagtgcagttctacgatgcttttggagatgaagataacgggtatatagttatgggattatggtaagggagcgaactgctgggacggg

SEQ ID NO: 82084 - protein, 184 aa, Zea mays
  misc_feature: Ceres CLONE 1567792
  misc_feature: SWISSPROT Homolog: EC 2.7.11.1 Non-specific serine/threonine protein kinase
MGLCHGKPTQIPEAEAEEDPHVASGAGDGGDGATSPSAAAPAAKPGTPKQPKFPFYLPSPLPPSSYKGSPANSSVSSTPARGGLKRPFPPPSPAKHIRALLARRHGSVKPNEVPIPEGGEPELGLDKSFGFSKHFFTKYDLGEEIGRGHFGYTCSAKAKKGEHKGQDVAVKVIPKAKMTTAIAI

SEQ ID NO: 82085 - DNA, 801 bp, Zea mays
  misc_feature: Ceres CLONE 1567793
  misc_feature: Encodes the peptide sequence at SEQ ID NO. 82086
  misc_feature (476)..(476): n is a, c, t, g, unknown, or other
  misc_feature (801)..(801): n is a, c, t, g, unknown, or other
ggagctccccgcggtggcggccgctctagaactagtggatcccccgggctgcaggaattcgtctcacccctagaaaaacctggcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttccagctctacaaccgtaggaccgccgccaagacgccgtcgttctccgtctcccagcagcaggccggtgccgccaccttcaagaccgacgccgccatccctgacgccgccggccggaccgtcgntctgtgacgtgcacggagccctgctgcgctcctccgcgctcttcccctacttcatggtcgtggcctacgagggcggcagccttctgcgcgccatgctgctgctctgcgccttccctctcgtctgggcactcggggagcgcagcggcggcgctggcgccgtccgggtgatggcgttcgtcaccttcgcggggctcaggccaggaccatggacctcgtgggcccgcgccgtcctgcccagcactacatggagcagctcaacgcgctggtgtacggcagcctgtggctcccgcccagaggaaaggtgcggtgaccgcccgccccggtn

SEQ ID NO: 82086 - protein, 90 aa, Zea mays
  misc_feature: Ceres CLONE 1567793
  misc_feature: SWISSPROT Homolog: EC 2.3.1.15 Glycerol-3-phosphate O-acyltransferase
MVVAYEGGSLLRAMLLLCAFPLVWALGERSGGAGAVRVMAFVTFAGLRPGPWTSWARAVLPSTTWSSSTRWCTAACGSRPEERCGDRPPR

SEQ ID NO: 82087 - DNA, 834 bp, Zea mays
  misc_feature: Ceres CLONE 1567794
  misc_feature: Encodes the peptide sequence at SEQ ID NO. 82088
  misc_feature (466)..(466): n is a, c, t, g, unknown, or other
ctccccgcggtggcggccgctctagaactagtggatcccccgggctgcaggaattcgtctcacccctagaaaaagcctctcgccatttttactcgtcggctggtccggccccagcgattcggtttggtgcgcctcgtggtccacgtgcgcgggctttgtgctctctcttccctctgtgtgtgtgtcagttcgtcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgtggcgccgtctctggcgcaaggtgcgccgcgcgcccggggcgcgcgcgcgtctccctcggcgccgacccggcgttcctctgcncggactgctgccagggctgcgccgccgcttcccggcgcccctggtcggttgaggcctcctcggggtgccccttggggggccaaatctcccccgtcatggggggtcgaaactccccccgccggcctttggccttgggggaaaaacgggaaaagggggggaaaaaaaaaaaaaccccttcccctcgggggggttgaaaaaacccccggcttgggggtggggggggggtggggccaaaaaaaggaaaaatttggggaaacaccttattttggggcggggggaaaccccacccccgggtgtgggggcccttctcccccaaaaaaacgtggggggggggccccccccctcctttagaggggggagaggggggg

SEQ ID NO: 82088 - protein, 146 aa, Zea mays
  misc_feature: Ceres CLONE 1567794
  misc_feature (11)..(58): Pfam Name: zf-B_box Pfam Description: B-box zinc finger
  misc_feature (83)..(83): Xaa is any aa, unknown, or other
MKSCGGGGADGQQCPCDYCGEAAAALHCRADAARLCVACDRHVHAANALSRKHVRGAVSGARCAARPGRARVSLGADPAFLCXDCCQGCAAASRRPWSVEASSGCPLGGQISPVMGGRNSPRRPLALGEKREKGGKKKKTPSPRGG

SEQ ID NO: 82089 - DNA, 816 bp, Zea mays
  misc_feature: Ceres CLONE 1567797
  misc_feature: Encodes the peptide sequence at SEQ ID NO. 82090
  misc_feature (319)..(319): n is a, c, t, g, unknown, or other
ctccccgcggtggcggccgctctagaactagtggatcccccgggctgcaggaattcgtctcacccctagaaaaagccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggtgaggaccgcgagcggggccggcaccgcagcgttcgggagcaccgggatcgggatanaggatgacgggaaggagaaggagaggagccgcgatagccgcgggaaggacagagacaggaggggagagaaacgggagaaggagaggggggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagatagggaccagaggactgtatttgctttccagctatctctgaaggcagacgaaagagatgtttatgagttcttctcaggggctgggaaggttcgtgatgttcgtcttatcatggaccgaaactcagacgttctaaaggagttgggattcacactgaaattttatagtttgctctacatgctgggattatcggcaatttacaagtaagatggt

SEQ ID NO: 82090 - protein, 210 aa, Zea mays
  misc_feature: Ceres CLONE 1567797
  misc_feature (48)..(48): Xaa is any aa, unknown, or other
MVPAPARRTAARVAARATRAAYRSAPARVRTASGAGTAAFGSTGIGIXDDGKEKERSRDSRGKDRDRRGEKREKERGDRHRPREREVERERRSLSRSERRRIEEEEMVRELEMERERSERHHYRDRDVRRRKDDGAEPEVDPDRDQRTVFAFQLSLKADERDVYEFFSGAGKVRDVRLIMDRNSDVLKELGFTLKFYSLLYMLGLSAIYK

SEQ ID NO: 82091 - DNA, 1005 bp, Zea mays
  misc_feature: Ceres CLONE 1567799
  misc_feature: Encodes the peptide sequence at SEQ ID NO. 82092
  misc_feature (414)..(414): n is a, c, t, g, unknown, or other
  misc_feature (647)..(647): n is a, c, t, g, unknown, or other
  misc_feature (966)..(966): n is a, c, t, g, unknown, or other
aagctggagctccccgcggtggcggccgctctagaactagtggatcccccgggctgcaggaattcgtctcacccctagaaaaagggagagaaagccagacaggactcctcctccttccctcccctaaaagctaaaaacatttggagagagagagagagagagggagatagaggggaaaccgagcaaccaagacgcagacgacgatggagcgagcggacgaggacgcgtgccgggtggcgctgctggacgcggacggcggcggcggcgagggcggcaagaagcagcagcagctcgcggcgcgggtgtgggaggagtcgaggaagctgtgggacatcgtggcgccggccatcttcagccgcgtcgtcacctacagcatgaacgtcatcacgcaggggcttcgccgggccccccccngcgacctcgaagctcgccggccatctccatccgccaaacaccggtcgtcgtccggctttcaaccttcgggcccccatgcctggggcatgggcgaagcgcccctgggagaacgcttgtggcgggggcagggcgtttccggcgcccgggggaaacttccccacctagaaagggggggtggtaccactgccaagcggggcccgcgggggattccggggcctgggtcccaggagggnccgccggggtcccgtgccctcgcggggcccctacatttatatctttcctccgcggggtgaaagaaaaccggcgcttgcccttccgctgcgacggggggggcacccccccgcccgcgggaaccgggcgcggcgacaaaaggcgccgggggatataaatcgggcgggggtgggggagtcataccggcgcgggtggaagcggtatacgcgcggaaccagttcgcgcgctttcccgcggggggagagggcgttgtccgccgctgggcgggataaggggcgggccttccccggcagaaccggccggccgccgcgggggataaanacccgggttcgggcggtaccacgtcgcgcttatcggcag

SEQ ID NO: 82092 - protein, 167 aa, Zea mays
  misc_feature: Ceres CLONE 1567799
  misc_feature (71)..(71): Xaa is any aa, unknown, or other
MERADEDACRVALLDADGGGGEGGKKQQQLAARVWEESRKLWDIVAPAIFSRVVTYSMNVITQGLRRAPPXDLEARRPSPSAKHRSSSGFQPSGPHAWGMGEAPLGERLWRGQGVSGARGKLPHLERGGGTTAKRGPRGIPGPGSQEGPPGSRALAGPLHLYLSSAG

SEQ ID NO: 82093 - DNA, 852 bp, Zea mays
  misc_feature: Ceres CLONE 1567800
  misc_feature: Encodes the peptide sequence at SEQ ID NO. 82094
  misc_feature (623)..(623): n is a, c, t, g, unknown, or other
ctggagctccccgcggtggcggccgctctagaactagtggatcccccgggctgcaggaattcgtctcacccctagaaaaagtggaaacaatagcagcacccgggcgggagctctcgattcctcccctccccccttcagatgatcatatcattccgtccctggccatctgcactggtctctaatggcattatactggctcctacccactcgccttcttctcccctactcatctgcacgctcctcttctcctggtagcaggactgctatatatcaataatactagctggaccctttccactcctctcacctctcactaccaccaccactgccccggatgcattcgagatgctgcaccatcgcgcacgagctagattcagacggtcgatagatcgatctatcgctcgaccatcatggcccgggagagagcatgcgctgctgtcaacagagatcgtgaaccgcgtcgtggagccgtccggtccgggacgacggatcgccggccttctcagagagcgtgcgccgccgcctacacgacttccagcactccgagaacctcaagtacgtgcgcctctggtaccactacctcatcagccacagcgtgtacctggacgaagatacccgtcatncgtgctggtgtgcgatgcctagctgggcagcctcgaccacgacgagcatgggcgctacgagtcggggggaggccaccttcgacgtcatcacagagctcgacgtcctcatacgtctcgccttcatcatccccgtcgtcatcatggacaggcccatgacccgcgtacctcatcaacttctcatgactacagaccggcctaagtgcttcaagtgatgcgaggccgcattcat

SEQ ID NO: 82094 - protein, 54 aa, Zea mays
  misc_feature: Ceres CLONE 1567800
MGATSRGEATFDVITELDVLIRLAFIIPVVIMDRPMTRVPHQLLMTTDRPKCFK

SEQ ID NO: 82095 - DNA, 842 bp, Zea mays
  misc_feature: Ceres CLONE 1567801
  misc_feature: Encodes the peptide sequence at SEQ ID NO. 82096
ctggagctccccgcggtggcggccgctctagaactagtggatcccccgggctgcaggaattcgtctcacccctagaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcgctgcagcttgctgaagtctttacttgctgcattctgtgctcacacttttgaaagctgctctcttctgctctgcgttgttgatttctgcactcaagcttctcttgcctgtgcactcaagcttctctcttcctgggcaactagtgatctccttgaagcatttcagcttttacctagagatctttctgttgttgctgaaggcaagagaagctttagggtgatggcgcaaactagcctgcctcctggttttcgtttcaacccaactgatgttgagctcgt

SEQ ID NO: 82096 - protein, 29 aa, Zea mays
  misc_feature: Ceres CLONE 1567801
MSAEVAGGHPYFLSCYFWFIYCIKFRDFT

SEQ ID NO: 82097 - DNA, 840 bp, Zea mays
  misc_feature: Ceres CLONE 1567802
  misc_feature: Encodes the peptide sequence at SEQ ID NO. 82098
ctccccgcggtggcggccgctctagaactagtggatcccccgggctgcaggaattcgtctcacccctagaaaaaattcagcaatgcatcccgttccactgttccagcttgcacccgacaagccgaacacttcaccctttcccacttcacctccgccgttccgcatctgtggtcaaatacgacgctcgcgtccataccgatccgtgtttgctcattccctctcctcccactcgcttttcctccaaagcgagcgagctaggcgttacgccggagctcgtttgggcggtggtggaggagagaggaaagggaggagatgaaggcggtggagcgagcgaaactggtgaggagcctccggcacgagtcgcggcggctgcgtctactcgtcctcgttatcggtttcttcctcgttactctcaccttcgttgtcgtctccaagcccgacgcgctcctcttcaacctgaacggcaggctgtcggtggaccaggcgccgcgctcgctcttgatccgccagcgggttgacgccgacgaggggagatccgccgaaactctcgcctcagccaccggagatccaaaggtggtcgaagacgatacctacggcgaggaagccagcgccaaagccagagccaacgccaatgcccgagggaccactgctgaggaggaacggatgctcgctagtgagcccgagcagagaaaaagggcacaggaagcctacatctgagattttagctggcgaagacgaccggggaaggtaaaagcagcaagtaggacacaaagagcaccagcagcacaagttgaccctcccaactgtttcgaattataccattcacgatgccactgacgg

SEQ ID NO: 82098 - protein, 134 aa, Zea mays
  misc_feature: Ceres CLONE 1567802
MKAVERAKLVRSLRHESRRLRLLVLVIGFFLVTLTFVVVSKPDALLFNLNGRLSVDQAPRSLLIRQRVDADEGRSAETLASATGDPKVVEDDTYGEEASAKARANANARGTTAEEERMLASEPEQRKRAQEAYI

SEQ ID NO: 82099 - DNA, 757 bp, Zea mays
  misc_feature: Ceres CLONE 1567805
  misc_feature: Encodes the peptide sequence at SEQ ID NO. 82100
  misc_feature (483)..(483): n is a, c, t, g, unknown, or other
  misc_feature (704)..(704): n is a, c, t, g, unknown, or other
ctccccgcggtggcggccgctctagaactagtggatcccccgggctgcaggaattcgtctcacccctagaaaaaagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgtccctggcaccaggcgcctctggtggaggggaaacccgcaccagaggcaggctgcgcggtcagcgatggcgggacggacgtcatcatcgtcggcgccggggtagctggatctgcgctggcatacacgctcgggaaaggatgggccgtcgggtgcatngtcatcgagaggggatcctgacagaaacctggacaaaatttgttggggcaaaacctttttccaaacccgggggggggttacctttgaaaaattaaatttgggaggcgggggcgccccccaaaaaaatttggtgggggggaaaaaaaaaaaaattgatgtgcccccaccacacgggggggggtggtggggggtgtttccccccccctttttttttttttttnagaaaaggtggggggggggggggaaacaacacccccccgtttgtgtgtttgtg

SEQ ID NO: 82100 - protein, 95 aa, Zea mays
  misc_feature: Ceres CLONE 1567805
  misc_feature: SWISSPROT Homolog: EC 1.14.99.7 Squalene monooxygenase
  misc_feature (89)..(89): Xaa is any aa, unknown, or other
MAATAAAAGVEFPLIGVAVATLIVTVLVAAVMRRRRRPWHQAPLVEGKPAPEAGCAVSDGGTDVIIVGAGVAGSALAYTLGKGWAVGCXVIERGS

SEQ ID NO: 82101 - DNA, 881 bp, Zea mays
  misc_feature: Ceres CLONE 1567806
  misc_feature: Encodes the peptide sequence at SEQ ID NO. 82102
acccgcggtggcggccgctctagaactagtggatcccccgggctgcaggaattcgtctcacccctagaaaaaagccgtgacaacacagcctgcgctccccttctttcccgttcggctcacagcgaagaaggaagccggttaaggtttccacctcctttcccctcctctccttcagcgacgaccgcgggccacaccctcgatatccttcccctcggacccggaggcgatcatcagcctccagcgcctgccacgcctgcccgtctcattattgggaggattcgccatgtctgacatggagtccgtcacacctcttatgaactcgacaagctccaagatacagcagcttcatgatgcatttgctgagcttgagagccagagcacggtttccatgaacctcaagtggaagcagcttgaagaccactttcgtggtcttgaacaggccctcaagaaatagtttgacgagcttgaatagcacgagaatgagttccaggagactgtcgcaaaatcagagcagattctggagcagctggaggcagctgctgtggcaaaggaactgacctcgtttgagactttcccggagaagagggaagctgcttcagctatgatcttcagcaagtccaagctttcttttccgttccctccaataaaccaattgaacaagcccccgaataatcgttggtgtccagggggccaaaacccgccctccgagggaaaagttggccccttccaaattaaaaaaaggctgaattgcccaccccccacccgaaggggtggtcccccctcccgggggggaaaaaaaaaatttgaaaaggggcttcctaatttgttcttttttccccaaacaaccggaaaaaaatatttgtggcgccctcctccccaag

SEQ ID NO: 82102 - protein, 56 aa, Zea mays
  misc_feature: Ceres CLONE 1567806
MSDMESVTPLMNSTSSKIQQLHDAFAELESQSTVSMNLKWKQLEDHFRGLEQALKK

SEQ ID NO: 82103 - DNA, 834 bp, Zea mays
  misc_feature: Ceres CLONE 1567808
  misc_feature: Encodes the peptide sequence at SEQ ID NO. 82104
  misc_feature (684)..(684): n is a, c, t, g, unknown, or other
  misc_feature (804)..(804): n is a, c, t, g, unknown, or other
ctccccgcggtggcggccgctctagaactagtggatcccccgggctgcaggaattcgtctcacccctagaaaaagggagtgccaatgcctccagcccagcttgcctgccacctggtcttgaccctctcctggataggaggagcagcagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcattgaagaggatgatgatgatgattctgtttcggagagctcttcagcatcattggccaaaccagcntggaactttggatcttggcaagctgacagaggaaccacagcctcaccgcagtgtggatccaaaccattcgtatgatcaagtgtttattagatccactcggttactgggagaggagatccnaagaacgcacggcgggcacagggcttttga

SEQ ID NO: 82104 - protein, 133 aa, Zea mays
  misc_feature: Ceres CLONE 1567808
MIHDTSSSRASTACHYSPSLVAEEQLHGSKDTLTLKGEKALLELLLGMALDQHVDGRKLITQQEAEDSDFESYLREATSRVLYQPTFIEEDDDDDSVSESSSASLAKPAWNFGSWQADRGTTASPQCGSKPFV

SEQ ID NO: 82105 - DNA, 813 bp, Zea mays
  misc_feature: Ceres CLONE 1567809
  misc_feature: Encodes the peptide sequence at SEQ ID NO. 82106
ctccccgcggtggcggccgctctagaactagtggatcccccgggctgcaggaattcgtctcacccctagaaaaaattaaacgcgggcgatcaagatggcgcacgaccccagcctgggcttcgcggactacttctcggcggcggcggcggcgggcgccacggcgatggacgacgacgtcggggcgccggagctctatggcctgcatgccgacgacatggagttcctcggcatgcgtggcctggccgccatgccccccgccgcggcacaccaccagcaccaccaccatcacggccacagcaaggccggtgcgctcctcgacgacgacgacgcgggggtggggccagacgtcagcggctccgcggacgacgccaccatgcgcttcctgagcgagcagcagcagcagcagcaccaggcgccgctgtcgctgtcgctgtgccggccggacgtggcgacgacgttgcacgagcagcagcacctcgccggcggtggctcctcgtcccggtaccatcaggagcagcagccggcggcgtgggtgcagcagcagcacgactactcgccgtcgccgcagcagcacgcgtggcacctgcgcagctccaggttcctcgtcccggcgcagcaagcccggcaagagttctgccagctccccgtggacagcagcaagcgctgccgccctcagcaagggccgccaaggccgcaaataagccccggctccccagcagcagcagcagccaagaaagacggcgccgcccccccaagggggtcgttcttccttccgcctccctgggggcccctccccccccaaaatccgggcca

SEQ ID NO: 82106 - protein, 239 aa, Zea mays
  misc_feature: Ceres CLONE 1567809
MAHDPSLGFADYFSAAAAAGATAMDDDVGAPELYGLHADDMEFLGMRGLAAMPPAAAHHQHHHHHGHSKAGALLDDDDAGVGPDVSGSADDATMRFLSEQQQQQHQAPLSLSLCRPDVATTLHEQQHLAGGGSSSRYHQEQQPAAWVQQQHDYSPSPQQHAWHLRSSRFLVPAQQARQEFCQLPVDSSKRCRPQQGPPRPQISPGSPAAAAAKKDGAAPPRGSFFLPPPWGPLPPQNPG

SEQ ID NO: 82107 - DNA, 846 bp, Zea mays
  misc_feature: Ceres CLONE 1567812
  misc_feature: Encodes the peptide sequence at SEQ ID NO. 82108
ggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaatgagagcaccctccacttggtgctgcgcctcaggggaggcatgcagatcttcgtgaagaccctgaccggcaaaactatcaccctccgaggtggagtcttcagacaccatcctactacgtcaagggccaagatccaggaacaagaagggcattcccccagaaccagcagcggcctcatctttttgctggaaagcaaccttggtgtacagggcgcacccttggccgactacaacattccagaaaagagaagcaacccctcccccttggtttgctga

SEQ ID NO: 82108 - protein, 229 aa, Zea mays
  misc_feature: Ceres CLONE 1567812
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQNESTLHLVLRLRGGMQIFVKTLTGKTITLRGGVFRHHPTTSRAKIQEQEGHSPRTSSGLIFLLESNLGVQGAPLADYNIPEKRSNPSPLVC

SEQ ID NO: 82109 - DNA, 835 bp, Zea mays
  misc_feature: Ceres CLONE 1567813
  misc_feature: Encodes the peptide sequence at SEQ ID NO. 82110
  misc_feature (539)..(539): n is a, c, t, g, unknown, or other
ctccccgcggtggcggccgctctagaactagtggatcccccgggctgcaggaattcgtctcacccctagaaaaattcattgaggcaatgaataactacggaaaggatttttctcggatctcgtcttgtgtgaagagcaagtcatatgaacaatgcaaagtgttctttagtaaggctcggaaatcacttggtttggatttgatccatcaaggggcagccgatgttagtatgccagctagtgataccaatggagggaggagcgatactgacgaggcctgtgctgtggaaatggattcagctatctgtaggaagcagtcttgttcaaagattgtgcaagatgtttgtcctactgaaggagccattttagggcctgactctgttttaatctctaagcagacagaaggagatatatcaaataggtgcattgttgatgttaaaattgaggaagatgataaggaagctgataaaaattgcagcaatgttgatgataagaggtccagtgatagtactcatcaagctggccctatcaacatcaattgncccagaaagtacagataagctgcaaagaactgatgatgcccttgaccaagtaaacatgcatagtagtgtccctcaactcttcaaatgagcatgccatggccatgccacccaagaagtgaaaacaagtttcacccctggtagatgtacttccaaacaacaaagcctgaaagtactgggaactgaaccctgccaaggggggaaaaaggttcccatcagggctgtccacccaccccataaaaactggggaaatttggggtccccaacctttttaaactttaaaaaaagggggttcacaa

SEQ ID NO: 82110 - protein, 184 aa, Zea mays
  misc_feature: Ceres CLONE 1567813
  misc_feature (179)..(179): Xaa is any aa, unknown, or other
PRGGGRSRTSGSPGLQEFVSPLEKFIEAMNNYGKDFSRISSCVKSKSYEQCKVFFSKARKSLGLDLIHQGAADVSMPASDTNGGRSDTDEACAVEMDSAICRKQSCSKIVQDVCPTEGAILGPDSVLISKQTEGDISNRCIVDVKIEEDDKEADKNCSNVDDKRSSDSTHQAGPININXPRKYR

SEQ ID NO: 82111 - DNA, 804 bp, Zea mays
  misc_feature: Ceres CLONE 1567815
  misc_feature: Encodes the peptide sequence at SEQ ID NO. 82112
  misc_feature (776)..(776): n is a, c, t, g, unknown, or other
tccccgcggtggcggccgctctagaactagtggatcccccgggctgcaggaattcgtctcacccctagaaaaactctcccctgccacttcccaaatccgcccgccattcatgcactcttctgtgcactgtcagcgccaccattagctcgcagctcaagctcgccactaccattttcgtcggttcttgaggaaatcgatcgaaccgttggagtgccaccactggcagaggctgttgcattcttgagttgagcaggaagaggagaggaagcaatggctctgtcgacgttctctgtcccaagggggttcctcggcgtgccggctcaggactcccatttcgcttcggcggtcgagctccatgttcacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactacccccgtcacatgaagaacctgtctgtgaaggagctgcggcagctggccgacgagctcccgtccgacgtcatccttcacgtctccaagaccgggcggcacctcgggtccagccctcggcggtggtggagctcaacgtcgcgctgcactacgtcttcaacgcggcgcaagaccgcacccctctgggacggtcgggcaccaagtcgaccccgcacaagaatcctgacggggcggggccgacagaatgcctaccatggcggaaaacaaacgggcctggnggggttcaacaaacgccccccagaacca

SEQ ID NO: 82112 - protein, 178 aa, Zea mays
  misc_feature: Ceres CLONE 1567815
  misc_feature: SWISSPROT Homolog: EC 2.2.1.7 1-deoxy-D-xylulose-5-phosphate synthase
  misc_feature (169)..(169): Xaa is any aa, unknown, or other
MALSTFSVPRGFLGVPAQDSHFASAVELHVHKLLQARPINLKPRRRPACVSASLSSEREAEYYSQRPPTPLLDTINYPRHMKNLSVKELRQLADELPSDVILHVSKTGRHLGSSPRRWWSSTSRCTTSSTRRKTAPLWDGRAPSRPRTRILTGRGRQNAYHGGKQTGLXGFNKRPPEP

SEQ ID NO: 82113 - DNA, 905 bp, Zea mays
  misc_feature: Ceres CLONE 1567819
  misc_feature: Encodes the peptide sequence at SEQ ID NO. 82114
ctccccgcggtggcggccgctctagaactagtggatcccccgggctgcaggaattcgtctcacccctagaaaaactcccaaatcaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcgggggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctcagctacctcctcagcttcttcgggatcgccttcgtgaggtccgtcgtctccaacagcgacgacgaggaggacttcctcatcaactcccgccacggacaggcgcggggcgcccgcctcggcccgcggccggggggccccgtgttgcgcctgctggggaagaccccgactgccgggccgggagaatatgcccggaaggaggaccgagggagattcggtggtccccgggtccgtgggcagggaaaaaatccccgtccctaccgtgctgggaaaaacataggctgggaaaaattgcccccccgggcccctcccgggtattagggcgggaaggggccgtgcccagggattaccccggtaagggaaatattaaatgggccttccccgcctcgaagggggttcaaaataaacggtgtcattaactatggacaagttggttgggaagtgtggcccgggtggggttaa

SEQ ID NO: 82114 - protein, 195 aa, Zea mays
  misc_feature: Ceres CLONE 1567819
  misc_feature: SWISSPROT Homolog: EC 1.1.1.34 Hydroxymethylglutaryl-CoA reductase (NADPH)
MEVRRRVPPPHGSAPRRQQATGGEGQRVRVQAGDALPLPIRHTNLIFSALFAASLVYLMRRWREKIRSSTPLHVVSLAEIFAICGLVASLSYLLSFFGIAFVRSVVSNSDDEEDFLINSRHGQARGARLGPRPGGPVLRLLGKTPTAGPGEYARKEDRGRFGGPRVRGQGKNPRPYRAGKNIGWEKLPPRAPPGY

SEQ ID NO: 82115 - DNA, 996 bp, Zea mays
  misc_feature: Ceres CLONE 1567822
  misc_feature: Encodes the peptide sequence at SEQ ID NO. 82116
  misc_feature (17)..(17): n is a, c, t, g, unknown, or other
  misc_feature (59)..(59): n is a, c, t, g, unknown, or other
  misc_feature (62)..(62): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (857)..(857): n is a, c, t, g, unknown, or other
  misc_feature (887)..(887): n is a, c, t, g, unknown, or other
  misc_feature (924)..(924): n is a, c, t, g, unknown, or other
  misc_feature (944)..(944): n is a, c, t, g, unknown, or other
  misc_feature (964)..(964): n is a, c, t, g, unknown, or other
  misc_feature (967)..(967): n is a, c, t, g, unknown, or other
  misc_feature (968)..(968): n is a, c, t, g, unknown, or other
ggagcgcgcaccggcgnagcgggcgcgcgagagcacggcccggcgcgaggcgacgcacncgncggcgcgcgcnnnnnnnnnnnngtgnnnnnnnntttttggagctccccgcggtggcggccgctctagaactagtggatcccccgggctgcaggaattcgtctcacccctagaaaaaacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcggccctctccggctaaggatatccaatgcatgcgcttctttggcgatttcgtcatggaaaatcaggggtgtcctgtctataaatctagccctccctgggatgctcaacccttcggtcatggaaaaaataaatccagggcctactccttcaattacataaatttttgaaggctataaattataatacccccatccccttccccttgtgaagagagcaagnaacacagagaggctgacgcaaagcagcganacacgaaacggacacagtataaccaccggtagggggnggtagggcaaacaacagccncgtatagacgccacagcggncgnntacatcaacgggttccagccccgcccgc

SEQ ID NO: 82116 - protein, 176 aa, Zea mays
  misc_feature: Ceres CLONE 1567822
  misc_feature (32)..(128): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDGYSPIYNEDDWSPTGDVYVGGTTGLLIWAVTLAGILGGGALLVYNTSGPLRLRISNACASLAISSWKIRGVLSINLALPGMLNPSVMEKINPGPTPSIT

SEQ ID NO: 82117 - DNA, 799 bp, Zea mays
  misc_feature: Ceres CLONE 1567825
  misc_feature: Encodes the peptide sequence at SEQ ID NO. 82118
  misc_feature (764)..(764): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
ctggagctccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagcgggcggctggtatggatcccaatggcctcaaaactggaggccttttgctcccgaccatcgagaggcggtgcacgtcgcctccatccgtcattgtcatcggcggtggcattctcggggcgttgcagcctgcccgtgccctcctccaattctttcattttaaggggaacgggttttggaatccaagagattcgtattgggcggggcgccatttctaacggaataacccccgtttgggatgccccaatttggatttgtgggaagccctcctgggggtttaaccacgcctttttanaaggtcnnnnnnnnnnnnnnnnnnnnnnnnnnnnn

SEQ ID NO: 82118 - protein, 67 aa, Zea mays
  misc_feature: Ceres CLONE 1567825
MDPNGLKTGGLLLPTIERRCTSPPSVIVIGGGILGALQPARALLQFFHFKGNGFWNPRDSYWAGRHF

SEQ ID NO: 82119 - DNA, 807 bp, Zea mays
  misc_feature: Ceres CLONE 1567827
  misc_feature: Translation starting site: 150
  misc_feature: SWISSPROT Homolog: EC 1.11.1.6 Catalase
  misc_feature (793)..(793): n is a, c, t, g, unknown, or other
ggagctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtacgtccagcacccacgacacgacggtgacgacgacgaacgcgggcgctcctgtgtggaacgacaacgaggcgctgactgtggggcctcacggtcccatcctgatggaggactaccacctgatcgagaaggtggcgcacttcgcgcgcgagcgcatcccggagcacgtggtgcacgcacgagaggcctccgccaagggcttcttccagtgcacccacgacgtgacgtcgctgacttgcgccgacttcctgcacgcgcccggcgtgcagactcccgtgatcgtgcgcttctctacggtgatccacgagcgggggtccccggagacgatccgcgacccgcgcgggtatcgccgtgaagttctacacccgcgagggcaactgggacctgctgggcaacaacttccccgtcttcttcatccgagacggcatcaatttccccaacataatccactcgttcaagcccaaccctcggtcgcacgtgcaggagtactggagggtgttcgacttactgtcacacctccccgagagcctgcacaccttattcttcctcttagacgacgtgggcgtgccgtgcgactaccgccacatggaagggttcggcgtgaacacctacacattcgtgatcnccgcacatgatgct

SEQ ID NO: 82120 - DNA, 751 bp, Zea mays
  misc_feature: Ceres CLONE 1567829
  misc_feature (1)..(1): n is a, c, t, g, unknown, or other
  misc_feature (2)..(2): n is a, c, t, g, unknown, or other
  misc_feature (564)..(564): n is a, c, t, g, unknown, or other
  misc_feature (595)..(595): n is a, c, t, g, unknown, or other
  misc_feature (617)..(617): n is a, c, t, g, unknown, or other
  misc_feature (618)..(618): n is a, c, t, g, unknown, or other
nncctggagctcaccgcggtggcggccgctctagaactagtggatcccccgggctgcaggaattcgtctcacccctagaaaaactctcccacctctcctctcctctccattgcaaaccttcgggatgaaggttgagagcctgctctgaaacgacgtacgtaaagggagcaaggaaccggagagcgtgcggcgggcttctggattttagagtaggcacctgtcgcttggacgtgcttcggagaagtaggtgtccaaaagttgcttacagtggatccagatccttcgaacaacattgctcaagctcatgatatagactgtcatggaggcagctgcagatgaggagaggccactgattcagtacctggctccagaggatgatgaagcttcctcacgatacactagcgacgggaacgctcgatatccaacaaagcaaccgtggctctgaaaaaaaaaaccccccgggaaaactgggaaaaaaacgccccccccaaaaaattcggggggacccccaaattttccccccaaaaaaaaaccccgggggttttttttttcgccccccccccnccccaagaaaaaaaaaacggcggggggtgtntaacctcctcttccctccctcnnaggggagggaaaaaaattttgttttttgggggggggagagaagaaaacaaaatcttcttttttttttccttgcgcccccccccccccacaaaaaaaaaaaaaaaaaggagggggttcccctcccccccccccg

SEQ ID NO: 82121 - DNA, 885 bp, Zea mays
  misc_feature: Ceres CLONE 1567834
ctccccgcggtggcggccgctctagaactagtggatcccccgggctgcaggaattcgtctcacccctagaaaaacgcgtcattctcctcccctccttccacccggcaaaaaccccgcgtcggccactctccggaggcgactagggtttcagcccctgggacacgccgccggtcgtggcacctccgccaccggatcccggtacccgagctacgccatcgccgccccgcccccggtcaccgccggtgcgcttccgccgacaccagacgcagctcgtccgccccgtcacgtgcacctctgcgtgggcgcgggattggatagggtttggggtttcggcggctggcgccaaatcccaccgctgctgctcgcgcaggaggtctcgagccctcggggttcccctactccgctccggctggagttctcgatgaaacttgttctacagtgttcttctgttgcatgactcagttgttttgagttatacttcataataacaatgcatacacgaaaaaagggtgctgcaaaaaatgcagtgggggtatcatgccaatcctaaaaccagttaggcattccagaaaggcaactcattcctcagttggctgaaaaaaaagttctgatcccctcccgtcttccttccaaaaacaaaaacctgtgggggtgccctcccaaaaacctttctaaagggagaaaggaacccctttttttcttggaaaacaccgaagcgttggaaagaagacccctcggtgccccccctaaagtttttcccggtaatcggaggccccaaaatttttaaaggggtttcaaaattaattccccacaaaaatttccatttttttcctccaaaattccccttctctcagaggagaaggtgtggggatatatatttcttct

SEQ ID NO: 82122 - DNA, 858 bp, Zea mays
  misc_feature: Ceres CLONE 1567837
  misc_feature: Translation starting site: 185
  misc_feature: Pfam Name: Rpr2 Pfam Description: RNAse P Rpr2/Rpp21/SNM1 subunit domain
tggagctccccgcggtggcggccgctctagaactagtggatcccccgggctgcaggaattcgtctcacccctagaaaaaatcctgccgtcttgtaaaaaaatccccgccgccggagacgcgcaagctagggctagcaaccgttcttgctgacagagtacccacaggtcctgcaccagcggcggcatgggaaagaagattcgcagcaccgatggcacctcgacgccggccaggtccatgaatcaggccgtgtcgctccgcgaggagacctccgggaggacgcgcgtagacgatgcctccctgctgagggtcaagcatttgcagaggctagcggcgtgggcgggcccggaggccggggtgcgcccgatcggcgcgctgctggggcgccgcctcgccgcgagcgccgaggccgccggagtacccctcaacgccgccactttcctttggccagaggtgtgagacaatcttaaagccaggcttcaactgcactgtccgcataaggaacaagaaaaataaaagcaaaacgtcggaagaaatcaaactgttggccagaacagtgtttcttatgcatggcattttctgtggagatcagaacttatattggtagtggggaaaagggggtttttttttcaaaaacccggttacggtccaaaaggggattgctaaccctgaaatctttccccctttaaattggggaaaagagaaacccggttgccaccccccaggacccactggtttaaaaaaaaaaaaggggcttggaacctttccccaaaaaaaacaaattttttgcaaaaggggaaaaccccccccaccctccggttggagggggcggcccgcacctttcctgaaaagagggaccc

SEQ ID NO: 82123 - DNA, 801 bp, Zea mays
  misc_feature: Ceres CLONE 1567839
ggagctccccgcggtggcggccgctctagaactagtggatcccccgggctgcaggaattcgtctcacccctagaaaaagagagaggccaatgcgagggagtagctcgcggcggaccagagaccagagagcgagagcgagcaaagctcacaaggcgaagcggaattgattgcgaccaccaccaccacgtcttctccacctccgtccgatccgtcgtcaccaagccaccatcattggcgccaccgcgccgcccgcccagctgcgcattcttaactgtttctctcttggcttatcggcgaagtgttgcggttgcgggggtactggagtgcggagagcagcgcggcggtacgtgtgcgttgctgcgctgtgctgccacagtgagctaggggagagcgagggggaggaagcaccacccaccacaccacctccattaaaggcgctcacgcgccgcccctccgcctccacgagaaagcgaggcgggagcgagtgagcaggggcgtacgtccgtcgtcaaggccatctctctcctcctcacttcctcccctcacggggacagccacgtacaaaggcagctcgccaacgcccagcacctccctcgccgtgcgcctttaaagacagcgcgcgacaagcttaaaggttcccacgccgccgttcgctcgcgctgctctttgcgccacgacgcggttgatcggtgcttttgatctgttccttcttgttgcagctgcagaggaagtgacacagagggcagagccgtcgcgcgcgtgcgaaaccgaagcagagagagcggcaatggcggtgaccgg

SEQ ID NO: 82124 - DNA, 835 bp, Zea mays
  misc_feature: Ceres CLONE 1567844
  misc_feature: Encodes the peptide sequence at SEQ ID NO. 82125
  misc_feature (768)..(768): n is a, c, t, g, unknown, or other
ggagctccccgcggtggcggccgctctagaactagtggatcccccgggctgcaggaattcgtctcacccctagaaaaagtccccaacccacgcactgcccaccggtctctctcacacaacacagggatataagcccagtccacgagatctcccgtagaccagtggcgagtgaagggaaggaacgaaacagagcccgatcctagcgacaggccagggaagatcgccatgatgatgatgggcgaaggcgtgagcgtgccgccgtggtcccaccacgtccccgtgagcggcgtcgacgtcggcgtcggcggcggcggcgacgagatgacgccgtacctgctggcggcgctgcggcagtacctgccgtgcaacgacgccggcgccgccgaggcggacgacgaggaggcggcggccatggccgcgggcgtggacggctacggctgcgacgagttccgcatgtacgagttcaaggtccggcggtgcgcccgcgcgcgcagccacgactggaccgagtgccccttcgcgcacccgggggagaaggcgcggcggcgcgacccgcgcaggtaccactactcgggcgccgcctgcccggacttccgcaagggcgggtgcaggcgcggcgacgcctgcgacttcgcgcacggcgtcttcgagtgctggctccacccggcgcgctaccgcaaccagccctgcaaggacgggacggcctgccgccgccgcgtctgcttcttcgcgcacacccgggaccagctgcgggtgctcccgcccacnccgcaacagtctagcggcagccccaggggcgccggggccgctgcccgagtcctacgacgggctcccg

SEQ ID NO: 82125 - protein, 203 aa, Zea mays
  misc_feature: Ceres CLONE 1567844
  misc_feature (115)..(140): Pfam Name: zf-CCCH Pfam Description: Zinc finger C-x8-C-x5-C-x3-H type (and similar)
MMMMGEGVSVPPWSHHVPVSGVDVGVGGGGDEMTPYLLAALRQYLPCNDAGAAEADDEEAAAMAAGVDGYGCDEFRMYEFKVRRCARARSHDWTECPFAHPGEKARRRDPRRYHYSGAACPDFRKGGCRRGDACDFAHGVFECWLHPARYRNQPCKDGTACRRRVCFFAHTRDQLRVLPPTPQQSSGSPRGAGAAARVLRRAP

SEQ ID NO: 82126 - DNA, 846 bp, Zea mays
  misc_feature: Ceres CLONE 1567848
  misc_feature: Encodes the peptide sequence at SEQ ID NO. 82127
ctggagctccccgcggtggcggccgctctagaactagtggatcccccgggctgcaggaattcgtctcacccctagaaaaaaccgcagagagaggagcgagagcgagcgacccccccgagccgtgccaaccaagaaccatccacccaccaccaccaccccggccgcttccttgtccctgcccctccgttggtctcctttgcccatctcatcctctctctctctctccctctctctctctctggcggtcggcgtggctccgggggcgcgaagcgcgggctcggcggggcgactcgccggcggcgacctgcaggtttgggtatgagaggggtcacccacgcggcgcccaccacaagcgccccccgcccccgcggacgcctcatggacggcctcctcatcttcgtcttctacctctcgctgcccacccgtgccggccgcgaccactcgtcaatcgccgcctctaattgttagccgccgccggcacgccattgctcggcccgcctcccgagaagctcgatctgcggcctagccagccagcctcacgcgggatcaggatcgatggaccagccaccgaatggattcgccgccggaggttttttcacgcacattgatgggcaaaaccgttctcccccttctgtaattgtcattggggggagggatttcaggcatcgcagctgcacgtgctttgtcgactgcttcatttaaggtcacactctttggagtccagggaacgacctggtgggccgtgtgcacacctgactattctttcggttgcccaattgacattgggagcatcatgggggccatgggggtttgcaaagaaaatatctttgggcaccactggattaa

SEQ ID NO: 82127 - protein, 48 aa, Zea mays
  misc_feature: Ceres CLONE 1567848
MDQPPNGFAAGGFFTHIDGQNRSPPSVIVIGGRDFRHRSCTCFVDCFI

SEQ ID NO: 82128 - DNA, 796 bp, Zea mays
  misc_feature: Ceres CLONE 1567849
  misc_feature: Encodes the peptide sequence at SEQ ID NO. 82129
ctccccgcggtggcggccgctctagaactagtggatcccccgggctgcaggaattcgtctcacccctagaaaaaaaaacgcacggcacgaggctccccaaattccccatttttacggacaccagcaagccacgccacactcccaatcgccgcagcagctggtcccctgctcggctcgtctgatccagcggctgaatccacaggccatggggttcgacaaggaggcgagctcctcctcctcgcggctcgacgcggcgccgctgctcccgcagcacggcggcggcggcgcgggcgggcacctgtcgtcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctcctcgtcgcagcgcgccgccggatcgcggacgcgcaccccaagatcgcctccttcggggacctgggccacgccatctacggcgcgcccgggcgccacgcggtcgacgccatgctcgtgctcagccagggcagcttctgcgtcggctacctgaatctcatctccaaacacagggcgcacctctacccatcggcatcgggggccagtccccggggtcccgcctcctcagggcaaggcgcccttcatctgggcccaggtggccttccaagttgggccttaatcccatgaggaagttaaagctccttgggccgtttaaaaattttggcaaaagttgttaacccggga

SEQ ID NO: 82129 - protein, 177 aa, Zea mays
  misc_feature: Ceres CLONE 1567849
MGFDKEASSSSSRLDAAPLLPQHGGGGAGGHLSSQPKTFANVFIAVVGSGVLGLPYTFSRTGWAAGTLLLLAVAALTFHCMMLLVAARRRIADAHPKIASFGDLGHAIYGAPGRHAVDAMLVLSQGSFCVGYLNLISKHRAHLYPSASGASPRGPASSGQGALHLGPGGLPSWALIP

SEQ ID NO: 82130 - DNA, 838 bp, Zea mays
  misc_feature: Ceres CLONE 1567852
  misc_feature: Encodes the peptide sequence at SEQ ID NO. 82131
  misc_feature (788)..(788): n is a, c, t, g, unknown, or other
ctccccgcggtggcggccgctctagaactagtggatcccccgggctgcaggaattcgtctcacccctagaaaaagtccgccccttgccccctccctctccgtgtctccgattctggatctgcccatgccgtaacccgcaggctcccggcatctcgctcttgcctccaaaattcaccttcgccgattgccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgtgaccaccgaggaccaccagagcgggacgccgcggaactcgtcggccacgtcctggccgtcgcgcatgctgacgacgaggctgttgccctcccgggcgccctcggcgcggagctcgcacgcgtcctgcgagcgcgcggcgccgctgaggcaccgggcgcgccggcggaggaacaagttgaagtaggtccggaacagaggacagggagggacctaaaattcaagcccaaaggaccaaagcccgaagtttcttttcttccccgcaaagaaagaaggcaagagttctcggcttctcgcaagtcgcgacagagaaagaggcggagttgcggagaagatgcagagcagcagcatgaagagggagatcagcgaggcccacgacaccattcgcttcggcatcaacgccggcgtcaaagcggacctcgccccgccgcacccgaatgaaatccagaaatcatttcttcngtctaaattgaaatagtgtttggtgacaggaaagtctagaataggtgttt

SEQ ID NO: 82131 - protein, 47 aa, Zea mays
  misc_feature: Ceres CLONE 1567852
  misc_feature (43)..(43): Xaa is any aa, unknown, or other
MQSSSMKREISEAHDTIRFGINAGVKADLAPPHPNEIQKSFLXSKLK

SEQ ID NO: 82132 - DNA, 853 bp, Zea mays
  misc_feature: Ceres CLONE 1567854
  misc_feature: Encodes the peptide sequence at SEQ ID NO. 82133
aagctggagctccccgcggtggcggccgctctagaactagtggatcccccgggctgcaggaattcgtctcacccctagaaaaaaggacgacgaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacatccctacttgatccagaggagggtattcgttttaggggcctctcaattccagaatgccaaaaagtgcggccaacagcagttaagggcggcgaacctttgcctgagggtctcctttggcttcttttgacggggaaggtcccaaccaaagagcaagttgatgcactatcaaaggaattgcttgcgcgctcaactgttccagctcatgtctataagacaatagatgctctcccagttagatgcacattcctatgacacaggtttaccacgggagttaatggctccttcaagttggagaagtgaatttcaaaaggccttatgacaatgggaatggccaaaagtcaaaagtttttgga

SEQ ID NO: 82133 - protein, 172 aa, Zea mays
  misc_feature: Ceres CLONE 1567854
  misc_feature: SWISSPROT Homolog: EC 2.3.3.1 Citrate (Si)-synthase
MAFYRGLTAVSRLRSRMAQEATTLGGVRWLQMQSASDLDLKSQLQELIPEQQDRLKKLKSEHGKTQLGNITVDMVLGGMRGMTGMLWETSLLDPEEGIRFRGLSIPECQKVRPTAVKGGEPLPEGLLWLLLTGKVPTKEQVDALSKELLARSTVPAHVYKTIDALPVRCTFL

SEQ ID NO: 82134 - DNA, 821 bp, Zea mays
  misc_feature: Ceres CLONE 1567857
  misc_feature: Encodes the peptide sequence at SEQ ID NO. 82135
ctggagctccccgcggtggcggccgctctagaactggtggatcccccgggctgcaggaattcgtctcacccctagaaaaatcctccccccttcccctctctcgcccctcctccctccgtctcgtctcccaggtcatggcaaaagctggagcaccgggaaaaatagcaagtgggagataaacaggaagagctaggtgaatacttggcagaaaaaggtcccccacaccccccacgcaggtgaatactacaagtagcagtacaaggaagagagccaatctgcccgtgactgccagtgaattgctagggtgtggtggttagttgacgtcacgatgatgggaggcgggctgatgatggatcacagcgtggtgttccctggcgtccacaacttcttggatctcctgctgcaaaacggcgacaagaacctgggcttcgcctcactcatgccgcagacatcctccggcgaccagtgcgtgatgggggagggtgatcttgtggacccaccgccagacagcttcccggacgccgtggaggacgacagcgatgacgacgttgatgacatccaggagctggagcgcctcatgtggcgcgaccgcatgaagctgaatcggctcaaggagctgcagcagaagcgcggctaggatcccatggctagcggtgggagcctagccgacagctcatcccagccatagcagtcgcatgagcacgccctgctcaagaaaatgtcacgcgcgcaggacggcatcctccagtacatgctccaaatgattggacgtgtgcgtcgcaacgagcgtctgtgatagggctatcattcacgtataaagt

SEQ ID NO: 82135 - protein, 102 aa, Zea mays
  misc_feature: Ceres CLONE 1567857
MMGGGLMMDHSVVFPGVHNFLDLLLQNGDKNLGFASLMPQTSSGDQCVMGEGDLVDPPPDSFPDAVEDDSDDDVDDIQELERLMWRDRMKLNRLKELQQKRG

SEQ ID NO: 82136 - DNA, 818 bp, Zea mays
  misc_feature: Ceres CLONE 1567866
  misc_feature: Translation starting site: 231
  misc_feature: SWISSPROT Homolog: EC 4.1.1.1 Pyruvate decarboxylase
ctccccgcggtggcggccgctctagaactagtggatcccccgggctgcaggaattcgtctcacccctagaaaaaaccgaaccaaacaacacacgtcaaagcggaaaacctcagaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcggttccgggggactgcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtggctcaacgccatcgcgggcgcctaacgcgagaacctgcccgtcatctgcatcgccggcgggcccaactccaacgactacggtaccatacgcatcctcaacacaccatcggcctccccgacttctcgcaagagcttcgctgcttccaaaccgtcacctgccatcaggcgggtggtgaaaaacctggatgaaccgccacagcaaatcgaacccggcatttgccacgg

SEQ ID NO: 82137 - DNA, 812 bp, Zea mays
  misc_feature: Ceres CLONE 1567869
  misc_feature (754)..(754): n is a, c, t, g, unknown, or other
gagctccccgcggtggcggccgctctagaactagtggatcccccgggctgcaggaattcgtctcacccctagaaaaaattgcatagcatgggcagcacttccacaccacaccacaccacacctcggctgggcctgggatgggggttgggcagggagccccctccttcctttttttcccctccctcaaaaaagcacacccacacactcttcttcgttccttgaccgagtaaatcctctctcctcctcccgactctcaattgcttcaagcttcatgctttgtcggccccggcccgcccccctatggctcagctcagctcagccaactgctggagtggtagtggttgcttcctctctcttctcacgtcaccatgatcgataagactagctagaatataggtggctggcagtggcagtggcagcgctatcctatatagtgccccccggccggtgtgctcgcctcgggagctagccttggaagaagaagcagagagcagagacaccgttgcgtagagggaggaggagtgcttcttcgttcgtcgttgcccaaagcagcagcagtcacttggaattggaccagagcggcgccgagcgctgccggccggccggccgacctctgtttgtagcggcggcagcaccagctctcaactgctcaagcaaaccaattaaagcagccagcagtctgtcacacacacaggcggaaccgaaccggccaatgtattcttcgtcgccggcctggggagaagcgcgtgagcangcaagagcaggagcccactcttttgcattgcagctgcggcaggagggtttcacagcct

SEQ ID NO: 82138 - DNA, 818 bp, Zea mays
  misc_feature: Ceres CLONE 1567870
  misc_feature: Encodes the peptide sequence at SEQ ID NO. 82139
  misc_feature (364)..(364): n is a, c, t, g, unknown, or other
  misc_feature (384)..(384): n is a, c, t, g, unknown, or other
  misc_feature (388)..(388): n is a, c, t, g, unknown, or other
  misc_feature (389)..(389): n is a, c, t, g, unknown, or other
  misc_feature (404)..(404): n is a, c, t, g, unknown, or other
  misc_feature (540)..(540): n is a, c, t, g, unknown, or other
  misc_feature (565)..(565): n is a, c, t, g, unknown, or other
  misc_feature (566)..(566): n is a, c, t, g, unknown, or other
  misc_feature (624)..(624): n is a, c, t, g, unknown, or other
  misc_feature (671)..(671): n is a, c, t, g, unknown, or other
  misc_feature (752)..(752): n is a, c, t, g, unknown, or other
  misc_feature (753)..(753): n is a, c, t, g, unknown, or other
  misc_feature (773)..(773): n is a, c, t, g, unknown, or other
gtccccgcggtggcggccgctctctaactatgtggatcccccgggctgcaggaattcgtctctcccctcgaaaaaatcgccgtcgaagaagaagggcaagaagaagaagaagtcctcgctgccgggcgccgcaccggcccctcctccggcggagggcgctgcggatacagaagcatgtcccccgctgcccggaaccataaccctaaccgctgccaccgctgtctgcggcggtggttttccgagacagagtcagcagcagcggcgagggctcgacgtgcctatccgcctgcttcaccgcaagctcgtcctgggaacgcgtcctcgcactcctttctctgcccttggtcccccccccgcgtcccanaaagattttcttcgtccggncgcnnccggcaaaaagacgngggactcacctgggtggccgacgattcgccaggccacctttcaacagaatcactccgcctacgcgaggcccgagggggaccctttcgtgggcccgcccggatcctgtcctcccagaaggacacgaccccgccgagnccccgaagccggggcgcagccccgnncggcacggactcttgccggcgaaatgaaatcttggtgagaaaggaagcctggtcgagncccaaaaacggttgccgtgccccttacgcatgggttccccgactgantttggcaaggtacacccacccgcgggttaattctgtatagcttgcaaatggcttgaaagtccgggacgggaagcaatggcnnccggtctggtggcccccaanaacgtgtgaaaaggcaaaacatttctgtgctccatgctccggaat

SEQ ID NO: 82139 - protein, 200 aa, Zea mays
  misc_feature: Ceres CLONE 1567870
  misc_feature (121)..(121): Xaa is any aa, unknown, or other
  misc_feature (128)..(128): Xaa is any aa, unknown, or other
  misc_feature (130)..(130): Xaa is any aa, unknown, or other
  misc_feature (135)..(135): Xaa is any aa, unknown, or other
  misc_feature (180)..(180): Xaa is any aa, unknown, or other
  misc_feature (189)..(189): Xaa is any aa, unknown, or other
SPRWRPLSNYVDPPGCRNSSLPSKKSPSKKKGKKKKKSSLPGAAPAPPPAEGAADTEACPPLPGTITLTAATAVCGGGFPRQSQQQRRGLDVPIRLLHRKLVLGTRPRTPFSALGPPPASXKDFLRPXAXGKKTXDSPGWPTIRQATFQQNHSAYARPEGDPFVGPPGSCPPRRTRPRRXPEAGAQPRXARTLAGEMKSW

SEQ ID NO: 82140 - DNA, 828 bp, Zea mays
  misc_feature: Ceres CLONE 1567871
  misc_feature: Encodes the peptide sequence at SEQ ID NO. 82141
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (502)..(502): n is a, c, t, g, unknown, or other
  misc_feature (560)..(560): n is a, c, t, g, unknown, or other
  misc_feature (635)..(635): n is a, c, t, g, unknown, or other
  misc_feature (680)..(680): n is a, c, t, g, unknown, or other
  misc_feature (698)..(698): n is a, c, t, g, unknown, or other
  misc_feature (740)..(740): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnntaaaagctgggactcaccgcggtggcggccgctctagaactagtggatcccccgggctgcaggaattcgtctcacccctagaaaaagcctttgttccgtctgtgtctgtctatgatgggaccgggacacctagggttcggataccggcaccggctcaactgacgacggactatcgccagtggcgatcaccctccctgtcccctgaccgcggcgtcccctgctcgcgccgcaccggtggcgacaaggcaccccttgcctgctcccctagacgcgagtgagcgagccaacacctgtcggcacaagaatggatgggaatgctgagacgatccaattctcatggggcaagcgtcgagggaaaggtggtgctaagatggatacacagttctttgggtccttcacattggacaatgtgaagtattcactgntttgactgtgtctatctatttaagcatggtgatccctgaaccgtacattgggaaaaantagtgaagatctggggagaaagataaatgataaaaaaagtaaaaaattctttgggtttttcccacccctgatgangattcagaaaatattttaagtggccccctgtgatggggaaaaggnagattttttcttgcctgntggtggaagggtgctggggccttgcaagaatatcaaccccgnctggaaagctgtcgcctggaaaaatgcccctggtttatatggtacctccaaaaggaatgaagaggaaatcggtcaaaaccatcccccc

SEQ ID NO: 82141 - protein, 40 aa, Zea mays
  misc_feature: Ceres CLONE 1567871
MDGNAETIQFSWGKRRGKGGAKMDTQFFGSFTLDNVKYSL

SEQ ID NO: 82142 - DNA, 874 bp, Zea mays
  misc_feature: Ceres CLONE 1567873
  misc_feature: Encodes the peptide sequence at SEQ ID NO. 82143
  misc_feature (226)..(226): n is a, c, t, g, unknown, or other
  misc_feature (344)..(344): n is a, c, t, g, unknown, or other
  misc_feature (376)..(376): n is a, c, t, g, unknown, or other
  misc_feature (439)..(439): n is a, c, t, g, unknown, or other
  misc_feature (440)..(440): n is a, c, t, g, unknown, or other
  misc_feature (533)..(533): n is a, c, t, g, unknown, or other
  misc_feature (534)..(534): n is a, c, t, g, unknown, or other
  misc_feature (631)..(631): n is a, c, t, g, unknown, or other
  misc_feature (632)..(632): n is a, c, t, g, unknown, or other
  misc_feature (653)..(653): n is a, c, t, g, unknown, or other
  misc_feature (669)..(669): n is a, c, t, g, unknown, or other
  misc_feature (771)..(771): n is a, c, t, g, unknown, or other
  misc_feature (834)..(834): n is a, c, t, g, unknown, or other
  misc_feature (835)..(835): n is a, c, t, g, unknown, or other
ctggagctccccgcggtggcggccgctctagaactagtggatcccccgggctgcaggaattcgtctcacccctagaaaaacccttttagcttttagctcgccccttgcgttcgcggaaaaagctcatcttttcaggtggaaggagcgattcgtctgtgcctgcgcctgcgcctgcgcctcgccgggctcgtgccgctgtaccctccttctccaggagacctgtacnggtgaaaggggcgctcccgcgccaaacgggaagcaaagctcgctcgcgcccttttttcggatcatataacgccggcgcctagctcaaacaccacagctcgctgcctagatctacgcgngcagcggcgtcggcagaggagagggacccggnagctgcgccatggggcctaccgccggctccggcgaggacaaggctatgttagagctccggaannaacatcgtgtggaccctggagagactaacaattacatcacgaccgttcaagacattgtcaattcctttgtgttagcccatcgctcagaatttnnggaaagaacatgttcatctgttcctgaaaaaaaggttaccagttaaaaaccgcaaatgccttttgggttgttgggctacttggggtttcctgctcanntgttcactgatgggcctgaantgaaaagcatctgcangaagcctactttggtatgtcagggtttgggattttgtggtggatttaatacctagggggtccgcttcatcccaattggatttaaagttctgggtttgcacanctttttcataatgtatttgggctccccccatgtttgccctgttcactatccaaagcggttcanntgtggggtagggttttgatttggaaaaaggctcctttat

SEQ ID NO: 82143 - protein, 64 aa, Zea mays
  misc_feature: Ceres CLONE 1567873
  misc_feature (18)..(18): Xaa is any aa, unknown, or other
  misc_feature (19)..(19): Xaa is any aa, unknown, or other
  misc_feature (50)..(50): Xaa is any aa, unknown, or other
MGPTAGSGEDKAMLELRXXHRVDPGETNNYITTVQDIVNSFVLAHRSEFXERTCSSVPEKKVTS

SEQ ID NO: 82144 - DNA, 885 bp, Zea mays
  misc_feature: Ceres CLONE 1567874
  misc_feature: Encodes the peptide sequence at SEQ ID NO. 82145
  misc_feature (389)..(389): n is a, c, t, g, unknown, or other
  misc_feature (643)..(643): n is a, c, t, g, unknown, or other
  misc_feature (644)..(644): n is a, c, t, g, unknown, or other
  misc_feature (648)..(648): n is a, c, t, g, unknown, or other
ctggagctcaccgcggtggcggccgctctagaactagtggatcccccgggctgcaggaattcgtctcacccctagaaaaagcggcgcgcagggccagtagcaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaggccgcgtcgtcgctggagagataccctctcgcgacggtgacgggagcngtgaatgggacgggggcgggcccacccagttcgggcccggcgggcgccccggcggggatgaaaggggggaccgaagcagtataacgccgttgggggctgtccaccctccagaaaagcccaagtccgatctcttccccagggcccaaggaatatccaagcccccaatttggcaaccggggggggggggggggaaaaattttggaaaaaaaggatcggtcatggtgggggggggaaaagtggggggaaaaaaaaanngggnaaaaaaaaataaccacccttttaaaattttttggagagggggtaagaaaaaaggggggggcttttttggggggcgaaattgtggtttaaaaaagagtctctcaaagggggaggtttggaaaaaattgttgtttataaaaagggggcaaaaaacaaaataaagttttgtgctctcacgggttttttgcacaaaaacgtggaaaagaagtggggggggagagtcctcccaccaaaggat

SEQ ID NO: 82145 - protein, 120 aa, Zea mays
  misc_feature: Ceres CLONE 1567874
MAYAAPPMASSLTASHPPLSPSHLITHPHRCPARPNPTTGLLRLTPSRRRGRPPVAVRLAISASSTSAPPPSADRSEAASSLERYPLATVTGAVNGTGAGPPSSGPAGAPAGMKGGTEAV

SEQ ID NO: 82146 - DNA, 863 bp, Zea mays
  misc_feature: Ceres CLONE 1567876
  misc_feature: Translation starting site: 162
  misc_feature: SWISSPROT Homolog: EC 5.4.2.1 Phosphoglycerate mutase
ggagctccccgcggtggcggccgctctagaactagtggatcccccgggctgcaggaattcgtctcacccctagaaaaagttccatcgccccccattgctcgccgagagttcttcttgtttgtgcttcggcatgagcacggagcgaaagagtgtctttggcgatggcaagctcctggacacttcctgacgcacccgcaagctccccatcgggaatcccgtggctgctgtcctgctggactgatggggcggaggccaacccccaccagtactactgcatccatgtcgctcatactcctgtcctgcactcgctaatcactggtgctcctgacaaatggacactagtgaaggctcatggaaacgaactgcgggtctcccactctgatgacgcacatcggccacattgaagttgatcactatgcacctggtgctggtcttgattttctcccaacgcgcttatcttgttgatcgagctcttgcctccggaaagatctctgatggacatgggttctactacatcatataatcttttgaaaatggcactcttcaccttatccgggtctcgtagaatgatgatccgtgtccactcccccctcgaccaactactgatactctcttacacgtgtcactgagataccactgatttcttccgcgtgcacctccctacctatagtcgtgactcttattatgcaaccagtgtttctttcgtagacaccctagagaatgatctagcggagcttcgatgcagaggaattcgatgacatattgcatcctgcgatgggaaggatacatgttaccatggaccgtcatcagaatgactgggatgtagatgagctcgtctgagcatgctcacctgctctctagac

SEQ ID NO: 82147 - DNA, 766 bp, Zea mays
  misc_feature: Ceres CLONE 1567877
  misc_feature: Encodes the peptide sequence at SEQ ID NO. 82148
ggagctcaccgcggtggcggccgctctagaactagtggatcccccgggctgcaggaattcgtctcacccctagaaaaagtgtcccgttcctcctcgcccaccaccaccgcacgccggacaaaaccgctctcctcgccacattcgcaggctcgcagccccccctcgctcgcgcacacgccacaccacaccacaccatcagtacactgctctacgccacagtacagcagcatccagcgggcggctggctgcctaatctctccagctctttcgtcccctcgccacgccgcccaccgctgccgcatcatccgcccgttgcccgccgtcgtcgcctggccagcggcttccgcccccattcgccgtcgcagcgcgccgagccccgtcccagatcgccgctgcgcttcctgccgccgtcggcgcggcgcagggttgaaatctatttgaccactcagttataaccatttctggtctgaagatgcttcgtcaatgacatctggaaactgtaatagtatgcgctgatcttctatgcttcaccacctgactatcaatgggctctttcctgtggaaacagcccagctacctcttcattttgataattcttcaccttgttgctcatgaggcaagaacgctgaagtcagatggtgaagcactttctgccctcaagaaggcagttacaaattcagatggagttcttctaaattggcgtgagcaagatgcagacccctgcaattggaaagggtggtagatgggataatcatagtaagaaaag

SEQ ID NO: 82148 - protein, 65 aa, Zea mays
  misc_feature: Ceres CLONE 1567877
MGSFLWKQPSYLFILIILHLVAHEARTLKSDGEALSALKKAVTNSDGVLLNWREQDADPCNWKGW

SEQ ID NO: 82149 - DNA, 822 bp, Zea mays
  misc_feature: Ceres CLONE 1567878
  misc_feature: Encodes the peptide sequence at SEQ ID NO. 82150
ctggagctccccgcggtggcggccgctctagaactagtggatcccccgggctgcaggaattcgtctcacccctagaaaaagccgatcgagatctatccccaatcccttctcccccctccagccgacgggcgccggaggccgacggcgacggggcagcacattgcctctgattgattgatcgacagaagcctcgcgacccggcccccgcttcgccgtgatccggcgacccgaggagtcgagccgagcaccgaaatggggtcgttcaacggccacatcctgccggggacgctgttcctggcggtgggcctgtggcgggtgtggtccgccgtcgcgcgcttcgccgccgacccgccggcgttccgcgtccgcacgtggaaccccctccccaaggggccccggctgctggagctctacttggtggccggcggcgcgttcctggacatgtgcctggagctcggcggcggcatcctcgccggcggcgcccgggtcggcccggacagcctcatctacctcgagcacgccggcatgctgctcatgttcttcctcttcggggcgctcgccctcctctcccagaagacaaggtacctgccgctgaccgacggcgagctgagcctagtggcagcgacggcattcacgtcagagctgcttctcttctcctaccactccgccacccacacggggctagagggctactaccaccaccctcctggtcctcctcatcggcctctgcatcctctccaccggtcctgggcgcgctctcggcggcgagcttccccgcggacttcgccgccggggtgctcctcacgctgcaaagggctgtgc

SEQ ID NO: 82150 - protein, 190 aa, Zea mays
  misc_feature: Ceres CLONE 1567878
MGSFNGHILPGTLFLAVGLWRVWSAVARFAADPPAFRVRTWNPLPKGPRLLELYLVAGGAFLDMCLELGGGILAGGARVGPDSLIYLEHAGMLLMFFLFGALALLSQKTRYLPLTDGELSLVAATAFTSELLLFSYHSATHTGLEGYYHHPPGPPHRPLHPLHRSWARSRRRASPRTSPPGCSSRCKGLC

SEQ ID NO: 82151 - DNA, 818 bp, Zea mays
  misc_feature: Ceres CLONE 1567879
  misc_feature: Encodes the peptide sequence at SEQ ID NO. 82152
  misc_feature (542)..(542): n is a, c, t, g, unknown, or other
  misc_feature (589)..(589): n is a, c, t, g, unknown, or other
ctccccgcggtggcggccgctctagaactagtggatcccccgggctgcaggaattcgtctcacccctagaaaaaaacaagggtgagagagatggtaaccaatacttgatcaaccttattgactcgcctggacacgttgatttttcttcggaagtcacagctgctcttcgcatcaccgatggtgctctggttgtggttgactgtattgaaggtgtctgtgtgcaaactgaaactgtgcttcgccaagcccttggtgagaggattaggccagttctcacggtgaacaagatggacaggtgcttccttgagcttcaggttgagggtgaggaagcgtatcagactttctcccgtgtcattgagaatgccaatgtcatcatggcaacatatgaagataagctccttggtgatgtccaagtatacccagagaaggggacagttgctttttctgctggtctgcacggatgggccttcaccctcactaacttcgcaaagatgtatgcatctaagtttggagttgatgaaactaagatgatggagaggctnatggggtgagaacttctttgaccctgccacaaagaagtggaccaccnagaacacaggttctccctacctgcagagaggaatttgtcagttctgctatgagcccaaatcagcaatcatcaagacctgcatgaatgaccagaagggagaaattgttggccatgctgcaaaaagctccatgtaccatgaaggctgatgagaaaggaattgattggcaaaactttttaatgaagcgtgttatgcaaacgtggcttccaacctagaactgcttctgcttga

SEQ ID NO: 82152 - protein, 182 aa, Zea mays
  misc_feature: Ceres CLONE 1567879
  misc_feature (24)..(164): Pfam Name: GTP_EFTU Pfam Description: Elongation factor Tu GTP binding domain
PRGGGRSRTSGSPGLQEFVSPLEKNKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLMG

SEQ ID NO: 82153 - DNA, 813 bp, Zea mays
  misc_feature: Ceres CLONE 1567880
  misc_feature: Encodes the peptide sequence at SEQ ID NO. 82154
ctccccgcggtggcggccgctctagaactagtggatcccccgggctgcaggaattcgtctcacccctagaaaaaattcagcaatgcatcccgttccactgttccagcttgcacccgacaagccgaacacttcaccctttcccacttcacctccgccgttccgcatctgtggtcaaatacgacgctcgcgtccataccgatccgtgtttgctcattccctctcctcccactcgcttttcctccaaagcgagcgagctaggcgttacgccggagctcgtttgggcggtggtggaggagagaggaaagggaggagatgaaggcggtggagcgagcgaaactggtgaggagcctccggcacgagtcgcggcggctgcgtctactcgtcctcgttatcggtttcttcctcgttactctcaccttcgttgtcgtctccaagcccgacgcgctcctcttcaacctgaacggcaggctgtcggtggaccaggcgccgcgctcgctcttgatccgccagcgggttgacgccgacgaggggagatccgccgaaactctcgcctcagccaccggagatccaaaggtggtcgaagacgatacctacggcgaggaagccagcgccaaagccagagccaacgccaatgcccgagggaccactgctgaggaggaacggatgctcgctagtgagcccgagcagagaaaatgtcacaggaaagctacatctgagattttagctggggaagaccaccgggggagggaaaagcagcaagagggacacaaagagcaccgccagcacaagttgaccctcccaactgttttcgaa

SEQ ID NO: 82154 - protein, 167 aa, Zea mays
  misc_feature: Ceres CLONE 1567880
MKAVERAKLVRSLRHESRRLRLLVLVIGFFLVTLTFVVVSKPDALLFNLNGRLSVDQAPRSLLIRQRVDADEGRSAETLASATGDPKVVEDDTYGEEASAKARANANARGTTAEEERMLASEPEQRKCHRKATSEILAGEDHRGREKQQEGHKEHRQHKLTLPTVFE

SEQ ID NO: 82155 - DNA, 852 bp, Zea mays
  misc_feature: Ceres CLONE 1567888
  misc_feature: Encodes the peptide sequence at SEQ ID NO. 82156
ctctcctcggtggcggccgctctagaactagtggatcccccgggctgcaggaattcgtctcacccctagaaaaagcctcgtgccctcctcctcctcctcctcccagatctcgtgaccattgccattccctccctccgctacacgccgagcgcccccgtccggaccaggcgtctccgcggctcctagtcctcgctccctccctctcccgtggaggactgccgcggggcggcgagggagaggagatccgtcggtgctggctgctggttggtcggctggtcaatccctttccatcgtttgctggtgcgtgagctcagggtttggacagtttggccccgtctgttgcggattggacccggactggattgggttcgtgtggctgccgcgtcggcgggtgctgattccagcttgtcccctcccccctagattgcgcgagacggtgcttcaggactgccccctggcgcggaggccgcacaggctcggcggcgccggcggcgagatgaagggcgcgaccatcccttcggtcgcgatcatgccctcgccgctcttcctctggcggtttaaggttgtgttgtttcttctatggggcttatgttgttgcaagataagttgggactcggttatgagaatgagtgttgatctcagagacttatttctttatgaagctttcttgtactataatcctccttcttcctgtggcccttgatgatttgggtgggggggagtaaaatctatgggttttttgcaccatccttctgtgaattatggcaaaaatggtttgatccttccacaaaaactttttatctcaccgagaaaatatggaaggggtggctaccttggcctgaactttaatta

SEQ ID NO: 82156 - protein, 68 aa, Zea mays
  misc_feature: Ceres CLONE 1567888
MKGATIPSVAIMPSPLFLWRFKVVLFLLWGLCCCKISWDSVMRMSVDLRDLFLYEAFLYYNPPSSCGP

SEQ ID NO: 82157 - DNA, 847 bp, Zea mays
  misc_feature: Ceres CLONE 1567890
  misc_feature: Encodes the peptide sequence at SEQ ID NO. 82158
tggagctccccgcggtggcggccgctctagaactagtggatcccccgggctgcaggaattcgtctcacccctagaaaaatccctggactactcttggtgggtggagactggagagagccacagaaggcaactggaggtttgaggacggcgcgataggcgagccggcgagttcgggtgcttttcctggggtcggagatgcgaccgttgggacctgggaaacagcgcacttcgagttcgggggcggctcccgcgacggcggcagccacctgagcaggatgtttaattggaacgacgagcagcagcaggcaggggatgcaatatgggctgagttcaatgacagtggggaccatattgtgccatatcctaaaggtgtagaagatagtacaatagttagtgccagggacctcaagaacaatgaggaagaggtggctagtattgcttgcatcagtgaacattctacaggtgttcaaactggacttcaagtgatggaaaagcagactgcaaaccagacatgtgcacatttttcagccacacaaattgacatggaatcctggcctgaccttccttccctcaatcctacacttgacagaaactatagtgatgacaacatagcatccacatatctggctttcagtgctgaacccagtttacagaaagtgacagggaaatgctacagggcaaatagatggtgaatcaaaagtgttttggtaatgatcaagaatgaaaagagtaacagtttcccttggattggtaattggggcaaatatttggaaaatttttgatgaatttttaccggccctattttagccatttagtgacctcccttttttggggtaaattgggaaac

SEQ ID NO: 82158 - protein, 138 aa, Zea mays
  misc_feature: Ceres CLONE 1567890
MFNWNDEQQQAGDAIWAEFNDSGDHIVPYPKGVEDSTIVSARDLKNNEEEVASIACISEHSTGVQTGLQVMEKQTANQTCAHFSATQIDMESWPDLPSLNPTLDRNYSDDNIASTYLAFSAEPSLQKVTGKCYRANRW

SEQ ID NO: 82159 - DNA, 812 bp, Zea mays
  misc_feature: Ceres CLONE 1567893
  misc_feature: Encodes the peptide sequence at SEQ ID NO. 82160
  misc_feature (714)..(714): n is a, c, t, g, unknown, or other
  misc_feature (812)..(812): n is a, c, t, g, unknown, or other
ctccccgcggtggcggccgctctagaactagtggatcccccgggctgcaggaattcgtctcacccctagaaaaagggagtgccaatgcctccagcccagcttgcctgccacctggtcttgaccctctcctggataggaggagcagcagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcattgaagaggatgatgatgatgattctgtttcggagagctcttcagcatcattggccaaaccagctggaaactttggatcttggcaagctgacagnagaccacagcctcaccgcagtgtggatccaaaccattcgtatgatcaagtgtttattagatccactcggttactgggagagagatcaaagaaacgcan

SEQ ID NO: 82160 - protein, 151 aa, Zea mays
  misc_feature: Ceres CLONE 1567893
  misc_feature (119)..(119): Xaa is any aa, unknown, or other
MIHDTSSSRASTACHYSPSLVAEEQLHGSKDTLTLKGEKALLELLLGMALDQHVDGRKLITQQEAEDSDFESYLREATSRVLYQPTFIEEDDDDDSVSESSSASLAKPAGNFGSWQADXRPQPHRSVDPNHSYDQVFIRSTRLLGERSKKR

SEQ ID NO: 82161 - DNA, 845 bp, Zea mays
  misc_feature: Ceres CLONE 1567894
  misc_feature: Encodes the peptide sequence at SEQ ID NO. 82162
  misc_feature (547)..(547): n is a, c, t, g, unknown, or other
  misc_feature (711)..(711): n is a, c, t, g, unknown, or other
ggagctccccgcggtggcggccgctctagaactagtggatcccccgggctgcaggaattcgtctcacccctagaaaaaagataaagccaagcccagcgaggccaccaactccacctcgtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcagcggcggcgtccgcgcggtggagaaggacccgatcaagctgtgggagcgctacgtcgagtggctctaccagcacaaggagctcggcatcttcgtcgacgtcagccggatggggttncacggaggagttcctgcggcagatggagccgcggatgcagcaggccttcgtcgacatgcgggagctcgagaagggcgccatcgccacccccgacgagggtcgcatggtgggccactactggctccgcgacccggccctcgctcccaactccttcctccggaacnagatcgagaccgcactcgacaaaatcctcgccttctcccaagatgcatctctgggaaagattcttccccatctggtcgtttcacttcaatctctctataggaatcgggaggtcagcttggggccctcatttgtt

SEQ ID NO: 82162 - protein, 92 aa, Zea mays
  misc_feature: Ceres CLONE 1567894
  misc_feature: SWISSPROT Homolog: EC 5.3.1.9 Glucose-6-phosphate isomerase
  misc_feature (48)..(48): Xaa is any aa, unknown, or other
MEPRMQQAFVDMRELEKGAIATPDEGRMVGHYWLRDPALAPNSFLRNXIETALDKILAFSQDASLGKILPHLVVSLQSLYRNREVSLGPSFV

SEQ ID NO: 82163 - DNA, 785 bp, Zea mays
  misc_feature: Ceres CLONE 1567895
  misc_feature: Encodes the peptide sequence at SEQ ID NO. 82164
  misc_feature (103)..(103): n is a, c, t, g, unknown, or other
  misc_feature (275)..(275): n is a, c, t, g, unknown, or other
  misc_feature (289)..(289): n is a, c, t, g, unknown, or other
  misc_feature (292)..(292): n is a, c, t, g, unknown, or other
  misc_feature (301)..(301): n is a, c, t, g, unknown, or other
  misc_feature (321)..(321): n is a, c, t, g, unknown, or other
  misc_feature (325)..(325): n is a, c, t, g, unknown, or other
  misc_feature (329)..(329): n is a, c, t, g, unknown, or other
  misc_feature (330)..(330): n is a, c, t, g, unknown, or other
  misc_feature (339)..(339): n is a, c, t, g, unknown, or other
ctgagctcaccgcggtggcggccgctctagaactagtggatcccccgggctgcaggaattcgtctcacccctagaaaaaaccctcccccaccgcctattgctnctagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgcccatgtgtggcgtcngtgctccaagaccngcngtgtcgacngcctcccgccggggcctccnggtngccnngtggtgggnaacctgtttccagatgatcttgcagcgacggccctttcatgtacgtgggtgcgcgaccctccgggaaaaagtacgggccccttcttcaccatggcggatgggggcaacgccacccctccttcgtggtccaccctcgggggaaactctattcccccaaagggcctcgggttaaaaaaagggccccccttggtttccccaaacccggcccccaaggaaaaaccccccccccccccctcccttttttaaggttttgggaaaatggtcaccccttataaattgggggcccccctaagggcccccctctttgtgtgggttttttttttgcccccaaaatttttttttttccccaaaaaataattttttccccccccaccccccccctaaaaagggggtttttccccccgttaaacccccggaaaaagatggcccccctcgcgaaaccccac

SEQ ID NO: 82164 - protein, 124 aa, Zea mays
  misc_feature: Ceres CLONE 1567895
  misc_feature (22)..(22): Xaa is any aa, unknown, or other
  misc_feature (27)..(27): Xaa is any aa, unknown, or other
  misc_feature (28)..(28): Xaa is any aa, unknown, or other
  misc_feature (31)..(31): Xaa is any aa, unknown, or other
  misc_feature (39)..(39): Xaa is any aa, unknown, or other
  misc_feature (40)..(40): Xaa is any aa, unknown, or other
MDVNDVLLVVLAAALAAHVWRXCSKTXXVDXLPPGPPGXXVVGNLFPDDLAATALSCTWVRDPPGKSTGPFFTMADGGNATPPSWSTLGGNSIPPKGLGLKKGPPLVSPNPAPKEKPPPPPSLF

SEQ ID NO: 82165 - DNA, 780 bp, Zea mays
  misc_feature: Ceres CLONE 1567896
  misc_feature: Encodes the peptide sequence at SEQ ID NO. 82166
ctccccgcggtggcggccgctctagaactagtggatcccccgggctgcaggaattcgtctcacccctagaaaaaatcagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctggggctcacctacctgccggggggccagcacctgccgctgtggcgcgcggacggcgccgcgctcatcggcctgctgcacgccggccccgtcgagctcgtctactactgggctgaacccggcgcttaaacaccactttcctctattcccggttccattccaacaacaaggcttcattgttaccgagccattcacctccgccatccatccattttcctgaacccggggcctataaacttttgttccaaacccctttgatttggtggccctttagaggaaacggctttaatttttgccctttaaaaattaacgcgac

SEQ ID NO: 82166 - protein, 149 aa, Zea mays
  misc_feature: Ceres CLONE 1567896
MATNPGLFTEWPWKKLGNFKYLLLAPWVAHGGYQAATKGWRAADLGYVAILPSLLLRALHNQAWITASRLQSARGRRQVVDRGIEFEQVDRERNWDDQILLSGILLYLGLTYLPGGQHLPLWRADGAALIGLLHAGPVELVYYWAEPGA

SEQ ID NO: 82167 - DNA, 826 bp, Zea mays
  misc_feature: Ceres CLONE 1567898
ctccccgcggtggcggccgctctagaactagtggatcccccgggctgcaggaattcgtctcacccctagaaaaagagagaggccaatgcgagggagtagctcgcggcggaccagagaccagagagcgagagcgagcaaagctcacaaggcgaagcggaattgattgcgaccaccaccaccacgtcttctccacctccgtccgatccgtcgtcaccaagccaccatcattggcgccaccgcgccgcccgcccagctgcgcattcttaactgtttctctcttggcttatcggcgaagtgttgcggttgcgggggtactggagtgcggagagcagcgcggcggtacgtgtgcgttgctgcgctgtgctgccacagtgagctaggggagagcgagggggaggaagcaccacccaccacaccacctccattaaaggcgctcacgcgccgcccctccgcctccacgagaaagcgaggcgggagcgagtgagcaggggcgtacgtccgtcgtcaaggccatctctctcctcctcacttcctcccctcacggggacagccacgtacaaaggcagctcgccaacgcccagcacctccctcgccgtgcgcctttaaagacagcgcgcgacaagcttaaaggttcccacgccgccgttcgctcgcgctgctctttgcgccacgacgcggttgatcggtgcttttgatctgttccttcttgttgcagctgcagaggaggtgacacagaggccagagccgtcgcgcgcgtgcgaaacgaaagcagagagagcggcaatggcggtgaccgcgcggctcggcgcggtcgtggcgtgcgtct

SEQ ID NO: 82168 - DNA, 823 bp, Zea mays
  misc_feature: Ceres CLONE 1567909
  misc_feature: Encodes the peptide sequence at SEQ ID NO. 82169
  misc_feature (786)..(786): n is a, c, t, g, unknown, or other
ctccccgcggtggcggccgctctagaactagtggatcccccgggctgcaggaattcgtctcacccctagaaaaaattccccatcagagatctctccccatcaccaagccgaaccgagaccgagagagcttccccacacccacagcggggtgcagcggatcgcgccaaattcgaccgaacaatcgcgcgccactcggccccgccactatgagcttctcgtccatgagcaaacagcaggtgctggacgccggtgacggggagggggaagaggtcgtggagcttatcccgggcctgccggaagaggtggccgagaagtgcctcctccacctgcccttcctctaccaccgtctcttccgcaccgtctcctccacctggaaccgcttcctcaccgactcccctgccaagccgctgctgttcactcccgcggagggggcgggggctggcgcggggagcgcagccatgggctcgttgtccttatcgctgcccttcctcttcgccttcgcgtttgaccctgtgtcgcgacgcctccagtgccaggcgctcgaccctttctcgaggaggtggctcctgctcccgccggtgcccggcggcgccgcggccgggtcgtttgcggtggtggggctccccccgccgcgcgagatctacgtgattgggggcgtccaagaaggcagcgaacaagcggtgacgagcgtgggccgtgtcagcgccccgccgaaaacgatgggaagaaggcggcggctatccgaagcccccccggtacatggcgctgggagggaggcaccccccntggggggtttttcccccccgaaaacaccccgtagtcc

SEQ ID NO: 82169 - protein, 205 aa, Zea mays
  misc_feature: Ceres CLONE 1567909
  misc_feature (24)..(71): Pfam Name: F-box Pfam Description: F-box domain
  misc_feature (194)..(194): Xaa is any aa, unknown, or other
MSFSSMSKQQVLDAGDGEGEEVVELIPGLPEEVAEKCLLHLPFLYHRLFRTVSSTWNRFLTDSPAKPLLFTPAEGAGAGAGSAAMGSLSLSLPFLFAFAFDPVSRRLQCQALDPFSRRWLLLPPVPGGAAAGSFAVVGLPPPREIYVIGGVQEGSEQAVTSVGRVSAPPKTMGRRRRLSEAPPVHGAGREAPPXGGFSPPKTPRS

SEQ ID NO: 82170 - DNA, 724 bp, Zea mays
  misc_feature: Ceres CLONE 1567910
  misc_feature: Encodes the peptide sequence at SEQ ID NO. 82171
  misc_feature (474)..(474): n is a, c, t, g, unknown, or other
ctccccgcggtggcggccgctctagaactagtggatcccccgggctgcaggaattcgtctcacccctagaaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccagggcctttgcaggctgcaagcattcccaggactccnttggggattttttcagaaacgagtggggatgctcctcatgctttcctaaatttttgcttttggaagcagcaaccttcccccccggaaggacaaagaaacctttttgtccttggggcccccctcccacccacaaaaaaaaaaaatttttccccttgccggggggtggtttttttcccccccccgggtttatttttaaaggggggaaaaaaaaaagggggggagaggggtttaaaaaccccctatttttggt

SEQ ID NO: 82171 - protein, 156 aa, Zea mays
  misc_feature: Ceres CLONE 1567910
  misc_feature (74)..(74): Xaa is any aa, unknown, or other
MICAISGEVPDEPVVSKKSGLLFERRLIERYIEDHGKCPITKDELTMDDIVPVNTNKVVKPRAFAGCKHSQDSXGDFFRNEWGCSSCFPKFLLLEAATFPPGRTKKPFCPWGPPPTHKKKKFFPLPGGGFFPPPGFIFKGGKKKRGGEGFKNPLFL

SEQ ID NO: 82172 - DNA, 839 bp, Zea mays
  misc_feature: Ceres CLONE 1567915
  misc_feature: Translation starting site: 208
ctccccgcggtggcggccgctctagaactagtggatcccccgggctgcaggaattcgtctcacccctagaaaaaagccggctcgaccgacgagacgacaacgccgccgtgccgcgcgcacgcccgacgctcgacgatcacgccctccgctcggccccggtgaggcagcgaacgcccgccacacgtacagataccgtgcgcgcccggcatgggggtgaccaccgccggggaggccgtctgtaagtccccggcgcgggcctcggtcatcgtgaggcacaacgccgcgtacttcgccttcttcctcttcgcctacgtggagctcctcctccaccacgagtactcgggcctcttcgaccgcggcgccacctccctcgtccgatgcaccttccgagactcctgcccgccgccgtcgccgtcaaacagcagctctcacagaagctggtaggcgtggctgcgaacaaggaggcggatgaggagctcatcgtgaacgcaggacgcgctgcggccatgttctactagctctcgcgacggctgcatatgggctggatacaaaatgtgagcaaccagctgctggcgctgggcgtggagggcgacgcggtgcccgtggacttccagcgcgtggcggacgcgttccggtgggcggacctgttcccggagtggatcgacgagggaggaggacgaccaggggccctcctgcccggaactgcccatgccggactgggccccggacgggcggcaactggacattggggggggggggtttctttccgtgcaaccccaagggcgcccgggggggaacccgggacggggttcaggctggcgggtgccaccggggggcgg

SEQ ID NO: 82173 - DNA, 1184 bp, Zea mays
  misc_feature: Ceres CLONE 1567917
  misc_feature: Encodes the peptide sequence at SEQ ID NO. 82174
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (641)..(641): n is a, c, t, g, unknown, or other
  misc_feature (736)..(736): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (762)..(762): n is a, c, t, g, unknown, or other
  misc_feature (772)..(772): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (782)..(782): n is a, c, t, g, unknown, or other
  misc_feature (783)..(783): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (812)..(812): n is a, c, t, g, unknown, or other
  misc_feature (813)..(813): n is a, c, t, g, unknown, or other
  misc_feature (822)..(822): n is a, c, t, g, unknown, or other
  misc_feature (839)..(839): n is a, c, t, g, unknown, or other
  misc_feature (843)..(843): n is a, c, t, g, unknown, or other
  misc_feature (864)..(864): n is a, c, t, g, unknown, or other
  misc_feature (912)..(912): n is a, c, t, g, unknown, or other
  misc_feature (913)..(913): n is a, c, t, g, unknown, or other
  misc_feature (969)..(969): n is a, c, t, g, unknown, or other
  misc_feature (1156)..(1156): n is a, c, t, g, unknown, or other
  misc_feature (1184)..(1184): n is a, c, t, g, unknown, or other
gggggtggtttgttggtggccaatttacccccgctcgggggcgaacgcgaccccatacacnnnnnnaannnnnaaaatggagctcaccgcggtggcggccgctctagaactagtggatcccccgggctgcaggaattcgtctcacccctagaaaaaaccgggcacacaccatcacagtacacacacacacacgcacacgctcatcaagcttctctctcgcctactcggctgcaatggcgcgcttccagctcgcggccctggccatggcaatgctcttcgccgccgcggcggcgcaggccccggccgccaccccgacgccggctcccaaggcgtcttcccttccaccccggcccgggtaaaccgcccgccttccgaaggccccgcaaccccgccggcccgtccccggagccccaggtggtggctgcccggtcaaattatttggacaaggcttcccccggcacctagtaccatatcctcagggggtccctcacctcccctccggagagagagccgtgatttgtattatattattaatttatataagaggaaggacgcgtaacaacatcagcctgtccccccgacaccaatagtatattagaatctataacggcaagggacaggacaacagaacctccaatcanctcttggggtagcccgttaaaaatctcttgctcttgcccgcgttaggtaaaaaacgtagtacgccgcaaaacccctcaactccccggcgggagcntcnnncccnnnnnnnnnnnnacgccnccagctaggncnnnggaggnnagatnnnnnctcatttgaggtgagagccnnagggtaatnaccaatttcttccttcntcanacacctgtccccgttaatcancaagagaggccaacgatttatcgctccccgttcctaaacgtagaaggnnaatccattgtcaggggacaagaacctgatggaagggtatttgcgctgcggtgggangcacaccacttcggcaccccccgtagtgctcccgctcctactcgagagggggtgctgagtgtatcttgtaatactagatatgatatggcctctccccctacatatctgctgaggccgacgtcaaaagcgaggaggggagaattaacccagataacgtctataaattaactcgtgagagcaggagtcngaggataattacaattaatatatttgtn

SEQ ID NO: 82174 - protein, 41 aa, Zea mays
  misc_feature: Ceres CLONE 1567917
MARFQLAALAMAMLFAAAAAQAPAATPTPAPKASSLPPRPG

SEQ ID NO: 82175 - DNA, 831 bp, Zea mays
  misc_feature: Ceres CLONE 1567918
  misc_feature: Encodes the peptide sequence at SEQ ID NO. 82176
  misc_feature (624)..(624): n is a, c, t, g, unknown, or other
  misc_feature (625)..(625): n is a, c, t, g, unknown, or other
  misc_feature (717)..(717): n is a, c, t, g, unknown, or other
  misc_feature (737)..(737): n is a, c, t, g, unknown, or other
agctccccgcggtggcggccgctctagaactagtggatcccccgggctgcaggaattcgtctcacccctagaaaaaagatgccggccacaacgacgtactagctagcttagctagctcgttcgatcgcgtgcgtcgttccacaccgacgagcggcatggaggcctccgccaaactgcccgtcgtcgtcccgaagggcgtcggcggcatggacaacgacgacgtcgcggcggcgggcggcaagaagcaggcggcggcgggcaggtgggggttcgtgcagttcttcttcgtgctcgccgtcgtcttctgcgtgctcctctacgcaccgcgcgtcctcgtgctcagcccgtacgggtacagcatcgacgtcgggctcttcgcgccgacgccgacggcctcgtcggtgccgcagcgcgtcgccggaggcaatgcggtggcccttgacaaccaggtgcgctcgccgtgctcgtccatgcgcgaccacaccatctgctgcgaccgctccagcgtgcacacggacgtgtgcttcatggccggcgacgtgcgcacggacgccgcgtcgctgtcgctcctgctgttcccgccgcaccagcaggcgcagaacggcacctcggaagaagacaaannagagagggtgcggccgtaccccgcggaagtgggagcgcctcatcatgggacagggtccccgaggtgcggctcccttgtggcggcgcccccgncgcccgaatgggaacccggnaaaaaagtggaacccccgggggcaactttaggaacaacccgcccgtttgccccccagtggccccggggggggttcccccgggaacctggttccc

SEQ ID NO: 82176 - protein, 225 aa, Zea mays
  misc_feature: Ceres CLONE 1567918
  misc_feature (157)..(157): Xaa is any aa, unknown, or other
  misc_feature (188)..(188): Xaa is any aa, unknown, or other
MEASAKLPVVVPKGVGGMDNDDVAAAGGKKQAAAGRWGFVQFFFVLAVVFCVLLYAPRVLVLSPYGYSIDVGLFAPTPTASSVPQRVAGGNAVALDNQVRSPCSSMRDHTICCDRSSVHTDVCFMAGDVRTDAASLSLLLFPPHQQAQNGTSEEDKXERVRPYPAEVGAPHHGTGSPRCGSLVAAPPXPEWEPGKKVEPPGATLGTTRPFAPQWPRGGFPREPGS

SEQ ID NO: 82177 - DNA, 852 bp, Zea mays
  misc_feature: Ceres CLONE 1567919
  misc_feature: Encodes the peptide sequence at SEQ ID NO. 82178
ggagctccccgcggtggcggccgctctagaactagtggatcccccgggctgcaggaattcgtctcacccctagaaaaagatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatactgcctttaagtttggtcctgacgttgactttgttctgacttacaccgatgaggatggtgatattgtcatgctagatgatgatgatgacttgcgtgatgcagctctccgtcagagataaaccctctcaggattactgttcaactgaagaaaaatcacccaactgaaaaaaaaagatactttctgcaccagtggaaatccgctgctcaggatcccctatcccagttaatgtcagctattgaagggtttgaagcctgttcagggaagatagcctgggcccatataaatcagctaattgggtgaagcaatcaaggtctatcccagaagccaatacctggatgctcttggcaaacttttttcatgaaaaactttgatgccgcaccaccccccaataggctggagctgac

SEQ ID NO: 82178 - protein, 97 aa, Zea mays
  misc_feature: Ceres CLONE 1567919
MSDWSSPAAPTFFPFGPQAEGWDVTFKVKYGDTLKRFYGCANGSHFDMNLSALRARIDTAFKFGPDVDFVLTYTDEDGDIVMLDDDDDLRDAALRQR

SEQ ID NO: 82179 - DNA, 792 bp, Zea mays
  misc_feature: Ceres CLONE 1567920
  misc_feature: Encodes the peptide sequence at SEQ ID NO. 82180
ctccccgcggtggcggccgctctagaactagtggatcccccgggctgcaggaattcgtctcacccctagaaaaactcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcactttggcgaagacatggtgcgcaccatcgctatggacggcacggaaggggctcgtccgcggcccagcgcgtccctcaaaacgggctccccccatcacccgtgccttgttgggcaaggcctccccctgggacgtatcattaatggttatccggggaaccaattggattaaaaaggttgattttacgacaaaaccacttccctcccttatccatcggggaacccccctgcctttcttttgagcagggccccctgaaccacaaaattttttggttcactgg

SEQ ID NO: 82180 - protein, 179 aa, Zea mays
  misc_feature: Ceres CLONE 1567920
  misc_feature (85)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHFGEDMVRTIAMDGTEGARPRPSASLKTGSPHHPCLVGQGLPLGRIINGYPGNQLD

SEQ ID NO: 82181 - DNA, 853 bp, Zea mays
  misc_feature: Ceres CLONE 1567921
  misc_feature: Translation starting site: 270
ggagctccccgcggtggcggccgctctagaactagtggatcccccgggctgcaggaattcgtctcacccctagaaaaaccggtggcttctcattcattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaggccctccgcggctgggcgccgcgccgcgccgacacgttcgagaagcttaataaggatcgggcacgtacagcaacgtgtaccgggcgagggacaccgtctctggccggatcgtcgctcttaaaaaagtccgcttcgataacctcgagccagaaagcgtcaagtttatgggcccgggaaaatactgatccctaaaggagactcgaccaccccaaacatcatcaaaattagagggcctgggtccccctccaggaaggtcatgccacccttttacttttgtcttccgaatccttgggagcatgaatcttgctgggccttgcgggaaagta

SEQ ID NO: 82182 - DNA, 795 bp, Zea mays
  misc_feature: Ceres CLONE 1567923
  misc_feature: Encodes the peptide sequence at SEQ ID NO. 82183
ggagctcaccgcggtggcggccgctctagacctagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttcaccttccacggcgaagccggcggctggtatggatcccaatggcctcaaaactggaggccttttgctcccgaccatcgagaggcggtgcacgtcgcctccatccgtcattgtcatcggcagtggcatctcgggcagtgcagctgcccgtgccctctccaattcttcatttaaggtgactggtttggaaatcaagagatcgtatggggcgggcgcattcatacgtgataactcgtttggatgccccaattgatatgggagcctcatggctaacccggccgtgtgcattgagaattccccgggccccattgaataacctatcttgggggctgagggttataccgca

SEQ ID NO: 82183 - protein, 73 aa, Zea mays
  misc_feature: Ceres CLONE 1567923
MDPNGLKTGGLLLPTIERRCTSPPSVIVIGSGISGSAAARALSNSSFKVTGLEIKRSYGAGAFIRDNSFGCPN

SEQ ID NO: 82184 - DNA, 882 bp, Zea mays
  misc_feature: Ceres CLONE 1567924
  misc_feature (369)..(369): n is a, c, t, g, unknown, or other
ggagctccccgcggtggcggccgctctagaactagtggatcccccgggctgcaggaattcgtctcacccctagaaaaagccagcgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaactctaatttggtcagatgggatttccaacttcgacaaagcccgcgaggtcgatcgatctcagttgacgcgaggggattggaaaactagttgcnggggtgtagtaatttttctaggaagatggggggtttcaggctcaaacttccatggcttcaacgctgaggacgaaccctgggcgggagaataaccaagaatctttcttgccaaccggggaaccccccgggttcttttgtcaaatttcgggccggtttgggaacccccaacccaagggtaaaccggggaaaaatctttcccggggaggagggaaagtttccccttttaaaactttaaaaccaaaaatttggcggaagaaattttggggccctagaaggaaaccccccgggaaaaattttaaaagggggggcggcgggaggaaattttcgcccaaaaaacccctttttggggggggggggggaacccccttttttgaaaaaagcctcctatttcctcccaaaaaaaaagggggttcttcccggaaaaaaaacccctcttaaggggggggaatttttttggtgttcaccaccccccccccttttttttttataaaagaaacacccctttgggggacc

SEQ ID NO: 82185 - DNA, 817 bp, Zea mays
  misc_feature: Ceres CLONE 1567930
  misc_feature: Encodes the peptide sequence at SEQ ID NO. 82186
ggagctccccgcggtggcggccgctctagaactagtggatcccccgggctgcaggaattcgtctcacccctagaaaaaaactccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgtggcagctgcccctgctgctggcggcgctcctgcagctgaggcgaagaaagaagagaaggtggaggagaaggaagaaagtgatgacgacatgggcttcagcctcttcgactaagcctgtgcaatagtcaagagtattgtttttgagtcgcggaagcagagggaagaaaaatcgtagtcatgtttggactttaactttgttttatgttggaaagtacttgaaagacttttcctgtggtaattctaggcgtaggttgctgtgctggttggggtttactggtgaaccagagtttttctatctcccactatgaatttgttacctcaagttacctggatgttcactattttgttggtacaaaaaaaaaaaaaaaaagaagcaggatacagagcggggcgtacggagataccaggttccaagcgaag

SEQ ID NO: 82186 - protein, 111 aa, Zea mays; identical to SEQ ID NO: 60604
  misc_feature: Ceres CLONE 1567930
  misc_feature (17)..(110): Pfam Name: Ribosomal_60s Pfam Description: 60s Acidic ribosomal protein

SEQ ID NO: 82187 - DNA, 820 bp, Zea mays
  misc_feature: Ceres CLONE 1567932
  misc_feature: Encodes the peptide sequence at SEQ ID NO. 82188
  misc_feature (751)..(751): n is a, c, t, g, unknown, or other
  misc_feature (800)..(800): n is a, c, t, g, unknown, or other
ctccccgcggtggcggccgctctagaactagtggatcccccgggctgcaggaattcgtctcacccctagaaaaaaagacgcgcgcgccctgtgctccccctcagtcctcgctggtcctttctccatcacaaacgctagtcttttcctaaagctcggagaccgccggaagcgagcgatggcgtgcaagacgaagagcctgctgttggcgctcagcgtggcggcgctgctcgcggcgcggtcggagtcccacggcctgggggacttcacgagcgggagcgacgaggcgacgacgacgccggagatgcagaccttcttcaagccccaggccgccgcggcgctcccggaggccctcgacgcctccatgcccgccaagccggaggccacggcgctcccggccaccaccaccaccgccgccgtggcgtacgtggtggtgcgcggcgcgcggcgcgggacggaggtgcagctcggttagctcctccaccgtgagccccgtccggccgggcccgcgtcataggccgtcgtcgtcggcgttaggatctgggttaagcgcgttgtttagctttgcgattttgtgttttagtcgatctgcagactgggcttgcttttgggtcggcggttgtattctttcgtacgtgtcgtgtcgctaccgagtacgtacggaccagcacagtggtgcatgtgtgacataaataaatgctggttgtagcgtcgtcgtggtgtctagagtctagaactttgctattgctgcatngaggatttttgctgtaaaaaaatcgccgtatctccttttcccctctccntgcgtccccgggtccggcga

SEQ ID NO: 82188 - protein, 98 aa, Zea mays
  misc_feature: Ceres CLONE 1567932
MACKTKSLLLALSVAALLAARSESHGLGDFTSGSDEATTTPEMQTFFKPQAAAALPEALDASMPAKPEATALPATTTTAAVAYVVVRGARRGTEVQLG

SEQ ID NO: 82189 - DNA, 806 bp, Zea mays
  misc_feature: Ceres CLONE 1567934
  misc_feature: Encodes the peptide sequence at SEQ ID NO. 82190
ggagctccccgcggtggcggccgctctagaactagtggatcccccgggctgcaggaattcgtctcacccctagaaaaatccgcgcgccgaggatcttctacccagccatcaacgccctcctccatcaacggaaggtggccgaggatccgccccaccctcctccccacgccgtcgtcgatggaaggtgcgatctcctacccctctgctccactatcaacgccctcctccatccccttccattgttgccgctccgccaccacaccacgtttcccaaacgcgcagatccgaggatccgccatcaacgccgcgcccaccctcctccccctctgctccgcgacgacaggggtctgaggccgccatcaacgccctcctccccacgccgtcgatggcgcgcgcagatccagtctccttcaggcaacaccgcgccatcagcggaatctccttccgccatcagcagaaggtgctgaggatcttgggcaagcaggagaggggggagaggaggccaaggacacaaccgcgaagccaaactcatccaatccagtcccttctgtcggccgcacctcgacggcttcaccgtgcccccgccacatcgcgaccatggcgaaggagcaggctggctagccctcggtccgcctcagcccgccgccagaagagataagatacgcatagcggagcttggaagccttgctgtacaacaaagatgggtcggagcgggtggatccgaaggcactttcctctggcgtgaaaggatcttcagtcgaaagctagatgtgggtactggcaaaatgcttgactgaaaaggaatt

SEQ ID NO: 82190 - protein, 90 aa, Zea mays
  misc_feature: Ceres CLONE 1567934
MARADPVSFRQHRAISGISFRHQQKVLRILGKQERGERRPRTQPRSQTHPIQSLLSAAPRRLHRAPATSRPWRRSRLASPRSASARRQKR

SEQ ID NO: 82191 - DNA, 864 bp, Zea mays
  misc_feature: Ceres CLONE 1567936
  misc_feature: Encodes the peptide sequence at SEQ ID NO. 82192
  misc_feature (456)..(456): n is a, c, t, g, unknown, or other
gagctccccgcggtggcggccgctctagaactagtggatcccccgggctgcaggaattcgtctcacccctagaaaaaagccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggcctctccatctgggattcattcgcgcacgtcccaggaaatattgcnaggaaatcaaatggagacgttgcagtggatcaataccatcgctacaaggaggacgtcgatctcatgaaaagtttgaactttgatgcctacgggttctcaatctcatggtcccaggatcttccccggatggcgaaggggaaagtcaaatcccgaaggggtaggcgtattacaataaatttgataaactatcttgcttcagcaagggctggacttccttacatccacctttgacccctatggatccttcctctttgcgccttgaagagaaaatatgggagggggggttaaacccccaaagatggggggaactttttttaacggaactattcctggccttttggtttttaagaactctacgggggaaatccgctaaaaaggcccgggtttttacttttcaaggggggccat

SEQ ID NO: 82192 - protein, 156 aa, Zea mays
  misc_feature: Ceres CLONE 1567936
  misc_feature: SWISSPROT Homolog: EC 3.2.1.21 Beta-glucosidase
MDARWAVLLALLVASGGVRVCAAAGAKGANWLGGLSRASFPKGFVFGTATSAYQVEGAASTNGRGLSIWDSFAHVPGNIARKSNGDVAVDQYHRYKEDVDLMKSLNFDAYGFSISWSQDLPRMAKGKVKSRRGRRITINLINYLASARAGLPYIHL

SEQ ID NO: 82193 - DNA, 802 bp, Zea mays
  misc_feature: Ceres CLONE 1567937
  misc_feature: Encodes the peptide sequence at SEQ ID NO. 82194
  misc_feature (593)..(593): n is a, c, t, g, unknown, or other
ctggagctccccgcggtggcggccgctctagaactagtggatcccccgggctgcaggaattcgtctcacccctagaaaaagcggcgcgcagggccagtagcaaccctcccatggcctacgctgcgcctcccatggcgtcgtccctcaccgactcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcgatcggaggccgcgtcgtcgctggagagatacctctcggcgacggtgaccggagcggtgatgggaacgggggcggccccaccagcttcagccccgccgcgcgccccgccggcgatgaaggggggaccgaagcagtatagcgcgttgggggctgtcacgctcaagaaggccaagctcgatctctcccagcgccgcaagaatatcatgcccgagttggcgacacgcggtggtggtggagatattggaaaaacgacgtacgtncggggggtaatttttttccccacaaaatccccaatggtaacggtggggacatgctttaattgagaagaatcctggatgtactaaaaacgcctgcaaaaaagctagtgttgtggtcgggtgtacaagaagctattcaataagggaagttccgtagaaagctgtggttgcaaccatgtggttggtccctcaattaaccaggaggtcccaaa

SEQ ID NO: 82194 - protein, 174 aa, Zea mays
  misc_feature: Ceres CLONE 1567937
MASSLTDSHPPLSPSHLITHPHRCPARPNPTTGLLRLTPSRRRGRPPVAVRLAISASSTSAPPPSADRSEAASSLERYLSATVTGAVMGTGAAPPASAPPRAPPAMKGGPKQYSALGAVTLKKAKLDLSQRRKNIMPELATRGGGGDIGKTTYVRGVIFFPTKSPMVTVGTCFN

SEQ ID NO: 82195 - DNA, 905 bp, Zea mays
  misc_feature: Ceres CLONE 1567938
  misc_feature: Encodes the peptide sequence at SEQ ID NO. 82196
aagctggagctcaccgcggtggcggccgctctagaactagtggatcccccgggctgcaggaattcgtctcacccctagaaaaattaaacagagaaactatgtggaaaaattttcaaattaccaaacccttgctgagcagcaaacaccaaagttcatggtggttgcttgtgctgactccagggtctgccctaccgctgttttggggtttcagcctggggaagcatttacagttcgtaatgtggcaaatttggtaccaccatatgagcatggggggacagagactagtgcagcactagagtttgctgtcaataccctccaggtagaaaatgtactggtgataggccacagtaggtgtgggggcatccaggcactaatgagcatgaaagatgattcgacctccggaagcttcattaaaaactgggtttcaattgggaagaggcgcaggttaagcacgaaagctgcagctggaaatatgagttttgacatacagtgcaaacattgtggaaaaggaatcgcgtctccctatcccattcccaaataaatccccacctcccggttgctggttccggccgcccggccagggcctctcctcaccttgggggttcaattttaatccctcttccccgcagggccttcctcattccagggagccggaatccgttttttcccaccccccggggggtttttcccgggcaaaccttggcgggggttggggaaaccaggggggcgggcagatggggccccccggcgggcccggggccccctgattggggggggcccccgcgggggggggggaaatgtttggagcgccgcggagaacccgctgtgagaaaattgggcccccctggcggccattttgcgaccacggagaaaaaggcattttttctcgccgggggcggatgaaa

SEQ ID NO: 82196 - protein, 128 aa, Zea mays
  misc_feature: Ceres CLONE 1567938
  misc_feature (1)..(129): Pfam Name: Pro_CA Pfam Description: Carbonic anhydrase
  misc_feature: SWISSPROT Homolog: EC 4.2.1.1 Carbonate dehydratase
MVVACADSRVCPTAVLGFQPGEAFTVRNVANLVPPYEHGGTETSAALEFAVNTLQVENVLVIGHSRCGGIQALMSMKDDSTSGSFIKNWVSIGKRRRLSTKAAAGNMSFDIQCKHCGKGIASPYPIPK

SEQ ID NO: 82197 - DNA, 845 bp, Zea mays
  misc_feature: Ceres CLONE 1567943
  misc_feature: Encodes the peptide sequence at SEQ ID NO. 82198
  misc_feature (653)..(653): n is a, c, t, g, unknown, or other
  misc_feature (685)..(685): n is a, c, t, g, unknown, or other
ctccccgcggtggcggccgctctagaactagtggatcccccgggctgcaggaattcgtctcacccctagaaaaagaagcatctcttctccccccttcccaatcgggctgcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccctttgagcatggcgaggtgtttgttcttgatgatggtggagaggttgacttggatttggggaattatgagcgtttcatagatgttactctgacaagggataacaacattaccactggaaagatataccagtctgtcattgagaaggagagaaggggtgattatcttggaaagactgtacaggttattcctcatgtcactgatgaaataaaacagtggatacagtcagtgtcttcggttcctgtggatgggcagactcgtccagctgatgtttgtgttattgaattgggaggcactnggtagtgattattgagtcgatgccattcattngaagcttttgcgccaattatcctttttctctttggcaagggaaaaattctgccctcatacaacgttagcctttgtccaagtaatttgggggtggtaatttgggtgaggccaaaaaacttaaacccacccccacctttggtggtaccaggaaactgtaaaa

SEQ ID NO: 82198 - protein, 169 aa, Zea mays
  misc_feature: Ceres CLONE 1567943
  misc_feature (20)..(171): Pfam Name: CTP_synth_N Pfam Description: CTP synthase N-terminus
  misc_feature: SWISSPROT Homolog: EC 6.3.4.2 CTP synthase
MSSPSPSPPAPAEEEGRAPTKYVLITGGVVSGLGKGVTASSIGVVLKACGLRVTCIKIDPYLNTDAGTMSPFEHGEVFVLDDGGEVDLDLGNYERFIDVTLTRDNNITTGKIYQSVIEKERRGDYLGKTVQVIPHVTDEIKQWIQSVSSVPVDGQTRPADVCVIELGGT

SEQ ID NO: 82199 - DNA, 824 bp, Zea mays
  misc_feature: Ceres CLONE 1567944
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggagggtcacggcagcaacactgggagggtctgctggaccccatcgacggcgtgctcctccaggagctcatccgctacggcgagtttcgcccaggcacctacgacagcttcgactacgaccgcttctccccctactgcggcagctgcaagtacccggcgaagaccttcttcacgacgtcggcctcggcggcatcggctacgaggtcacccgctacctctacggcacctggaacgacctcaagttccccaacttcggcatcaagacggccgccaccgccagattgggagcgagtccggcactttcatggggtacgtggcccggtccaccgacgaga

SEQ ID NO: 82200 - DNA, 786 bp, Zea mays
  misc_feature: Ceres CLONE 1567946
  misc_feature: Encodes the peptide sequence at SEQ ID NO. 82201
  misc_feature (681)..(681): n is a, c, t, g, unknown, or other
ccccgcggtggcggccgctctagaactagtggatcccccgggctgcaggaattcgtctcacccctagaaaaaagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagcttgctgatcccatggagaatgctggtgcttccttgattcgtgaagttgctagcaagacgaatgactcggctggtgatggaacccacactgctctgttctcgctagggagatcatcaaattgggcatgttgagcattacttcaggggcaaatccagtgtccgttaagagggcatttgatagactgttcagaaattggtggagaacttgagaagaatcanggccgtccagggtagtggggatataaaagctgttgctgcatatcagctggaaatgatgaattggtggggacttgatcgccgaagcttatgacaaggttgcccctg

SEQ ID NO: 82201 - protein, 149 aa, Zea mays
  misc_feature: Ceres CLONE 1567946
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTHTALFSLGRSSNWAC

SEQ ID NO: 82202 - DNA, 972 bp, Zea mays
  misc_feature: Ceres CLONE 1567950
  misc_feature (198)..(198): n is a, c, t, g, unknown, or other
  misc_feature (202)..(202): n is a, c, t, g, unknown, or other
tcaccgcggtggcggccgctctagaactagtggatcccccgggctgcaggaattcgtctcacccctagagagaacgggtcaccagtcaccacatccctccctccctgccatttgtttggttgttcctctcgcagtctcgctcgccaccaggcagcaggcatcccaatctcgcgagagccagtagcggcggcggcggcntccncccgctcccgctcgccgccctcctccttcagcgtcgccgcgctccgtccgacgcttccgtcctccgccgcctccctccggcgcgtcctctggtcccgccgctacctcgtgctcttcgtttccctcccgcttctcttcctaatcctcttcttctcctacgggggtgcgtcctccctccgcctgcccgcctccatccgcctcccttccgccgcacccggccgccgaccccgggggcctcccgcatgccgcgaaggccgaagcttgcacgcgcctctaacctccctccggctccccaagggctccggggtcttcctcagccctccttcaacccggaacccgcaggccccccacccaacgggtttcccgcccccccgccccccatcttcgcttcttccgaattcttccaggtccccgcgccttcggagggggcccggagatccaagatcccacccgcgggaggatttcaaagggggggtgctttcctttttcccttgggaaccgtgttaaaggggcgtccgggcaaattggcgactcgaagggagcggggcctgggagatccctggaatcccccccttttctctccgggctgccggggaaaaaaagggaatttggccggggccaagcccggggggagaactttgtgggggggaaaacccccaaagaaaagacccgggtgcccctcccaagattatcttgtgcatcctcccggggaaaaaggttcacaaccctcttatgatatttgttgtggaagaagcactatttgtttcgtgg

SEQ ID NO: 82203 - DNA, 834 bp, Zea mays
  misc_feature: Ceres CLONE 1567954
  misc_feature: Encodes the peptide sequence at SEQ ID NO. 82204
  misc_feature (674)..(674): n is a, c, t, g, unknown, or other
  misc_feature (793)..(793): n is a, c, t, g, unknown, or other
ctccccgcggtggcggccgctctagaactagtggatcccccgggctgcaggaattcgtctcacccctagaaaaagaggagctctatagagcccatcctctgcttcgcataacctagcggcaccagcagctaaccgtccagagaacagaacagagatgaccaccagcgtccccgtccctctggcctcacagtcgcaggcgccgcagcgcaagccacggacctacaccccgagcccatggggtgacttcttcctccaccacaccccatgcactccgtcacagctcttgttgatgaaggagagggcaaaggtcaaggagcaacaggtgaggcagatcatacaggaaacaatggcctcctccaacctgcttcgcaagttggagcttgtggacacgctgcagcgtctcggggtggactaccgctacaacgaggagatcgaccagttgcttcgctctgtatacgacgacgacgacagggacggaggcggctccgacgatctctacctcacctcgctgcggttgtacttgctcaggaagcatgggtatacaacctcttcagatgtgttcgagaaattcagggacgagcgcgggagcgtctcgagcgacgatgccggctgcttgctcatgctgtatgacgctgctcatacgagaactcacgggggagagattcttgacgacntcatcgcttggagcaagagccgcctgcaatccctgctggaggaggagaatctggagccagagcttgccaaagaggtgaagtgcgcttttgaagacgcctcggttcaggcgggtgaaccnagtggaggccaggcgcttcctcctcgtgtacgaaaagaagg

SEQ ID NO: 82204 - protein, 181 aa, Zea mays
  misc_feature: Ceres CLONE 1567954
  misc_feature (1)..(181): Pfam Name: Terpene_synth Pfam Description: Terpene synthase, N-terminal domain
  misc_feature: SWISSPROT Homolog: EC 4.2.3.13 (+)-delta-cadinene synthase
  misc_feature (129)..(129): Xaa is any aa, unknown, or other
MKERAKVKEQQVRQIIQETMASSNLLRKLELVDTLQRLGVDYRYNEEIDQLLRSVYDDDDRDGGGSDDLYLTSLRLYLLRKHGYTTSSDVFEKFRDERGSVSSDDAGCLLMLYDAAHTRTHGGEILDDXIAWSKSRLQSLLEEENLEPELAKEVKCAFEDASVQAGEPSGGQALPPRVRKE

SEQ ID NO: 82205 - DNA, 830 bp, Zea mays
  misc_feature: Ceres CLONE 1567956
  misc_feature: Translation starting site: 408
  misc_feature (611)..(611): n is a, c, t, g, unknown, or other
  misc_feature (646)..(646): n is a, c, t, g, unknown, or other
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
ccccgcggtggcggccgctctagaactagtggatcccccgggctgcaggaattcgtctcacccctagaaaactcctccagctcctctctgggctgtggtggctgtgactcccaagcacacggcccgcacgagcagttggaacagattcctcgaccgcgtcgccccggaacccagttcttggcatccggtgcctagcttcgtcgcccctccggcaaagaccacctccagccctccacctcccgcggtagcgcttgctgctagtgagctagtatatttctgaaaccggaaacccgcgacacgggaccgagttcttgggagcggattcggctcgctgcaggctgaggctaccggcgcgctcttctccacggcggcggagagccagccagtagttgcgaccggaggcgggcatgggcgcgggcgtgtcgggcctggcgggcgcggagcccggcggcaaggtggcgcgcggcgccgggctgggcaacctcccggagctgtgcaccgcgggaggtgctgctccgcctcggcgcgccggacatatgcgggctcgcgcggctcaacctagcgttccgcggcgccgcgggcgcggacttcgtgtgggagggcaagctgcngggaactacgcccggctcctgcgctcgtgaacaangccaangnnagaggaggagttgggccgattgacccnnnnnnngggaaaaaaaaaatttttttggaggctcgccaaactggggccgttcgagcgggggaaaagggaattcgtggctgggaaaaaacgaaggggggatttgcatggcctttttctccaaaggcctgggtaattaagggggattgaa

SEQ ID NO: 82206 - DNA, 2327 bp, Zea mays
  misc_feature: Ceres CLONE 1567965
  misc_feature: Encodes the peptide sequence at SEQ ID NO. 82207
actcatcttcgattcctcttcgccgctgcagctccagaatggctgctaaacccttcctctcaatccctgccgcggcggtggctcgccttccctttcgcctcctctgctcggcagctccacctccccgcctcctccctttcttcccccagccattcctgctccaaagacgcagcctttccgcctccaccgtacccgccggcaggcgtagcagtcctccggccccggtcatcagcgagggcagggatgacgaggacgccgccgtcggccggcctgtatgtcctggatgcggggtctttatgcaggatgaggatcccaacctccctggcttcttcaagaacccctcccgcagctcccaggacgagacgggaggaagtggagaagtgctcctggccgccgatacggatgcgtttcttgaagaagaagatgataatgatgatcggagggtggcggatgacgcgtcggatgctgaactggagggtctggacagcgatatcgatgagttccttgaagaattcgataagggggacgaagatgacgggttaccggtgaaaagcgccactgataccgatgctttcgccagcgattgggactctgattgggaggagatggaagaagacgaggatgagaaatggaggaaagaactggatggtttcaccctgccgggtgtcgggtacgggaacatcactgaggaaacgatcgagaggatgaagaaagagaagctgtccaagtcccagaggaagcgccaggcgagggaggccaaaagggctgaggccgaggaggattcagccctcgtctgtagccggtgccactcgctgaggaactatgggcttgtgaagaatgacaaggctgagaacctgatcccggactttgatttcgatcggttcatctcgtctcggctcatgaagcggtcagctggtaccccggtcatcgtcatggtggtggactgcgcagacttcgatgggtcgtttcctaagcgagctgccaagtcattgttcgaggcacttgaaggaaggagaaattcaaaggcgagtgaaacgccgagacttgttcttgttggtacaaaggtggatttgcttccatggcagcaaatgggagtgcggttggataagtgggtccgtggccgtgctaaggctttgggagcacccaagctagatggtgtgttcttgatcagcgtccacagagatttggctgttagaaacctaattacatacatcaaggagtcagcaggacctcgtagcaatgtttgggtgattggtgcacagaatgctgggaaatctacgctgatcaatgcttttgcaaagaaacagggtgttaagatcacaagattgactgaagctgctgtcccgggaacaacattaggcatattgagggtaacaggtgttttacctgcaaaggcaaagatgtatgacactcctggcctgttgcatccttacataatggcaatgagattaaataatgaggaacggaagatggttgaaataaggaaagaaatgcggccacgatccttcagggtgaaagtaggacaatccgtacatattggaggcttggcacggctggatgtgctaaaatcatcagtgcaaactatctatataactgtttgggcatcttccaatgttcccctccatcttggaaagactgaaaattctgatgaattgcgagacaaacattttggcatcagacttcagccaccaattggcccagagcgagtcgatgaattgggtcactggacaggaagatctattgaggtgtctggggcaagctgggatgtcaacagtatggacattgctgtttctggccttggatggtactccttgggccttaaaggcactgccactgtttccttatggacatttgagggcattggtgtgacagaacgtgatgcaatgattctgcaccgagcccagtttctcgaaaggcctggattttggttacctattgccattgctaatgctataggtgaggagacaagaaagaagaacgaaaagagaaaagctgagcaaagaagaagagaggaagaagagctccttttggaagaaatggtttagtgatgattctgtagcccagcccacaaagttaggattctgtttctcttgtcaacacgggcttttgtttatcctagttcttgatgtcttttgacataggctgcatcctgtgattttttttcttagcttatgtatatctcaaattttctgtgtatttgttttccatgtgttttacaaccagttttgtcagttctgcttgcatcttacagattcaattcctgcaacttgaggaaaattgatatcctagattacctattcagctgtgtgcaaaaaaaaaaaaaaaaa

SEQ ID NO: 82207 - protein, 668 aa, Zea mays
  misc_feature: Ceres CLONE 1567965
  misc_feature (400)..(491): Pfam Name: MMR_HSR1 Pfam Description: GTPase of unknown function
  misc_feature: SWISSPROT Homolog: EC 1.14.13.39 Nitric-oxide synthase
MAAKPFLSIPAAAVARLPFRLLCSAAPPPRLLPFFPQPFLLQRRSLSASTVPAGRRSSPPAPVISEGRDDEDAAVGRPVCPGCGVFMQDEDPNLPGFFKNPSRSSQDETGGSGEVLLAADTDAFLEEEDDNDDRRVADDASDAELEGLDSDIDEFLEEFDKGDEDDGLPVKSATDTDAFASDWDSDWEEMEEDEDEKWRKELDGFTLPGVGYGNITEETIERMKKEKLSKSQRKRQAREAKRAEAEEDSALVCSRCHSLRNYGLVKNDKAENLIPDFDFDRFISSRLMKRSAGTPVIVMVVDCADFDGSFPKRAAKSLFEALEGRRNSKASETPRLVLVGTKVDLLPWQQMGVRLDKWVRGRAKALGAPKLDGVFLISVHRDLAVRNLITYIKESAGPRSNVWVIGAQNAGKSTLINAFAKKQGVKITRLTEAAVPGTTLGILRVTGVLPAKAKMYDTPGLLHPYIMAMRLNNEERKMVEIRKEMRPRSFRVKVGQSVHIGGLARLDVLKSSVQTIYITVWASSNVPLHLGKTENSDELRDKHFGIRLQPPIGPERVDELGHWTGRSIEVSGASWDVNSMDIAVSGLGWYSLGLKGTATVSLWTFEGIGVTERDAMILHRAQFLERPGFWLPIAIANAIGEETRKKNEKRKAEQRRREEEELLLEEMV

SEQ ID NO: 82208 - DNA, 875 bp, Zea mays
  misc_feature: Ceres CLONE 1567966
  misc_feature: Encodes the peptide sequence at SEQ ID NO. 82209
ctccccgcggtggcggccgctctagaactagtggatcccccgggctgcaggaattcgtctcacccctagaaaaagggcgctgcagtagcgcagcgcagccacgccgcggcaacagcaacaccgcaccatggcgcttcttcttcatccccgcctcccgtcccatcctttccgcgcggcagcccaccaccaccacgccatctcggacgcctcttgcttccttaccctccacggccccggaaggaagcgccgcatgctgctcgcggcggtcacgtgccgcgcagccagggtcaaggagcccgctccgagcgcaggcgcctcgcctccgccgccgccacaggcgctgacgaaggaggcgcacaagtacttcgaccacgccgtggtcaccgtccgcgcgggcgacggcgggcacggcgccgtgctcgccatgccgccggcgccctccgcggacgccgccaagccccgcggcaggttcaaccgggggcgagaagaagagcaagaaggtgtcgtacaagcgcaactacgacggggtccgtggcgctgcccgacggggcggcacggcgggcgacgtttgtgggtgtacgcccgaccaaggcgaaggaaacgcctgcttgcggtttcaccgaagaaggggcgggtactgcgcccaaacgggggaagggaaactgggggcgccggctgggggggcacgcttcaacttgcggaaagcccaacggggtttcgcccgggggaaaaccctcaagaaaaccccgggccctgtagggaaactgttttgaaaacccaaagaaaggggggctggtttctgggcggaatttgggcccctccccctgggaagaaaaggcctccctttcctaaaagggggaaaaaggggcggaaat

SEQ ID NO: 82209 - protein, 208 aa, Zea mays
  misc_feature: Ceres CLONE 1567966
MLLAAVTCRAARVKEPAPSAGASPPPPPQALTKEAHKYFDHAVVTVRAGDGGHGAVLAMPPAPSADAAKPRGRFNRGREEEQEGVVQAQLRRGPWRCPTGRHGGRRLWVYARPRRRKRLLAVSPKKGRVLRPNGGRETGGAGWGGTLQLAESPTGFRPGENPQENPGPCRETVLKTQRKGGWFLGGIWAPPPGKKRPPFPKRGKKGRK

SEQ ID NO: 82210 - DNA, 788 bp, Zea mays
  misc_feature: Ceres CLONE 1567970
  misc_feature: Translation starting site: 250
  misc_feature (653)..(653): n is a, c, t, g, unknown, or other
  misc_feature (657)..(657): n is a, c, t, g, unknown, or other
  misc_feature (692)..(692): n is a, c, t, g, unknown, or other
  misc_feature (697)..(697): n is a, c, t, g, unknown, or other
  misc_feature (706)..(706): n is a, c, t, g, unknown, or other
  misc_feature (708)..(708): n is a, c, t, g, unknown, or other
agctccccgcggtggcggccgctctagaactagtggatcccccgggctgcaggaattcgtctcacccctagaaaaaaccgcgcccccacaccccgctcctctcgctcctcgctcccttttcaccttccccttcgcaggctccccctcccgtgccgtgctctctcaacaagggagaaggggaaaccaccaccaccaccacacttgataagaagggggccgcacgcgcctgcccgctcccgccgctacgccatggacgcctgggaggccaccaaggcggtgttcgaccgggtgcgggcgctggacccggacaacgcgtccaagatcatgggcctgctgctcatccaggacaacagcgacaaggagctcatccgcctcgccttcggccccgaccacctcctccacgccttcgtctccgccgcgcgcgccgacctcgccgccaagcccgcgtccccgccgtcgcccgtgctgggcccgctccaccagacctggggagcgccgccgcacccgagccctaccgctggctccgaccaccaacaccaggcccccttcgccgccgacctcgcgctcggctacgacttcgacggcgccggcgccggcgctgacgcgttcttccccgacgactacgactgctggtcaccggccggcgccgcccnacgncgcagcttctcgctcagcgacgccgaaggccacgncgccngcgccgggngnggctgcgtggaggccatgcatgtacttcgcgcgcggtttctgcaagaacggctcctcctgccgcttccttcacggctttt

SEQ ID NO: 82211 - DNA, 818 bp, Zea mays
  misc_feature: Ceres CLONE 1567975
  misc_feature: Encodes the peptide sequence at SEQ ID NO. 82212
  misc_feature (489)..(489): n is a, c, t, g, unknown, or other
  misc_feature (591)..(591): n is a, c, t, g, unknown, or other
tccccgcggtggcggccgctctagaactagtggatcccccgggctgcaggaattcgtctcacccctagaaaaagattttcgtttctctctcttttcctttccccccgtccctctctttctttctctcttggaattggactcaaaagtttcggcggccttctccatgaacacggtggcttcgctgcctttggcgccgcgcctgctcattaagccctccctcgcctgcttctccagaaaggacgtcggccgctatggcgggatcaaggtgtacgccgtgctcagggaagacggggccgagttcgcccggaacaacaacctggaggccctgttccaggtggacgaccccgggccgcgggtgcccgtcaagaagttcctggacgtgaacgaggctctggaggtggtccgcttcgacatccagtactgcgactggagggcgcgccaggatctcctcaccatcatgcttctccacagcaaggtggtggaggtccntcaccctctggcgagggagttcaagtccatcgggaccttgaggaaagagctcgccgagctacagcaggagctggaaaaagctcacaatcagggtcatctctncgaagcaggagtctcatcggcgctcgacaagctagcgcatatggagaccctggtgagcgcatcatcaacaggcgaccggcccattcttccctccttgggtgcaactggaaatggaaccggaaaaaggcaccgcccgggttcgaagccaagaaaaaacagcccccttggaggctttgaactttcccggcccaattgaaacctttcaaccccccgccctaaaaaatttt

SEQ ID NO: 82212 - protein, 207 aa, Zea mays
  misc_feature: Ceres CLONE 1567975
  misc_feature: SWISSPROT Homolog: EC 1.13.12.14 Chlorophyllide-a oxygenase
  misc_feature (109)..(109): Xaa is any aa, unknown, or other
  misc_feature (143)..(143): Xaa is any aa, unknown, or other
MNTVASLPLAPRLLIKPSLACFSRKDVGRYGGIKVYAVLREDGAEFARNNNLEALFQVDDPGPRVPVKKFLDVNEALEVVRFDIQYCDWRARQDLLTIMLLHSKVVEVXHPLAREFKSIGTLRKELAELQQELEKAHNQGHLXEAGVSSALDKLAHMETLVSASSTGDRPILPSLGATGNGTGKRHRPGSKPRKNSPLGGFELSRPN

SEQ ID NO: 82213 - DNA, 828 bp, Zea mays
  misc_feature: Ceres CLONE 1567977
  misc_feature: Encodes the peptide sequence at SEQ ID NO. 82214
tccccgcggtggcggccgctctagaactagtggatcccccgggctgcaggaattcgtctcaccccctagaaaaatcggcgcgacgacctctcccccaggagagcctaccccctccctcattccccgcgcgacgaggccgcttaatggcgggtcgcggccggcctcggccgggctcgcaccaggctctcgtcgtcgccgccgtcatcctactcctggccgccgcgtccggggccggcgctggatcccccgatcggcccgcgccggggccgccgctgttcctcccgctcacgcgctcgtcccccaacgccagccggctcgccgcctcgctgcggcgcggcctcggcgacggggtccaccccaacgcgcgcatgcgcctccacgacgatctcctcaccaacgggtactacacgacgaggctgtacatcgggacgcccccgcaggagttcgcgctgatcgttgactccgggagcaccgtcacctacgtgccctgctcctcctgcgagcagtgtggcaaaccaccagatccacgattttcacctgacctctccagttcatattcaccagtaaaatgcaacgttgattgtacttgtgacagtgacaaaaaacagtgcacttatgaaaggcagtatgctgaaatgagctccagcagtggggtgcctggtggagggaatattgtcttttggcagaaagaggggaacttaagccacagcctggctatttttgggttgggaaaatttctgaaacgggagaatttgttccatccaccctgcctgatgggataaaggggggccggggttctggggccaacttttccaaaaggggatccag

SEQ ID NO: 82214 - protein, 212 aa, Zea mays
  misc_feature: Ceres CLONE 1567977
  misc_feature: SWISSPROT Homolog: EC 3.4.23.12 Nepenthesin
MAGRGRPRPGSHQALVVAAVILLLAAASGAGAGSPDRPAPGPPLFLPLTRSSPNASRLAASLRRGLGDGVHPNARMRLHDDLLTNGYYTTRLYIGTPPQEFALIVDSGSTVTYVPCSSCEQCGKPPDPRFSPDLSSSYSPVKCNVDCTCDSDKKQCTYERQYAEMSSSSGVPGGGNIVFWQKEGNLSHSLAIFGLGKFLKRENLFHPPCLMG

SEQ ID NO: 82215 - DNA, 815 bp, Zea mays
  misc_feature: Ceres CLONE 1567978
  misc_feature: Encodes the peptide sequence at SEQ ID NO. 82216
  misc_feature (488)..(488): n is a, c, t, g, unknown, or other
  misc_feature (574)..(574): n is a, c, t, g, unknown, or other
  misc_feature (625)..(625): n is a, c, t, g, unknown, or other
ctccccgcggtggcggccgctctagaactagtggatcccccgggctgcaggaattcgtctcacccctagaaaaggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacngcggtggcggcggcggctacggtggcggcggcggctacggtggtggtggcggcggctacggcggtggcaaccgtggcggcggctancggcactccgacgggaactgggagaactgagcggtggggcccgcgcggccnaagtatcctgttcgctaccgtgttgtttacctagtccagagggttttatctcgttcgtctcatgtttgtttgtgcccatctggtgtttttgattgcaaggtcgcttttgtgtcagttgttagtgctgtgttcatcctcggcttcagcagacccatgcatcaaccagcattggactggcggatcgatgggt

SEQ ID NO: 82216 - protein, 156 aa, Zea mays
  misc_feature: Ceres CLONE 1567978
  misc_feature (10)..(81): Pfam Name: RRM_1 Pfam Description: RNA recognition motif. (a.k.a. RRM, RBD, or RNP domain)
  misc_feature (48)..(152): Pfam Name: GRP Pfam Description: Glycine rich protein family
  misc_feature: SWISSPROT Homolog: EC 5.2.1.8 Peptidylprolyl isomerase
  misc_feature (119)..(119): Xaa is any aa, unknown, or other
  misc_feature (147)..(147): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYXGGGGGYGGGGGYGGGGGGYGGGNRGGGXRHSDGNWEN

SEQ ID NO: 82217 - DNA, 833 bp, Zea mays
  misc_feature: Ceres CLONE 1567981
  misc_feature: Encodes the peptide sequence at SEQ ID NO. 82218
  misc_feature (780)..(780): n is a, c, t, g, unknown, or other
tccccgcggtggcggccgctctagaactagtggatcccccgggctgcaggaattcgtctcacccctagaaaaaaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaacccttcggcctaccgcaccgccgtgagcccgctgctgcggggcgtcgaggtcggcctcgcgcacggctacctcctcgtggggcccttcgcgctcacgggcccgcttcgcagcacgcctgtgcacggccagggcggcgcgctcggcgccgccgggctcgtcgccatcctcagggtctgcctcaccatgtacggcgtcgcctccttcacggagggggacccgtcaggggggcccttgtttacgctcaccgggaaggaagaaggaggccaacaagctgcaaaccttcggacggctgggccagtttccccggggggaatctttcttcngggggattcttcggggtgctttggggcctacttttcccctctaggggctcgac

SEQ ID NO: 82218 - protein, 200 aa, Zea mays
  misc_feature: Ceres CLONE 1567981
  misc_feature (44)..(197): Pfam Name: PsaL Pfam Description: Photosystem I reaction centre subunit XI
  misc_feature (183)..(183): Xaa is any aa, unknown, or other
MASQVMKSSLVVHSRPRGLSGAAALTRRPGRFTVKAIQPEKATYQVVQPINGDPFIGSLETPVTSSPLVAWYLSNPSAYRTAVSPLLRGVEVGLAHGYLLVGPFALTGPLRSTPVHGQGGALGAAGLVAILRVCLTMYGVASFTEGDPSGGPLFTLTGKEEGGQQAANLRTAGPVSPGGIFLXGDSSGCFGAYFSPLGAR

SEQ ID NO: 82219 - DNA, 1062 bp, Zea mays
  misc_feature: Ceres CLONE 1567982
  misc_feature: Encodes the peptide sequence at SEQ ID NO. 82220
  misc_feature (1)..(1): n is a, c, t, g, unknown, or other
  misc_feature (15)..(15): n is a, c, t, g, unknown, or other
  misc_feature (19)..(19): n is a, c, t, g, unknown, or other
  misc_feature (55)..(55): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
nttaaaaattttttncccncttcctttgcgctctcttccttctgggctggggggnggannnnnattnnnnnnnnaaagctggagctcaccccggtggcggccgctctagactagtggatcccccgggctgcaggaattcgtctcacccctagaaaaaaccctcgcaccctcaccgaaaggagaaggcttcagccttcaagcgcacacaggcacgcaaatcccctcttcatcaacctcgactcgagtccgcgcgcgtccccgaatcgaggggagatgagtcgtccgcatgacggtcacaggtccttctttcccatggggaatcccttcaggatgattctcccaagaggagcccgcctgccaccgaagctcactgagctgctcacttcgtatgaggatggcctggcctcgagcttgaggaaggtcaagccagaggccacctcagaggtgttcacactatcatggatgaagctcgcagtggagtgcttatcagagctgcacaccaatatagccacccctgattactgagctttgagctgccctttatcagactggggatgaagaagtgggttggacattttaccttgaacaccagtggtgaaacctgctgggacatctgccatttgcccttgaagctcggaagcttctcctcgggtttgggaacaaaagggccaacctggcctttggggcgaaaaatcctccccggaaaattggtggtttaaaacctccttgggggaaggccaacactttgccccatccccccaggggaaaccacgcctcccagggaaaaacccctaaaggggttctcctcttctttaaagggaaaatggggaataagaagcccaaagcccaaattttaaaaaagggttcctcccccagggggcttttggaaaaatatgtgccttttgggacacaccccctccacaaaaggaacctttttttctggggaaaacacccttttaaccccctgtaaaataaaggaggttaaggcgccctttccccccctataagggggggaaaaaagggctcttatttcccccaacctttatgaatccaggctttccc

SEQ ID NO: 82220 - protein, 70 aa, Zea mays
  misc_feature: Ceres CLONE 1567982
MGNPFRMILPRGARLPPKLTELLTSYEDGLASSLRKVKPEATSEVFTLSWMKLAVECLSELHTNIATPDY

SEQ ID NO: 82221 - DNA, 822 bp, Zea mays
  misc_feature: Ceres CLONE 1567983
tccccgcggtggcggccgctctagaactagtggatcccccgggctgcaggaattcgtctcacccctagaaaaacccttcgtttcgtttattccccacttccacacggccacaccgccacagccgccgccgccggacggcgctgtccttccctgggaggcgctccactaggctcggctcagctcacgcgcggcggcggtgtccgtggctgctgggcttgcgcgcgcacctgattccgtgctgggcttcgcgaggtgctcctcgtgcgagacacacgcccgatgcggcggaatcgcgcggccggcgcccgagacccggcgtgattcggtggggaggctgggtcgcggtgcttccgcgtgcgggaaccagtgacttttttattcttctcttccccagcggctcgggcggctagagggcgggccgcttggtgctcgtcagcgcgtgaggctgagattacccggcgccgatctggtgctcttgccgccccgagaggtggtgccgggggccattgccgggttctgattaggaggaggcggaggaggtaagtccctagtcttatggggctcgcgccgccggagctggggcagttcgacgggtgggagaactccggggaagaaagggaccccttgggctgggtgccccccaaccgccgcggcaacaataaggcgcgcccgggaccccagggggcccaacaacaaacccccccgtcctccccggttggtgcatccccctcttggcccgccggaaaatgccccccggggccccccccccccccccccccagggtccaaggttgacacctctccccggggggggcgcggacga

SEQ ID NO: 82222 - DNA, 822 bp, Zea mays
  misc_feature: Ceres CLONE 1567986
  misc_feature: Translation starting site: 378
  misc_feature (502)..(502): n is a, c, t, g, unknown, or other
agctccccgcggtggcggccgctctagaactagtggatcccccgggctgcaggaattcgtctcacccctagaaaaacccgccagcatctccctccgagtccagggggcaggggcaccattaccgagtagtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaagatgacggtgacgccacggatcacggtgagcgacgggcggctgacggtgcgcggccgtacggtgctcaccggcgtgctggaacacgtgtcggcggcgcacgcggccggggcgggggctcgtcgacngggccttcgtcggcgcccacgccggcgaagccagagccaccacgtcttcaccttcggcacgctcggggactgcgggttcctgtgcctgttccgttccagctgtggtggatgacgcaacggatgggcgttctcggccgcgacgttcttctggagacccagttcatgctcgtcgaggttcctgccagtgacggcgacggcaaaacccccccgccttacgtgggaatccttcgcctgctggaagggcattttccggcagcccttcaagggaaccaaccgcaacaaacttcaaaattttcttccaaagcggggaacaagcggta

SEQ ID NO: 82223 - DNA, 844 bp, Zea mays
  misc_feature: Ceres CLONE 1567987
  misc_feature: Encodes the peptide sequence at SEQ ID NO. 82224
  misc_feature (527)..(527): n is a, c, t, g, unknown, or other
tccccgcggtggcggccgctctagaactagtggatcccccgggctgcaggaattcgtctcacccctagaaaaaaagggcccaaggcttctccttctagggattcatcttcctctcgtcttccctcttcctctccgaggatacaaggcgccgtcccaggtagaggtagggtcgccaccatgctggaggagctgctcatcttcacccggggcggcctcatcctgtggtcgtcctgccgggcgctcggcgccgcagccctcaagggctcccccatcgacgccctcatccgctcctgtctcctcgaggagcgatccgccgacgccagcttctcccaggacaattacgccctcaagtggaccttccacaacgacctcggccttgtcttcgtcgccgtataccagaagatactccacctcctctacgtcgacgatctcctcgccgccgtccgcaaggagttctcccagatctacgaccccaagcgcacctcctacgatgacttttgggacatcttccgccagctccaccgcgnagccgaagcgcgcgccgaggaaatgagaagtccaagcaggccctctcgtcccgtccgcagcctgctctcacccagaagaggcctggtcccaagggccgcggcgggtgattctcgccggcggcgctgctaacaaggggcggctctgggtgccaaggatgactcttgatggcgacgggtatggcaaaccaggaccaaccgtactctgggaaaatggtgccttcaaggggcaaagagaatggtgtcccccaggaagaatttttctcatgggccctacctgtttcaaagggaaaggaaaaagggggcccccaaaggaatat

SEQ ID NO: 82224 - protein, 159 aa, Zea mays
  misc_feature: Ceres CLONE 1567987
  misc_feature (27)..(155): Pfam Name: SRP-alpha_N Pfam Description: Signal recognition particle, alpha subunit, N-terminal
  misc_feature (117)..(117): Xaa is any aa, unknown, or other
MLEELLIFTRGGLILWSSCRALGAAALKGSPIDALIRSCLLEERSADASFSQDNYALKWTFHNDLGLVFVAVYQKILHLLYVDDLLAAVRKEFSQIYDPKRTSYDDFWDIFRQLHRXAEARAEEMRSPSRPSRPVRSLLSPRRGLVPRAAAGDSRRRRC

SEQ ID NO: 82225 - DNA, 833 bp, Zea mays
  misc_feature: Ceres CLONE 1567988
  misc_feature: Encodes the peptide sequence at SEQ ID NO. 82226
  misc_feature (414)..(414): n is a, c, t, g, unknown, or other
  misc_feature (419)..(419): n is a, c, t, g, unknown, or other
tccccgcggtggcggccgctctagaactagtggatcccccgggctgcaggaattcgtctcacccctagaaaaagtccctccccaaggccgcagctcactcgtgtcgtgcacccgtcccctcccggctcccacccgccaagaactagcattgccgccgccggtgccagggggcggaggagaggccgcggcggcgagggagcggcaccaggcgcaggggggaggagaagcaggagagccgccggcaggatgttcgggcgggacccctggggcgggccgctggagatctccaacgccgactcggcgacagatgacgaccggagccgggacctggaccgggcggcgctgatgcggcagctggacgagacgcagcagagctggctcctgggcggccccggcgaccaggcggggcagaangaagngaggtacgtcgacctgggctgcgtcgtcgtcgacggcaagatcttcatgtggaccgtcggcaccatcctcggcctcggcgtcttcatcggcttcatcatgatgatcgtcaagctcgtcccgcaaagggcccgccggcggcgccgcccgaacagtacacgcaagcgctgcacaggccgctcatgttcttcacgcgcagcgatacgtgtatactcccgtcatatatctaacccgaccagagtccccgtgggggacaaaagaaatcccccggattccccaacaatcccccttctgacctggaaaacgagtccagaaacttttgattcctaaaaactcattttaaattggacgaaaaagaatgggttgcccccaccaaaaacctttgttttcaccctggctccctcccccaaggtttg

SEQ ID NO: 82226 - protein, 166 aa, Zea mays
  misc_feature: Ceres CLONE 1567988
  misc_feature: SWISSPROT Homolog: EC 3.2.1.4 Cellulase
  misc_feature (56)..(56): Xaa is any aa, unknown, or other
  misc_feature (58)..(58): Xaa is any aa, unknown, or other
MFGRDPWGGPLEISNADSATDDDRSRDLDRAALMRQLDETQQSWLLGGPGDQAGQXEXRYVDLGCVVVDGKIFMWTVGTILGLGVFIGFIMMIVKLVPQRARRRRRPNSTRKRCTGRSCSSRAAIRVYSRHISNPTRVPVGDKRNPPDSPTIPLLTWKTSPETFDS

SEQ ID NO: 82227 - DNA, 866 bp, Zea mays
  misc_feature: Ceres CLONE 1567992
  misc_feature: Encodes the peptide sequence at SEQ ID NO. 82228
  misc_feature (777)..(777): n is a, c, t, g, unknown, or other
  misc_feature (818)..(818): n is a, c, t, g, unknown, or other
  misc_feature (866)..(866): n is a, c, t, g, unknown, or other
tacccgcggtggcggccgctctagaactagtggatcccccgggctgcaggaattcgtctcacccctagaaaaactgccgctgcctcctccccctttccgcctgccttcgctctcctcctcgtctcctccgtctagggttctccacccccaccccgccccgccgccgcccgatccgaggcagatgccgcccgcagccatggcgctgccgtcccaggccccgtctaactcaggggatccgctgtacccggagctctggcgcgcctgcgccggcccgctcgtcaccgtcccccggcgtcggcgaacctccgtctttcctactttccccccggggggacacattcgaggggggggggggggggggcccccctgaaaaaccaggggtgtgggggggggaaaccccaaggggggggtttctccaaaaaaatgtgggtttttaaaggggtggttttttttgcccggggggggggctccaccggggcttgcagggtttgagaggggggggggggaagaccatagccccggctgaggggggggggggggtggggccccccgccaagaaaaaagaaagaaggcccttttagtcgcggggggaggggccgcctcccgcccgtaagaaaaaagaaagggggtggggggggggccccgccccccgggaagaaagaaaagacaagccgtctgtggtggtgggggtgtgggttgcgttggtcccccccctacgcccaggagagggagggcgcccggggggtgtggcggggttggtttatcttgtttgtttgnagagagagaaaaaatattagcttcgtttcctcctgtgtcgntgcaaacagaccactagaatagagagagaggagagcagctgggtgtgn

SEQ ID NO: 82228 - protein, 57 aa, Zea mays
  misc_feature: Ceres CLONE 1567992
MALPSQAPSNSGDPLYPELWRACAGPLVTVPRRRRTSVFPTFPPGGHIRGGGGGGPP

SEQ ID NO: 82229 - DNA, 911 bp, Zea mays
  misc_feature: Ceres CLONE 1567999
  misc_feature: Encodes the peptide sequence at SEQ ID NO. 82230
tcaccgcggtggcggccgctctagaactagtggatcccccgggctgcaggaattcgtctcacccctagaaaaagctcaattgggggtcacggtcacggcccgcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctcccccgcgtccaactcgaggggcgccgccgcggttactgacggccgcgctctccacgggatctctccgcagcagcagtacggaggcactccggctcagctcggccccccaagctcaacctgttcccaccaaactcgcccccccgttcccaccccttccccgcccgccgacaggttgggcgggcttgcccatccctgggaaaaacttgatggcccaaggggcccatcttagacccgcgtcccttcgcccgaccctcagtcttttcccccaaaacgcactcggggcggtcttgtctccgggcttttcaccggcgcccccccgggtggggaaagtggcgcttttggaagggtgtctccctgcctctccccggaagacagttttgaggtttaccccgcgaaacacgggggccccttattggaagataaattgaatgagggacacggggaaattcttctaaccaggcaacgtcgtgaacacaacacgacgttgtggcgggatacgtacgcctggtcttcgttgggagaagacgccctcaagtattatgtggcgcgtcttctaccatgtgccg

SEQ ID NO: 82230 - protein, 117 aa, Zea mays
  misc_feature: Ceres CLONE 1567999
MNCGPPDQLPPGSAPSCFLNLNWDQSMAADQLDPALSSMVSSPASNSRGAAAVTDGRALHGISPQQQYGGTPAQLGPPSSTCSHQTRPPVPTPSPPADRLGGLAHPWEKLDGPRGPS

SEQ ID NO: 82231 - DNA, 770 bp, Zea mays
  misc_feature: Ceres CLONE 1568003
  misc_feature: Encodes the peptide sequence at SEQ ID NO. 82232
  misc_feature (572)..(572): n is a, c, t, g, unknown, or other
  misc_feature (575)..(575): n is a, c, t, g, unknown, or other
  misc_feature (582)..(582): n is a, c, t, g, unknown, or other
  misc_feature (693)..(693): n is a, c, t, g, unknown, or other
tccccgcggtggcggccgctctagaactagtggatcccccgggctgcaggaattcgtctcacccctagaaaaagtccgtcgcctcgcgcggtcgcgcctcacctcgcccctccctccctcctttctgccggccactcccggctcccgagccacagcaattacccagctcagcggctgccgaaccccctccgcttcccggctctccaggtcgagaagggcgctgctcgccacctgcctttctttctacagttcgacgcactttggtggcggtgccgctactctccttcccgagttcctaacttcctaactaggagggcgggcgttgtctgcctgtgtgcttttggcgattcgggggcttgggctcggatctgcgcgtgccttcctccggacccgagcgaggctcgggcgcgaatttggggcggatcagcgcagatctggaggcacatgaggaggaggaggcggaggggtagcgggagcgatgcggtgcttctgcgaagggcttgagccgacctgggaaggtgattctggaggaggtggcggtggctgcggaagcggagggggagctggagaanggnatggaanacgtcgtagcagtcgtggcgtcactctccgcgccgcgggcgccggcgtttagccccgccgcggcggggctcacgctgatcgccgcggcggtcgcggaacccgatcgcgcgntggtcgtcggagccatggagggggtctccgtgcccgtgactgtgccccccgtcaagacggcgtccgcggtggacgac

SEQ ID NO: 82232 - protein, 65 aa, Zea mays
  misc_feature: Ceres CLONE 1568003
  misc_feature (3)..(3): Xaa is any aa, unknown, or other
  misc_feature (40)..(40): Xaa is any aa, unknown, or other
MEXVVAVVASLSAPRAPAFSPAAAGLTLIAAAVAEPDRAXVVGAMEGVSVPVTVPPVKTASAVDD

SEQ ID NO: 82233 - DNA, 817 bp, Zea mays
  misc_feature: Ceres CLONE 1568004
  misc_feature: Encodes the peptide sequence at SEQ ID NO. 82234
gcggtggcggccgctctagaactagtggatcccccgggctgcaggaattcgtctcacccctagaaaaaaagtggacgaggaagctgggccacaccctctcccgcatcgtcacgaccaagccgcgcttcgccttctcccagcccaggcctaggcccaggcccaggcccgcacaacccggtctgccttcctcacaacccgtctcgatcccgccgcagccgccggagcttccccccttcgtccccaccgccatgccgcaccacggcagccaccgcccgccggcgccgccgccggggggccccgtgttcccgcgcgcaacgtccacggtggtgcccgacccgtcccgcttcttcgcgccgccgctcctcgccgcgccgctccccaccaactccttcttccagaacttcgtgctcaagaacggggaccagccggagtacgtccacccgtactccgtccgctcccccggaggcgccgctctcgacatctgctacccttcgcggaaccactcgccgtccttcgtcatccagactttcgtccccgacctcacggtctccgacgccgccgggagcgcgcagcgccactgcgtcttcggctttcgacgacttctccgtcacgctcgacgtctccccgtccctccgcgcgcaccttcgtccgcggaagcccgtacgtcacccgtcacaaccacgggcgggggccctcgaacatcttccgtcgcggtccgtccaattgcttccctcgaactcgccctccttgcaacgacttccgggcaccaagggggccgcctccgggaagaaaaagcgggccaaaacctttccttcca

SEQ ID NO: 82234 - protein, 189 aa, Zea mays
  misc_feature: Ceres CLONE 1568004
MPHHGSHRPPAPPPGGPVFPRATSTVVPDPSRFFAPPLLAAPLPTNSFFQNFVLKNGDQPEYVHPYSVRSPGGAALDICYPSRNHSPSFVIQTFVPDLTVSDAAGSAQRHCVFGFRRLLRHARRLPVPPRAPSSAEARTSPVTTTGGGPRTSSVAVRPIASLELALLATTSGHQGGRLREEKAGQNLSF

SEQ ID NO: 82235 - DNA, 808 bp, Zea mays
  misc_feature: Ceres CLONE 1568005
caccgcggtggcggccgctctagaactagtggatcccccgggctgcaggaattcgtctcacccctagaaaaagccctttcgcctgttgccggagtcgctagcctccgggccccggccgatgccccgcctcctcccgaggaccacttcctccagcattcgcttccagagcaggctagacgctgagcgaggtcaattcttccgccgagtgacagagagggagggagcgaggaacagacgggagggtctccgcgcacgtgctatcagacaccacccgatacccgggtctagtccggcacagatctgctgctgcccttgagatatagatcaaagcttccgctccggttgttgtctgctgctcggcacatgcgcggcggctgatgcagtacgggaggacagcgaacatgtcgtcgagcaccatcctgaaggccctgggcgctgttgaacgaccacagcagcatcatcctcgccaggtcacgtaggatccttgcgcccgatctggaggtgcttctcgtaagggccaccacctttcaccactagccggcggatgaacgccccttccgcgagaatctcctccttacctccggatcccggccccccctttggtgatgggggggtaagggaagctcccctagggtcctcccggaccaaacaattaaaagagccccccccaagggtctcctaagggggggggggccccggcctgtctttttcaaaaagggagaaaccttttttttttgcccaaagagggggcgccccccccaggggagtcccccggggggggaggggcacacccccgccctcttttaaa

SEQ ID NO: 82236 - DNA, 836 bp, Zea mays
  misc_feature: Ceres CLONE 1568007
  misc_feature: Encodes the peptide sequence at SEQ ID NO. 82237
ccccgcggtggcggccgctctagaactagtggatcccccgggctgcaggaattcgtctcacccctagaaaaaaacacgccgccgtcttctgcggttctgccgtttactcctccactttggcctcctcacttgcaagtttaatcttcgcctccagccatgggtaaggagaagtctcacatcaacattgtggttattggccacgtcgactctggcaagtcgacaaccaccggccacctgatctacaagcttggaggcattgacaagcgtgtgatcgagaggtttgagaaggaggccgctgaaatgaacaagcggtcctttaagtatgcttgggtgcttgacaagctcaaggctgagcgtgagaggggtatcaccattgatattgctctgtggaagtttgagaccaccaagtactattgcaccgttattgatgcccctggacaccgtgactttatcaagaacatgatcactggtacctcccaggctgactgtgctgtccttatcattgactccaccactggttggtttgaggctggtatctccaaggatgggcagacacgtgagcatgctctccttgcgttcacacttggagtgaaacagatgatttgctgctgcaacagatggatgcaaccacctcccaatactccaaggcacgttatgatgagattggtgaaggaagtctcatctttacctcaggaaagttgggtacaaccctgaatagaaaaccatttgttcccatctctgggttttgagggggacaaactgatttgagaaggccccccaaccttggactggaaaaaaggcccaacccctggttggaagctccttgaccagaacct

SEQ ID NO: 82237 - protein, 185 aa, Zea mays
  misc_feature: Ceres CLONE 1568007
  misc_feature (5)..(185): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGWFEAGISKDGQTREHALLAFTLGVKQMICCCNRWMQPPPNTPRHVMMRLVKEVSSLPQESWVQP

SEQ ID NO: 82238 - DNA, 780 bp, Zea mays
  misc_feature: Ceres CLONE 1568009
  misc_feature: Translation starting site: 185
  misc_feature (712)..(712): n is a, c, t, g, unknown, or other
agctcaccgcggtggcggccgctctagaactagtggatcccccgggctgcaggaattcgtctcacccctagaaaaaaactcgaaccgaagggacgaccgagcggagtctagactcgagagcaacctcgacctcccggatctctctcccacccacgcctcgtcagcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattaggagcaatcctgttctgcggttgattgctggacttgtatttatgcgtgagcaggactacaatgaggctctcaagcacacacactctggaggaactctggatttgcatgcagttgaatgtccagatcttcatcaggatgcatcgttcagactatgctgagaagcaattgaagatcatgcaacaaattgatgaagaccgtacacttacacaacttgcaaacgcatggctgggcanttgctgttgggtggctctaaaatccgatgaagcttatctcagtattcaagactttgctgaatagtact

SEQ ID NO: 82239 - DNA, 803 bp, Zea mays
  misc_feature: Ceres CLONE 1568011
  misc_feature: Encodes the peptide sequence at SEQ ID NO. 82240
ctcaccgcggtggcggccgctctagaactagtggatcccccgggctgcaggaattcgtctcacccctagaaaaactattggggacaacctgagggaacttttaatttctgggacaggccaacttgggaggttgaagaggaaatcgaatacaggaactaccaaacatgccagtacaacactactccgcaggaagcttttacagtggctcaagatatcatgaagacgatgctagaaaaggggtacgtgctcagcaaggatgctttggctaaggctagagcctttgatgagtcctatggattaacagctgcagcagcagccagggctgcagagctgagcaagagaattggtttaactgatagggtcaatgctggtgttggtgcaatgcgatcagtcgatgagacatatcgcgtaagagagacaaccaagacggttgctactgccactggaagaacggcagcaaaggtggtaaatggcatcgtcaccagcagctacttctctgcaggagccatgatcttgtctgatgctcttactagggctgccagggccgcgcagatctggccgctcatggtaggcagaattaagtgaaaatagacataaagttcatctttgcagttactaaacatgaggacgaccactttcaagtgatgttgcttgatgtattttaatgacacaacagtgttctaaattaaaggagaccatccctgcgtttggaacaaatggttgccctgaataagttttgatattgcaaaaaaaaaaaaaaaaaaaataaagggtttccaaaaggcaatttttcttttcaaaaa

SEQ ID NO: 82240 - protein, 122 aa, Zea mays
  misc_feature: Ceres CLONE 1568011
MKTMLEKGYVLSKDALAKARAFDESYGLTAAAAARAAELSKRIGLTDRVNAGVGAMRSVDETYRVRETTKTVATATGRTAAKVVNGIVTSSYFSAGAMILSDALTRAARAAQIWPLMVGRIK

SEQ ID NO: 82241 - DNA, 843 bp, Zea mays
  misc_feature: Ceres CLONE 1568013
  misc_feature: Encodes the peptide sequence at SEQ ID NO. 82242
  misc_feature (420)..(420): n is a, c, t, g, unknown, or other
  misc_feature (660)..(660): n is a, c, t, g, unknown, or other
ctcaccgcggtggcggccgctctagaactagtggatcccccgggctgcaggaattcgtctcaccccctagaaaaaaaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcctggtgcacgcgcgcggggcctccgcccagggcttcttcgagtgcacccacgacgtgacgtcgctgacgtgcgccgacttcctgcgcgcgnccggcgtgcggacgcccgtgatcgtgcgcttctcgacggtgatccacgagcgggggtccccggagacgatccgcgacccgcgcgggttcgccgtgaagttctacacccgcgaaggcaactggggacttgctgggcaaacaacttccccgtcttcttcatccgcgacggcatcaagttcccccgacggtgatccacgcggtcaagccccaacccgcggtcgcacgtgcaggagtactggcnggtggttcgacttcctgtcgcacctccccgagaggctgcacaacttctttttccctcttcaacaacggggggggtgcgttcgactaccgccaaatggagggttcgggcttaacccctacactttcttaaccccgggggggaaaggcccaaaacctgaaatttcactgggaacccaaagtgccg

SEQ ID NO: 82242 - protein, 233 aa, Zea mays
  misc_feature: Ceres CLONE 1568013
  misc_feature (18)..(233): Pfam Name: Catalase Pfam Description: Catalase
  misc_feature: SWISSPROT Homolog: EC 1.11.1.6 Catalase
  misc_feature (93)..(93): Xaa is any aa, unknown, or other
  misc_feature (173)..(173): Xaa is any aa, unknown, or other
MDPTKFRPSSSHDTTVTTTNAGAPVWNDNEALTVGPRGPILLEDYHLIEKVAHFARERIPERLVHARGASAQGFFECTHDVTSLTCADFLRAXGVRTPVIVRFSTVIHERGSPETIRDPRGFAVKFYTREGNWGLAGQTTSPSSSSATASSSPDGDPRGQAPTRGRTCRSTGXWFDFLSHLPERLHNFFFPLQQRGGCVRLPPNGGFGLNPYTFLTPGGKGPKPEISLGTQSA

SEQ ID NO: 82243 - DNA, 752 bp, Zea mays
  misc_feature: Ceres CLONE 1568014
  misc_feature: Encodes the peptide sequence at SEQ ID NO. 82244
  misc_feature (274)..(274): n is a, c, t, g, unknown, or other
  misc_feature (332)..(332): n is a, c, t, g, unknown, or other
ccccgcggtggcggccgctctagaactagtggatcccccgggctgcaggaattcgtctcacccctagaaaaatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgncttgagctgaccggcggggcgactccccacccagcgaccgggtcgggggcttggaccntggtggcccgtgcttggacgtgagccgcaccatgcagggcgagaagatcagaagatgaaactgccctgaagttcgtggtgaagagctcacttcatcgacggcttttcatcgtccctttctggacaccccaaaaggatctgccgcttggggcagggaacaaagatccccaccggaggtgtggaagttattgacccctccggcccggggggaaacccaaatttgggaagggctccaaaagggggttaaggggcctccccaaaaccaaaattacctccgggggggggttttttggggctttttttctttttttccaaaggggccccaaaaaaacgggggggggaaccccccccccccccaacctttaaaaatagtgggcacccgggcgcccgggggggaacccccccccttgggggggggggg

SEQ ID NO: 82244 - protein, 47 aa, Zea mays
  misc_feature: Ceres CLONE 1568014
MSFSDDEPIIPSPNSGPRPTPIVPGRVQLVSKNNNMAPLEENTQKVL

SEQ ID NO: 82245 - DNA, 866 bp, Zea mays
  misc_feature: Ceres CLONE 1568016
  misc_feature: Encodes the peptide sequence at SEQ ID NO. 82246
  misc_feature (545)..(545): n is a, c, t, g, unknown, or other
tcaccgcggtggcggccgctctagaactagtggatcccccgggctgcaggaattcgtctcacccctagaaaaactccagaagtccagaccaaagctctaaagtccaatccctcgctagccacttgccatctgatcaaccagccagccgatctcagcgatccgccatggccaccgcgtattacgagaggccccgtggcggcgccgtcgaggaggcggacgacttcgatgagttcgaccccacgccgtacggcggtgggtacgacctcgccgtcaccttcggtcgcccgctgccaccgtccgaggaaacctgctacccgtgctcggcgccctcgacctcctacgacgcaccgcactacgccgcctccgagccgtccccctacggtcaccacgccaagccaaagcccaactatgggttccgcccccagcaagagcaacagccgtcttacggcagcggctacggatccaggcccgagcccgctgcggaggagggcggtgggctatggatctgggcttccgatccgggtatggggaggacgaagccgganggaggaaaagctcccggctctggatatggggagggaacccgcagggcggaggaaaactaccgggtccgggcgggtacggcttctgggctacggggggtcaaaaccccggccgggaggaaaagcttatgggtccagccggggtattgggacttgcccaatccggaggggtgaaaaactaaggggttttgggttcccgggagggaaacccccggggtagagggaaaacctccccgatttggcagatagggggtccggggttcgggggaggaaaccccccctaatttgggggaaagaccttttgggttctgggggtcacgggga

SEQ ID NO: 82246 - protein, 183 aa, Zea mays
  misc_feature: Ceres CLONE 1568016
  misc_feature (127)..(127): Xaa is any aa, unknown, or other
MATAYYERPRGGAVEEADDFDEFDPTPYGGGYDLAVTFGRPLPPSEETCYPCSAPSTSYDAPHYAASEPSPYGHHAKPKPNYGFRPQQEQQPSYGSGYGSRPEPAAEEGGGLWIWASDPGMGRTKPXGGKAPGSGYGEGTRRAEENYRVRAGTASGLRGVKTPAGRKSLWVQPGYWDLPNPEG

SEQ ID NO: 82247 - DNA, 892 bp, Zea mays
  misc_feature: Ceres CLONE 1568018
ggagctcaccgcggtggcggccgctctagaactagtggatcccccgggctgcaggaattcgtctcacccctagaaaagactccgacctgctcttgcatatagattgggcagagagtgagagagagagagcgcgcgcgcgcgctcaagggggggccaaaaggagtttttttttaatacagcttcttagcctgaatctctttgatccggagagcagccgccagcccaactaatccttgctgctagcgcgccggggctccgattgcgctccagatctgaggcacctgctcggtggattccaggaatccgagcaccaactcgacagggagagttctcagggtaaaggtgagctcccttttccttctccctcctcatccgtccaccgttgccaaaactctgtccctccgccgctggactggagtagtcgcgctcgcgctcgcgcctgtcttaaactctgattgctagctaatcttcgggatgtttgcctctcggtcttggttctgccgcccgcctacactggaggaagacgctttgatgcaccccgggacgggacaaccaatttggcccccagtttttgtttgtcccttgcacacgacccacccaccagctcccggcggtgttttttttttcttcttcaacccccctttgaatggaatcgtgtggttttccgaaaggaaaaaggcctaaaagcgccctttggaaatttttgaacctaaaagaaccaggcgcacctgagccatgcctgggggtccctttgggggaccccccttttaaaaaaccctcggtgggacgggggggggcagcggggcaataaaaaatagggagatcatccgataactcaatcatggacagatcgctcccctaccggtccgtcctatcgaggtggggttacgtc

SEQ ID NO: 82248 - DNA, 819 bp, Zea mays
  misc_feature: Ceres CLONE 1568020
  misc_feature: Encodes the peptide sequence at SEQ ID NO. 82249
  misc_feature (698)..(698): n is a, c, t, g, unknown, or other
ctccccgcggtggcggccgctctagaactagtggatcccccgggctgcaggaattcgtctcacccctagaaaaaacccttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaggtgatcagcacaggagtcgtgcccccgattcatgagttccttacacgtgaggaccatccacaactcccagttgaggctgcatgggcgctcaccaacattgcatcaggcacatcagagaacactaaggtggtggttgaaaagtggtgctgtgcccatnctttgtaagctccctcactcaatagcgaggatgttcgtgaacaggctgtatgggcctttgggaaatgttgctggtgactccccaaaatgccgtgatctggtgctaggccatgtggggctac

SEQ ID NO: 82249 - protein, 165 aa, Zea mays
  misc_feature: Ceres CLONE 1568020
  misc_feature (4)..(96): Pfam Name: IBB Pfam Description: Importin beta binding domain
  misc_feature (105)..(146): Pfam Name: Arm Pfam Description: Armadillo/beta-catenin-like repeat
  misc_feature (164)..(164): Xaa is any aa, unknown, or other
MSLRPSEREQMRKGNYKQTVDAEESRRRREGQMVDIRKAKREESLQKKRRDGFPAAGAVPPMGHSTALQQKLDGLPAMVQAVHSNDPTVQLEATTQFRKLLSIERSPPIEEVISTGVVPPIHEFLTREDHPQLPVEAAWALTNIASGTSENTKVVVEKWCCAHXL

SEQ ID NO: 82250 - DNA, 796 bp, Zea mays
  misc_feature: Ceres CLONE 1568021
  misc_feature: Encodes the peptide sequence at SEQ ID NO. 82251
  misc_feature (739)..(739): n is a, c, t, g, unknown, or other
ctccccgcggtggcggccgctctagaactagtggatcccccgggctgcaggaattcgtctcacccctagaaaaagatccggagatcgacaaccccaccgtcccgcgcgaggagaaggccgagctcatcggcgagatcgccaagtcgtccgagctgcagccgcacgtcgtcaacttcctcaacgtcgtcgtcgacaacttccgcgcgtccatcgtgccgcagatcgtcgtcgagttcgagaacgtctacaactcgctcaccggcaccgaggtcgccaccgtcacctccgtcgtgcagctcgagtcgcaggacctcgcgcagatcgcgcagcacgtccagaagatgaccggcgccaagaacgtccgcctcaagacgcagctcgacccggcgctcatcgccggcttcaccgtgcagtacggccgcgacggctccaacttgatcgacatgagcgtccggaagcagatcgaggagatcgcgtccgagttcgagttgcccgccgtcccgctcgaagtctgaggccggcttgaggcgtccatcctcgccctcgaagctataggtcctttttctgctgcctctctccctgctctgctattcatctgtatcattctctggttgttgaatggtttgagtgaaatgtgaatgctgcatacctggattttaggattcatatttggatggaatggtgaatacactgcataccggaatttcagaaatttgggttcaaataaggaaagtgatangaatggagggaggatgtgaccataaatttcacatgaacgggtgtagggaagtaagac

SEQ ID NO: 82251 - protein, 170 aa, Zea mays
  misc_feature: Ceres CLONE 1568021
  misc_feature (7)..(161): Pfam Name: OSCP Pfam Description: ATP synthase delta (OSCP) subunit
  misc_feature: SWISSPROT Homolog: EC 3.6.3.14 H(+)-transporting two-sector ATPase
PRGGGRSRTSGSPGLQEFVSPLEKDPEIDNPTVPREEKAELIGEIAKSSELQPHVVNFLNVVVDNFRASIVPQIVVEFENVYNSLTGTEVATVTSVVQLESQDLAQIAQHVQKMTGAKNVRLKTQLDPALIAGFTVQYGRDGSNLIDMSVRKQIEEIASEFELPAVPLEV

SEQ ID NO: 82252 - DNA, 822 bp, Zea mays
  misc_feature: Ceres CLONE 1568022
gcggtggcggccgctctagaactagtggatcccccgggctgcaggaattcgtctcacccctagaagtaccatgtggactctttcatcgcccgctctctcggagagtttggatgctcctgaacctccaagcaacaggcgatgaaaggagggaccctcgcaattaccctgatggggtaccttgatgtgccatggcactgccttgcttcttgggcaggtctgctccccgtcttcgcatctgtaaatgtgtgtgctgcagctccgatactgagagcaggattacataaaattgaacttcagcaccgcttctgcgacccccaactagtacaatagcttcatcgcttctgtacctgcgtggcttgatgagcaaagctcggggcaacagaagcgggatccccgtgctggtcgactagaacgacacgctctcgctctaatcgattctaaccatcactctggtgaacaaggcagggcgctccgtatgcttgacgatggatgtatcctgagcctacttcatgacttacttagcaagatagcgctcgtgcctcctcaagagatcatgccacatgttctcctcggcgatgtgttactaccgtggcccgaggaggacaagatgggggtcctgtagtgactgaccgacggtcacttgcatggggaattgatccctgctgatgcacgataaggaccacggtcaagaatactggggtcgtggcctggagaagcgataatttttcgacgaggccatctcggtccggtgttctggtctccactggccaccctacccaaaaagaggttaaagcttggggcctcttcccccttgttaacaac

SEQ ID NO: 82253 - DNA, 835 bp, Zea mays
  misc_feature: Ceres CLONE 1568023
  misc_feature: Encodes the peptide sequence at SEQ ID NO. 82254
tccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttagggtgactgttttggaatcgagagatcgtattggcgggcgcattcatactgataactcgtttggatggccaatttgatatgggagcctcatgggctacccggggtggtggcaatgagaatccccctgggcaccctttgataaacctatctgtgggttggagggtttatcccgcccaaagcgaaggaataacctcaggtcggggtatgaaacctgaac

SEQ ID NO: 82254 - protein, 72 aa, Zea mays
  misc_feature: Ceres CLONE 1568023
MDPNGLKTGGLLLPTIERRCTSPPSVIVIGGGISGVAAARALSNSSFRVTVLESRDRIGGRIHTDNSFGWPI

SEQ ID NO: 82255 - DNA, 788 bp, Zea mays
  misc_feature: Ceres CLONE 1568024
  misc_feature: Encodes the peptide sequence at SEQ ID NO. 82256
gcggtggcggccgctctagaactagtggatcccccgggctgcaggaattcgtctcacccctagaaaaaaaggaagcgatccctctccctccctccctcgtatccaggacaacagcccgtgcgatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgtcgtcgcgctcgtcgacgctgccacgggccaccgggtcacgttccaggaactctggcgcgcggtggaaggggcggccaccgcgctcgccgcgccgccgctgtcgctccgcaagggccagatcgcgcttatcctctccccgaactccgtccacttccccgttgccgccctcgcagccatgtccctcggcgccgtcctcaccaccgccaacccgctcaacacgcccgccgagatcgccaagcaggtcgccgacgcgcgccccgtcgtcgccttcaccacccgcgacctcctcccaaagctccggcgcgccggcggcgggcgccggcatccgcgtcgttcttctcgagccggaccgcctcccctccgaccttagcccccgtcgtccccaccatcggggagattttccggcagggccgcccgaccccaaggggccgcggggaacggggtcacccagggacaaaccgggcccagtttgtttaattcccttggggacccccgggggccccaaaaaaggggct

SEQ ID NO: 82256 - protein, 169 aa, Zea mays
  misc_feature: Ceres CLONE 1568024
  misc_feature: SWISSPROT Homolog: EC 6.2.1.12 4-coumarate--CoA ligase
MAARPDARSGYCAATRTFRSKRADVPLPADADLDVVRFLASRRHAGVVALVDAATGHRVTFQELWRAVEGAATALAAPPLSLRKGQIALILSPNSVHFPVAALAAMSLGAVLTTANPLNTPAEIAKQVADARPVVAFTTRDLLPKLRRAGGGRRHPRRSSRAGPPPLRP

SEQ ID NO: 82257 - DNA, 796 bp, Zea mays
  misc_feature: Ceres CLONE 1568030
  misc_feature: Encodes the peptide sequence at SEQ ID NO. 82258
ctccccgcggtggcggccgctctagaactagtggatcccccgggctgcaggaattcgtctcacccctagaaaaagctctggtctttcccaccaccgcgaacacctggcaatggcggcccccgccccgtcggccacctcccagatgtcctcaagcggcctcctttcttactgagctcacccaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccgggatctaggccctgagcaatggcagcggcggtggcgccgccgctctgcacctggctcgtcgccgcctgtctctccgcggcctgcggcgatggcgagaaggagaatgaacgcaggcaccgcggtggcggcgtagggggtttcttcggctcgcgccgcccgctcggctcagggcgccgcggcgtggggcgctctggaatgccatgtctgttgccttgcatcctgaaaggacagctgtggaaaataagaacctgatatgaaccggagagaggtggttgtcactgggcatggtggtagtgacccccctagggcatgatccctgatgaatccaacaataacccttttaaggggttttcggtggaataaaccgagaataaaggcctttgaattggttccccccaacccaccgagaaaaccgggggagaaaaaaaaaattattttttcaa

SEQ ID NO: 82258 - protein, 77 aa, Zea mays
  misc_feature: Ceres CLONE 1568030
MAAAVAPPLCTWLVAACLSAACGDGEKENERRHRGGGVGGFFGSRRPLGSGRRGVGRSGMPCLLPCILKGQLWKIRT

SEQ ID NO: 82259 - DNA, 872 bp, Zea mays
  misc_feature: Ceres CLONE 1568031
  misc_feature: Encodes the peptide sequence at SEQ ID NO. 82260
tccccgcggtggcggccgctctagaactagtggatcccccgggctgcaggaattcgtctcacccctagaaaaaagctcgactgctccagttcttcccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaagtgcgccgctaaggtgaatatgggactatggccctttgaatccaacaataggggaaggccataatacaggccggctgaaggaggtcgcagaggggaaagtttggaatgatcactttcccctttgtttatctgggaaaactggccggggggcccccaaagcaactggaatggcccaaggggggtaatttggccaaatggggggaatttttggaatttccttggggaaaacaaggccgggggggagaaaaattttgggcccccccaaaagacacccttggaaaaagggcccccacctccccaaaggggacaccttctccccccgttaagtgaccttttcgggcgggggccgggggaaaaaaatttctggggggttttccccccaattttggggggggggttggcacaaaatccccctctctcctgaaaaaaaaatttttgggttttttagaacaatat

SEQ ID NO: 82260 - protein, 93 aa, Zea mays
  misc_feature: Ceres CLONE 1568031
  misc_feature: SWISSPROT Homolog: EC 4.2.1.2 Fumarate hydratase
MAMALRRLAGVSGSPSASSAAATVLLRSALTRPISTGFREERDTFGPIQVPNDKLWGAQTQRSLQNFDIGGERERMPVPIIRAFGVLKSAPLR

SEQ ID NO: 82261 - DNA, 870 bp, Zea mays
  misc_feature: Ceres CLONE 1568032
  misc_feature (301)..(301): n is a, c, t, g, unknown, or other
  misc_feature (631)..(631): n is a, c, t, g, unknown, or other
  misc_feature (660)..(660): n is a, c, t, g, unknown, or other
  misc_feature (788)..(788): n is a, c, t, g, unknown, or other
ggagctccccgcggtggcggccgctctagaactagtggatcccccgggctgcaggaattcgtctcacccctagaaaaacttttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgctcctcccagcaccagcatgagacacaatcacatgacagtggttcctcgaaatctcgnagaaaggggacccggagaacgcccaataaagggggaagggataaggggaggcgggggacccgggggatattgtgggcccccaaaaaaaaaaagggggggggggggggccccccaaaaccgggggggggaaaaagggggctctcctccaaaaaaaaaaaaaaccccccccccgaaaaaaaaaaagaagaataaaagttgtgtggggggggaggcccccccccccccccccggcggggggggggggggggctgttttttttttgggggagaggggggggcccccgccggcgggggtggtgtggtttgaggaacggagagagggagggggggnccgtccccccccgcccgccgcgggggggngggagaggggcgtctctccgtctccgaggtggcgagtgagacagggaagggggggggggggggggacggccgcgcgccgccggcccctttcatctgagtggattataatagatggggtggagtggagngggttttgagtgagagggagggaacgatcaaccctctcacctcgcactattggtgtagttgggggggctcggttgtgttgtt

SEQ ID NO: 82262 - DNA, 1125 bp, Zea mays
  misc_feature: Ceres CLONE 1568033
  misc_feature: Encodes the peptide sequence at SEQ ID NO. 82263
  misc_feature (59)..(59): n is a, c, t, g, unknown, or other
  misc_feature (76)..(76): n is a, c, t, g, unknown, or other
  misc_feature (78)..(78): n is a, c, t, g, unknown, or other
gagtggtgagggcacctctccctctctttttgtttttttttggttctgttttttctttnaagaaatataatatttntntggggctcaccgcgtggcggccgctctagaactagtggatcccccgggctgcaggaattcgtctcacccctagaaaaatgctaccatggcgttcacctccggaagccctacccccacgcgcttctactcttcagctttgctatcgttgcgcaacccccaagagcctctctgtctacggcccatggcgaatggcgtgggcgtgggcgccccctcctcgcgctccggcatcggtcccaggcccaggctgccgcagcggcggccggggcggccgaaacctcccaccacaatgttgaagttgtgagcgctgggaatcgtagggcttgccatcgagcgccaccgcttcctccacacttcgctctccgtttgccttcgccgaaccctggcctcccctgctctgggtgccacatggtccagggcaggggatacctttttggatgttcgccaccgggacaccccggggactgacacccggggaaaccttggggcctcccggaacaaagcaaccttttggcagggcgagcttggccaaccccgaaggttttaaacggcccaggggaaagctaactataaacactccttcgataaagaaaaattttgggcggtgtgcgatttagtgaacaaagaaaagcccgtggcgttaacttatcggcgaaaaaaaagatcttctctcccgcaaaacaaccctgacggggggaaccctttttgggcgaatgtcaatacatagggcgacccacccgggcttctcctatactccttctgaaggcgaacggggcgagacaacacagtggccgggagaataatttctattaatcacccacctatttatttgcgtttcccgattgaccctgactgaaaaaccgtctgctatacctaccgtggtgcttatttgggcaaaaacttgtggagcgccgcgtttctctcaatcgcaacgtcgaccgccgagtacagaaaggggtgtcctgagtggttagagtgagaaggttccgggggggggcgaaccatccatgtttcccctcggaaaataaaccgcaattatagcctccgggg

SEQ ID NO: 82263 - protein, 39 aa, Zea mays
  misc_feature: Ceres CLONE 1568033
MANGVGVGAPSSRSGIGPRPRLPQRRPGRPKPPTTMLKL

SEQ ID NO: 82264 - DNA, 819 bp, Zea mays
  misc_feature: Ceres CLONE 1568034
ccccgcggtggcggccgctctagaactagtggatcccccgggctgcaggaattcgtctcacccctagaaaaattttctacttctacagaagcatcccattagtattaatcacggggtattgatcatttatgtgtttctgaatagttttacttatatgcatttgtcatatcgatactttttttttgggaaaacgcaggagaactgcgcctcaatatattaagaagaagagataaatccagatcaaagagatctggacaaattacaaggcctcctcatgggggccagaaacacagcaaactgaaaaaatccatcaaactaaacaactccctagtctccaggaattagggcagcaaggtatgaaagacccttagccccagccatctcccaagactgcctctcctccctggctaaattaatggacagatctaaactaggagtacaaccatcaaaaacacaactattaccatcaaagacacaactgttaagtcatatcgatactttatagtccatttcaatgtgaaacatttaaacaccgttcaatccttacaattgttcaggtcgttgcacctgctgtcacttcgtgatattaagatgcagtcaccatttgctcggatgattattcaactcttctcgagtcgtcatgtgatttacacacacttgagatatcagaaaacaatgttgggttgacatgaaaaaaatatcctaaatttccttttacttattttccaatcggggaaaatgggttgtttttttgtaaaattggctggctgggctttcggaattgaacaaaatgttctaccaaactttattagcgctgaa

SEQ ID NO: 82265 - DNA, 828 bp, Zea mays
  misc_feature: Ceres CLONE 1568036
  misc_feature: Encodes the peptide sequence at SEQ ID NO. 82266
  misc_feature (425)..(425): n is a, c, t, g, unknown, or other
  misc_feature (548)..(548): n is a, c, t, g, unknown, or other
ggagctccccgcggtggcggccgctctagaactagtggatcccccgggctgcaggaattcgtctcacccctagaaaaaactccagaagtccagaccaaagctctaaagtccaatccctcgctagccacttgccatctgatcaaccagccagccgatctcagcgatccgccatggccaccgcgtattacgagaggccccgtggcggcgccgtcgaggaggcggacgacttcgatgagttcgaccccacgccgtacggcggtgggtacgacctcgccgtcaccttcggtcgcccgctgccaccgtccgaggaaacctgctacccgtgctcggcgccctcgacctcctacgacgcaccgcactacgccgcctccgagccgtccccctacggtcaccacgccaagccaaagcccaactatgggttccgnccccagcaggagcaacagccgtcttacggcagcggctacggatccaggcccgagcccgctgcggaggaaggcggtggctatggatctggcttcggatccgggtatgggaggaaagagcaggangaggagagcttcggctcttgaatttggaagaaaaccccaggcggaggaaagctaccgggtcggggggggtacggttttggctaacggcggtcaaacccgggcgggagaaaaactttggggtcaaccagggtatgggatttttcccaatcccccggggggtggaaaacataagggtcttttggcgttcggggaagggaaaccccccggggtgaagagggaaaccctcccggattccggaaaattttggggcccttgggggttcccggggaaaagaaacaca

SEQ ID NO: 82266 - protein, 132 aa, Zea mays
  misc_feature: Ceres CLONE 1568036
  misc_feature (126)..(126): Xaa is any aa, unknown, or other
MATAYYERPRGGAVEEADDFDEFDPTPYGGGYDLAVTFGRPLPPSEETCYPCSAPSTSYDAPHYAASEPSPYGHHAKPKPNYGFRPQQEQQPSYGSGYGSRPEPAAEEGGGYGSGFGSGYGRKEQXEESFGS

SEQ ID NO: 82267 - DNA, 820 bp, Zea mays
  misc_feature: Ceres CLONE 1568039
  misc_feature (441)..(441): n is a, c, t, g, unknown, or other
  misc_feature (471)..(471): n is a, c, t, g, unknown, or other
  misc_feature (472)..(472): n is a, c, t, g, unknown, or other
  misc_feature (496)..(496): n is a, c, t, g, unknown, or other
  misc_feature (497)..(497): n is a, c, t, g, unknown, or other
  misc_feature (513)..(513): n is a, c, t, g, unknown, or other
  misc_feature (527)..(527): n is a, c, t, g, unknown, or other
  misc_feature (547)..(547): n is a, c, t, g, unknown, or other
  misc_feature (550)..(550): n is a, c, t, g, unknown, or other
  misc_feature (590)..(590): n is a, c, t, g, unknown, or other
ctcaccgcggtggcggccgctctagaactagtggatcccccgggctgcaggaattcgtctcacccctagaaaaatccccgagagccgcttcttctttctccgtgactcggagctgtctacctcaccctcactgcctctgcgtgcgtgcgtcactgccggtctgccgtgccgctgcgcccgctcccgcaataaataaactcacctctctctgttctccgttctcacctccctcctcatccatccagggacgcgccttgacttctcacgtcgtgtcgtgtgtgagcgcagcggtgctgctgatctgcgattcctccacgccacaccctacctgaccacccgacagggaatcctactccctcttgcgcgccgcggcggcggcggcggcatcttcggtctccgtgcgggtgtttccgttcggcgtttactggccgggcgagcgcngcattggaggagtcgggagggaggagacanngagcgtgatcgatggggaactgcnntggcgagcggggcgcnacaacggtcacggncgcaggggaggacgggagcngcngggaaaaaaaaatttgaaaagccccccccgggaggagcanctccggctcgggtcccccggcgggatctttctccaacgacgggccgcagcccgcaccgccgcccgtgtttcacgcagcaggggccgggaaagggggtcaatcagggacgccatgcttcttcttgggattgggttccggcgggggaaggaggaacttcgtgcctgggtggggggggtggttccaacgggcaacgggcccccaatgggccaccttggggggggccccccggg

SEQ ID NO: 82268 - DNA, 888 bp, Zea mays
  misc_feature: Ceres CLONE 1568040
  misc_feature: Encodes the peptide sequence at SEQ ID NO. 82269
gagctcaccgcggtggcggccgctctagaactagtggatcccccgggctgcaggaattcgtctcacccctagaaaaagagagcagggaaggaagggagaggaaaaggaaaagcgggtcgcgagtgccccccaccccccgcttttgctccaatcggcgccgcctcgcgcgagatccgctccgcgtgccccgccgccgcgctgctgccgagatagagggtgtcgtccccggcatcgggttccacggggagagtgtgattgggtacctgatccattggggggtggattgagtcgcttgaccttttcacatctgtcccgtcctgctggtttggtcaccataagaggctggcttggttcaaaaatgatggcattgggagtggaaaaaggattcggcaaaaaattggtcccaaaatttccggccgaggaaaaattcaaaaatcccactggtttcccccgccctgggaaagggacccggaaaaccccccacgggagggagcccccttttagagggacaaaaaaaaaggggggcccccccccaaaaaaggtttttttgggaaatcccctccaaggccccgaaggaaaatcccccccaaaaaaaaaaaaaaaaaggccccttcttgtttttttaaaaaaaaaaataaaaggaggggcggaggttttgtgggaaaaaaaaaaaaaaaaaatttttacaaaccttttgggaaaaaaaaaaaggtttttttttttttttttttataaaaaaacaaaagggggggggggaaaaaaattattatttttcccccaccaaaatggggggaggggctttttttgggggagggtcttttgttatgtgggagaaaacctttggtgggtgtttgttctgggggaaaaacaaaaaggaagagggtggtg

SEQ ID NO: 82269 - protein, 94 aa, Zea mays
  misc_feature: Ceres CLONE 1568040
AHRGGGRSRTSGSPGLQEFVSPLEKESREGRERKRKSGSRVPPTPRFCSNRRRLARDPLRVPRRRAAAEIEGVVPGIGFHGESVIGYLIHWGVD

SEQ ID NO: 82270 - DNA, 895 bp, Zea mays
  misc_feature: Ceres CLONE 1568041
  misc_feature: Encodes the peptide sequence at SEQ ID NO. 82271
ctccccgcggtggcggccgctctagaactagtggatcccccgggctgcaggaattcgtctcacccctagaaaaaaaggataaactctcccttggccaccgcccattctccgccccgccttatccttccctcatcccccgtacaaaaacgcgctccctcccgcccgcccgccgctcaagccacctacaccaccaccccgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcgggggtgcgcaagaccgccgactactccttccccaaggtcgtgggcctcgctcagccccgcgggcaggaggcggcgcgggcggcgcgttccgggcccaaaagaaacgcccccgccgaaatcttcagggtccgccgccccccatgaacgggcttcgtgctcgggcggggtcccccgtcggggtccgtggtgcccccgggggggaggccccccgtccaaagaagcccaaaatagggggcggtggggcctggccccctggggggggtgggcccccccggggcccgaaatttgtgttttaagaaaacccgggaaaaatatataaacccagaagggggcccgccttccgaattacaaatttaacctggggggagggggacccccggacaacaaggggggggaaaaaacgtgggggaaaaaaatgttttttttgtggggggcgcagggccccaaaatgtgaagccgagggacacattagacaagaagagttg

SEQ ID NO: 82271 - protein, 144 aa, Zea mays
  misc_feature: Ceres CLONE 1568041
MASSFAVATVPSLAAPAAKKRSGGVTYVEGMNAYSGLKGLNKVNMLGGAQDRRLLLPQGRGPRSAPRAGGGAGGAFRAQKKRPRRNLQGPPPPMNGLRARAGSPVGVRGAPGGEAPRPKKPKIGGGGAWPPGGGGPPRGPKFVF

SEQ ID NO: 82272 - DNA, 798 bp, Zea mays
  misc_feature: Ceres CLONE 1568042
  misc_feature: Encodes the peptide sequence at SEQ ID NO. 82273
ctccccgcggtggcggccgctctagaactagtggatcccccgggctgcaggaattcgtctcacccctagaaaaatagaaaaatccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcagggcaaggccctggtgtctggggatacattcggggttgaatgtaaaattaaacctgggcttggtggaaagaaacctaaaaattttttctctaaaaaaattttggggatttaaagagagaaaaaaccgggggtgggggggggggggaaaaaatcccccccccggtttattttttttttttttgtgaggggggtgtttttttttttttttttaggccccccccctataggggggggggccctcttttttttttgtgggggcccccccccccccctctggggggggggggaagaaatcatacccccctcccaagaaaagaaagagggggggggggggggggggtggttttttttttttttttttttttttaccacaacaaaaaaaacggtgggggggg

SEQ ID NO: 82273 - protein, 146 aa, Zea mays
  misc_feature: Ceres CLONE 1568042
  misc_feature: SWISSPROT Homolog: EC 2.4.1.13 Sucrose synthase
MAAKLTRLHSLRERLGATFSSHPNELIALFSRYVHQGKGMLQRHQLLAEFDALFDSDKEKYAPFEDILRAAQEAIVLPPWVALAIRARPWCLGIHSGLNVKLNLGLVERNLKIFSLKKFWGFKERKNRGWGGGGKNPPPGLFFFFL

SEQ ID NO: 82274 - DNA, 849 bp, Zea mays
  misc_feature: Ceres CLONE 1568043
  misc_feature: Encodes the peptide sequence at SEQ ID NO. 82275
ctccccgcggtggcggccgctctagaactagtggatcccccgggctgcaggaattcgtctcacccctagaaaaaactgccgctgcctcctccccctttccgcctgccttcgctctcctcctcgtctcctccgtctagggttctccacccccaccccgccccgccgccgcccgatccgaggcagatgccgcccgcagccatggcgctgccgtcccaggccccgtctaactcaggggatccgctgtacccggagctctggcgcgcctgcgccggcccgctcgtcaccgtcccccgcgtcggcgacctcgtcttctacttcccccagggacacatcgagcaggtggaggcgtccatgaaccaggttgccgggaacccgatgcgtctctacgatctgccttccaagctgctctgccgcgtgctcaacgtcgagctgaaggcggagaccgacaccgacgaggtgtacgcgcagatcatgctcatgccggagcccgagcaaaacgatgtggctgccgagaagacgagctctgggtctgctgcgccaccgaggccagcggtcaggtcattctgcaagacgctcaccgcctccgacaccagcacacacggcggcttctctgtcctgcgccgccacgctgacgagtgcctccctgccctggatatgtcccagtcgcctcccactcaggagctggtggcgaaggatctgcttgggatggaggggcgattccgccacatctttcggcgggcaacccaggaagcatctccttcagaaggggtgggagtggtttttgtcagtttcaaaaaaggctttgttgctggaagaccccctccctttttccctcaaaggaagaaaacg

SEQ ID NO: 82275 - protein, 217 aa, Zea mays
  misc_feature: Ceres CLONE 1568043
MALPSQAPSNSGDPLYPELWRACAGPLVTVPRVGDLVFYFPQGHIEQVEASMNQVAGNPMRLYDLPSKLLCRVLNVELKAETDTDEVYAQIMLMPEPEQNDVAAEKTSSGSAAPPRPAVRSFCKTLTASDTSTHGGFSVLRRHADECLPALDMSQSPPTQELVAKDLLGMEGRFRHIFRRATQEASPSEGVGVVFVSFKKGFVAGRPPPFFPQRKKT

SEQ ID NO: 82276 - DNA, 808 bp, Zea mays
  misc_feature: Ceres CLONE 1568044
  misc_feature: Translation starting site: 307
  misc_feature: SWISSPROT Homolog: EC 4.1.1.50 Adenosylmethionine decarboxylase
  misc_feature (25)..(25): n is a, c, t, g, unknown, or other
  misc_feature (222)..(222): n is a, c, t, g, unknown, or other
  misc_feature (225)..(225): n is a, c, t, g, unknown, or other
  misc_feature (227)..(227): n is a, c, t, g, unknown, or other
  misc_feature (232)..(232): n is a, c, t, g, unknown, or other
  misc_feature (241)..(241): n is a, c, t, g, unknown, or other
  misc_feature (323)..(323): n is a, c, t, g, unknown, or other
  misc_feature (438)..(438): n is a, c, t, g, unknown, or other
  misc_feature (690)..(690): n is a, c, t, g, unknown, or other
  misc_feature (691)..(691): n is a, c, t, g, unknown, or other
  misc_feature (695)..(695): n is a, c, t, g, unknown, or other
  misc_feature (767)..(767): n is a, c, t, g, unknown, or other
  misc_feature (776)..(776): n is a, c, t, g, unknown, or other
ctccccgcggtggcggccgctctanaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacnacncnagcancaaaattcntcaagggccgctggttgctgcgagaggtccgggccttcgtgggatcttgaaaattgaatgttctaatggagtccaagggtgncaagaagaagtctagcagtagtcgttcctccctgatgtacgaagctccccttggctacagcatcgaggatatccgccctgcaggcggcatcaagaagttctccgctgcttactcnaactgcgcgaggaagccatcctgatatctctgtcgtcatccccatcctagtagcgtaaaaaccacctgcattttcattttgatctccctaatccctccggctagctgctttccagtgaccaaaagatatcaaagaccacttcccgtcttcctcccgtggctgtctgtcatctggctctgaaacgatggcagtcctgcaagttgctgctgctgcccctccccctgtctctgtgattgggttcgagggatttcnnaagnccctttgagatcagcttctctgaggcacctgtcttggctgaccccagcccaaggggactgcgtgcgctctcncgtgcccanatcaactctgttcttgacctggctcggtgcgc

SEQ ID NO: 82277 - DNA, 781 bp, Zea mays
  misc_feature: Ceres CLONE 1568045
  misc_feature: Encodes the peptide sequence at SEQ ID NO. 82278
gcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaagcccttcacgtccgcaacatcgcctccatgttcccaccctacgacaagatcaagtacgccggcacagggtccgccatcgagtacgccg

SEQ ID NO: 82278 - protein, 137 aa, Zea mays
  misc_feature: Ceres CLONE 1568045
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEALHVRNIASMFPPYDKIKYAGTGSAIEYA

SEQ ID NO: 82279 - DNA, 845 bp, Zea mays
  misc_feature: Ceres CLONE 1568046
  misc_feature: Translation starting site: 149
  misc_feature: Pfam Name: CTP_synth_N Pfam Description: CTP synthase N-terminus
  misc_feature: SWISSPROT Homolog: EC 6.3.4.2 CTP synthase
ccccgcggtggcggccgctctagaactagtggatcccccgggctgcaggaattcgtctcacccctagaaaaagaagcgaagcatctcttcgccccccttcccaatggggctgcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggactgcgggctccgcgtcacttgcatctggatcgatccatacttgaacaccgatgctggtacaatgtccccctttgagcctggcgaggtgtttgttcttgctgatggtggagaggttggacttgcatttggggaattatgagcgtgtcataggtgttactctgacaagggatcacaacattgccacttggaagatataccagtctgtcattgagaacgacagcacgcgtgattatcttggagagctgtacaggttagtcctcatgtcactgatgaactcaagccgggatacgctcagtgtcttgggttctgaggatgggcagactcgtacagctgatgtttgtcatattggagtggagagggcctgtcagtgcaattagagtcccgggccgttcattggaggcttttccgccaatggtgctttttctcttggccaggggaattttcctgccttcttacccatttaccccttgttcccggaaaatgagggggttgggttgggtggcccccaaaaaccttactcccggcccccctataagggggacagaagaaaccgg

SEQ ID NO: 82280 - DNA, 856 bp, Zea mays
  misc_feature: Ceres CLONE 1568047
  misc_feature: Encodes the peptide sequence at SEQ ID NO. 82281
  misc_feature (632)..(632): n is a, c, t, g, unknown, or other
  misc_feature (638)..(638): n is a, c, t, g, unknown, or other
  misc_feature (639)..(639): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (684)..(684): n is a, c, t, g, unknown, or other
  misc_feature (712)..(712): n is a, c, t, g, unknown, or other
ctccccgcggtggcggccgctctagaactagtggatcccccgggctgcaggaattcgtctcacccctagaaaaaaccaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctgatcgccggcatcaccatcgccagcctcgccatcccgcagggcatcagctacgccaagctcgccaacctgccgcccgtgctcggactctactcgagcttcgtgccgccgctggtgtacgcgctgatgggagctccagactgcgtnggaaannannnnnnnnnnnnnnggggnnnnnnngnnnnnnngngnnnntggngggggggggggggggttgtccgaagggnaaaccccggggttttacctggcccccttggcctttcccggccgcctttctttgcggggggttcttttcaggcctcgcgtcgggccttccttaagggttggggctttccttcggggaacctgtgttgtcccacccgcacagaatc

SEQ ID NO: 82281 - protein, 202 aa, Zea mays
  misc_feature: Ceres CLONE 1568047
  misc_feature (130)..(130): Xaa is any aa, unknown, or other
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (136)..(136): Xaa is any aa, unknown, or other
  misc_feature (138)..(138): Xaa is any aa, unknown, or other
  misc_feature (139)..(139): Xaa is any aa, unknown, or other
  misc_feature (140)..(140): Xaa is any aa, unknown, or other
  misc_feature (141)..(141): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
  misc_feature (146)..(146): Xaa is any aa, unknown, or other
  misc_feature (155)..(155): Xaa is any aa, unknown, or other
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLPPVLGLYSSFVPPLVYALMGAPDCVGXXXXXXXGXXXXXXXWXGGGGVVRRXNPGVLPGPLGLSRPPFFAGGSFQASRRAFLKGWGFPSGNLCCPTRTE

SEQ ID NO: 82282 - DNA, 853 bp, Zea mays
  misc_feature: Ceres CLONE 1568049
  misc_feature: Encodes the peptide sequence at SEQ ID NO. 82283
tccccgcggtggcggccgctctagaactagtggatcccccgggctgcaggaattcgtctcacccctagaaaaacgcagtaccgcaccaccaccaagcaccgcaaccggagccggagccagaggagggcgagaggccgaggggagaggagcgaaggaggccgccgaccgaccgtgcgtccggccccgcggcggcgtcggcaggtgcgctagctctgtcttcttcttcttcttctctccctccgatcccgatcctcacggtacctcacggggacatgcatgccgatgatgcgggcacgccagcctccgatccgtttccaccgccgcgcgcgccgcccggccgctccctctcgttcgtcttgtcctctccgcctgtctcgcgtgtcctcacccttcctccgtcctccgtcgtccccttttctttaatgacaaatcggctgcgagccaagtggggcgtgcactcaaacccctcatccccatgagaccgcacgagttggagcaaggctcagtgcccgcctgcccccgcgtgccgtgcgatgcccatggaggcgcgagtccctgggcgtcgtcacgtcctcactccttgtccgtctgcctgtcgccttgtctcgccttgcaggtcgtagacgacagacgagcagtagcagcagcagcagcacgaagcggccgggcccgggccacgccatgccggagaagggagcgcaggccggccgcgttctgcggcggaggcgggggatcgccggagttcgagtcccttcccccggggacgccgccggccgtggcagcgcgaacccccttgcggccggattcttggggaagacaaccccttgcgcccgagttaccttcggcctgccgg

SEQ ID NO: 82283 - protein, 57 aa, Zea mays
  misc_feature: Ceres CLONE 1568049
MPEKGAQAGRVLRRRRGIAGVRVPSPGDAAGRGSANPLAAGFLGKTTPCARVTFGLP

SEQ ID NO: 82284 - DNA, 806 bp, Zea mays
  misc_feature: Ceres CLONE 1568050
  misc_feature: Encodes the peptide sequence at SEQ ID NO. 82285
  misc_feature (685)..(685): n is a, c, t, g, unknown, or other
  misc_feature (733)..(733): n is a, c, t, g, unknown, or other
ctcaccgcggtggcggccgctctagaactagtggatcccccgggctgcaggaattcgtctcacccctagaaaaaaagtacagcagcatccagcgggcggctggctgcctaatctctccagctctttcgtcccctcgccacgccgcccaccgctgccgcatcatccgcccgttgcccgccgtcgtcgcctggccagcggcttccgcccccattcgccgtcgcagcgcgccgagccccgtcccagatcgccgctgcgcttcctgccgccgtcggcgcggcgcagggttgaaatctatttgaccactcagttataaccatttctggtctgaagatgcttcgtcaatgacatctggaaactgtaatagtatgcgctgatcttctatgcttcaccacctgactatcaatgggctctttcctgtggaaacagcccagctacctcttcattttgataattcttcaccttgttgctcatgaggcaagaacgctgagttcagatggtgaagcacttcttgccttcaagaaggcagttacaaattcagatggagtctttctaaattggcgtgagcaagatgcagacccctgcaattggaagggtgttagatgtgatagtcatagtaagagagtgattgatctgattcttgcataccacagattagttggggccataccacccgaaattggaaagntaaaatcagtgcaaaccttgtcactgcaggggaacagtttgtatgggntcactccctcctgaactgggggaatggtaccaagctgcaaacaattgtatctaccaggaaaattatttaggtg

SEQ ID NO: 82285 - protein, 114 aa, Zea mays
  misc_feature: Ceres CLONE 1568050
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (95)..(95): Xaa is any aa, unknown, or other
  misc_feature (111)..(111): Xaa is any aa, unknown, or other
MGSFLWKQPSYLFILIILHLVAHEARTLSSDGEALLAFKKAVTNSDGVFLNWREQDADPCNWKGVRCDSHSKRVIDLILAYHRLVGAIPPEIGKXKSVQTLSLQGNSLYGXTPS

SEQ ID NO: 82286 - DNA, 833 bp, Zea mays
  misc_feature: Ceres CLONE 1568052
  misc_feature: Encodes the peptide sequence at SEQ ID NO. 82287
ccccgcggtggcggccgctctagaactagtggatcccccgggctgcaggaattcgtctcacccctagaaaaagcacgctcgccgcctgctctcttgtctgctctgctcagctcaggcgacacggcgcgctccgtgccgcccacgaaacctcatcggcgtcatcctcatcaatccctgcctctgccgtccgagataaccatgctccacggtctctgactcacccctgcatctgccgtgtagccttcttgtacagcttggactggactagactggatcactagaggtggacatccctccattaatttaagggatttttatgtccaccgccgccgccagcgccaactaaacccgcgacgacggtcgaccatggcgtcctcgctgctctcctcccccgctaaacccaccaccaccaaaacgaccccggccccaagacccgcccgctccgcccatgtccatgtcctctccgccgcccgctgcctccgcctccgcctccgcgcggtccccgcccgagcgtcgtcgcagcatcctccgcctcgcccaccccggggtcgcggcggccggagtacgtccccaaccgcatcgacgacccccactacgtgcgcatcttcgacaccaccctgcgcgacggggagcagtccccgggcgccaccatgaacgagcgccaagaagctcgtcctcccgccgccagctggcccgccctcggcgtcgacatcatcgagggccgggttccccggtcttcttccccgaaaaaaccttaaagcccgtggggcttccatcgcccatcaggggtcggaaaacccggccccagagacccctccgggggagggagggcc

SEQ ID NO: 82287 - protein, 35 aa, Zea mays
  misc_feature: Ceres CLONE 1568052
MNERQEARPPAASWPALGVDIIEGRVPRSSSPKKP

SEQ ID NO: 82288 - DNA, 844 bp, Zea mays
  misc_feature: Ceres CLONE 1568053
  misc_feature: Encodes the peptide sequence at SEQ ID NO. 82289
  misc_feature (578)..(578): n is a, c, t, g, unknown, or other
  misc_feature (586)..(586): n is a, c, t, g, unknown, or other
  misc_feature (614)..(614): n is a, c, t, g, unknown, or other
ctccccgcggtggcggccgctctagaactagtggatcccccgggctgcaggaattcgtctcacccctagaaaaaatcatattgcctgcctatgaagctctctgtctctggccaatggaggagctacttcttctcctctagcctttcccgtctctgattcgtccattgaccttgggtgacgtcggcgccacttctgcgccccgcgactcctcgcgccttgtgtgagtgagtggctgagtgctacaagcaagcgatggacatgaacgagagcggtgagacagggatggagcagggcaacgcgtcctccggcgccccggtggagtggcacactcaattcaacgccgccgcgttctcgtgcgcgccgcagcaggttccaatgatggactccgtcttcgcgtccgccggcctgtgggcgtccacctcccaagccatggcgctctccgacgtcgtcggcgccatgtcggccgcgcggggaggcgggttcttggcgccggtgcccggtttcctcccgcagggcctcggccatttcgccgtcgactccggcttcatcgagcgcgccgcgcggacgtcctgcttcancggcggcngcggcggcggcggggtgatgggcgctancgcagctgctttcggtgcggctggtcagaccgtgaacaacgcgttcagtgtttcgtcaggggcgctgctgggaggatcacagaagaaaggacttccttccgccagaaaggcgagccgggagctccgccgccaaccacggggttggctgaacccggaaggctgcttggtgggtgggggacctgcttcgtcccagaggggaaccttcgggacttccaaagaagaaggagaaa

SEQ ID NO: 82289 - protein, 197 aa, Zea mays
  misc_feature: Ceres CLONE 1568053
  misc_feature (109)..(109): Xaa is any aa, unknown, or other
  misc_feature (112)..(112): Xaa is any aa, unknown, or other
  misc_feature (121)..(121): Xaa is any aa, unknown, or other
MDMNESGETGMEQGNASSGAPVEWHTQFNAAAFSCAPQQVPMMDSVFASAGLWASTSQAMALSDVVGAMSAARGGGFLAPVPGFLPQGLGHFAVDSGFIERAARTSCFXGGXGGGGVMGAXAAAFGAAGQTVNNAFSVSSGALLGGSQKKGLPSARKASRELRRQPRGWLNPEGCLVGGGPASSQRGTFGTSKEEGE

SEQ ID NO: 82290 - DNA, 932 bp, Zea mays
  misc_feature: Ceres CLONE 1568054
  misc_feature: Encodes the peptide sequence at SEQ ID NO. 82291
ccccgcggtggcggccgctctagaactagtggatcccccgggctgcaggaattcgtctcacccctagaaaaagtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcactccggggaggagacggcccgcgagatccaggtggccagggaggcgtaccgccgcgagacggccgcgccggcctacgtcatacccgaggagccgccgggccgtggtccaactcgtcgggctgggacatctacggggttccggccccaacttccatccccccccttggctgggtggccgggtcccccttccccggggcattattcgccggggggtcgcgctttccccaaacttccggaggttggaggccccggatcccccgcggtcgaccccccctggggggggggtaagcccctggggtccggggtccggagagagtgaggccgcggggtccccttggggggttcggcccgggggcgctcccgcctgtctaggttgaaggggtcccccgcggaggctccccccccttgggggcttggagtgcgcgacctcccccgcctaccgtatcggcgccctgtccaccgatggggggcgccagatttcctcaccccaaaacatgtggctcgcccccctgggaggggggcggccggagaccagcgtcggcagtactctgctgggagtacgggcagctttaggggg

SEQ ID NO: 82291 - protein, 169 aa, Zea mays
  misc_feature: Ceres CLONE 1568054
MSEQQQPLPQPRSSMREALEKEDKEKAAAAAAAKEKAAVPKNGNGNGGKNGGGAGSGNGGAPPHSGEETAREIQVAREAYRRETAAPAYVIPEEPPGRGPTRRAGTSTGFRPQLPSPPLAGWPGPPSPGHYSPGGRAFPKLPEVGGPGSPAVDPPWGGGKPLGSGVRRE

SEQ ID NO: 82292 - DNA, 1076 bp, Zea mays
  misc_feature: Ceres CLONE 1568055
  misc_feature: Encodes the peptide sequence at SEQ ID NO. 82293
  misc_feature (1041)..(1041): n is a, c, t, g, unknown, or other
  misc_feature (1059)..(1059): n is a, c, t, g, unknown, or other
  misc_feature (1076)..(1076): n is a, c, t, g, unknown, or other
tccccgcggtggcggccgctctagaactagtggatcccccgggctgcaggaattcgtctcacccctagaaaaagcccgttccagcgacgcactactgcggcgaaatcccgctcccgcgttccccatcctccggccgcctcgcttcggcctccctccggaaggtgtcttaaatcatggcgactggccaacttttctcaaaaactacccaagcattattctacaattacaagcaacttcccatccaacggatgcttgattttgacttcctctgtgggagagaaaccccttctgttgctggaataatcaatcctggttctgatggttttcaaaaatttttctttggacaatccccccacccctggggggggggggggcgccgagtttaacccttcatgcactgcacacccacacaggtgatgtatttatcaactttggcctcccttccggaagaggctgcctgtttttttcaatggacacgcctttgaaagcagccccaacaattaaggggtgggttagcccactttatcggctcgaggggtgctcccctgaacctcgaaaggccccacgccgcgttaatttacaatcttgctcccccggggccataaaaacgaaagaggctgatcttttttagggaaccctctctaatcaattcttggggggcccaattactacatgtctccggctgcgccttttcttctagagaaatgtcggcgtcgcgaataccactattgtgtggatacccctcttttcctgatggataccaagagatccaccgcttgaacagcgcgtgtatgccaaagcgggccccgcgcacactgcgtgttgcgtctcttcccgtccgcccgcctaggactgtggagcgaccttctccaaacagcgaaatgaggcgcacagcccggcctcttcgggctccctcccatatgcagcttccgtcagcttcttcgctagcatatcgccttcaccaccgccatttgttctggtggtgcactgctccaccgccgccgccgccaccagtcggtccagctacgccatgtcactcgnccgatcgccaccggtgtnctgacaactatcaaccn

SEQ ID NO: 82293 - protein, 70 aa, Zea mays
  misc_feature: Ceres CLONE 1568055
  misc_feature: SWISSPROT Homolog: EC 2.3.3.8 ATP citrate synthase
MATGQLFSKTTQALFYNYKQLPIQRMLDFDFLCGRETPSVAGIINPGSDGFQKFFFGQSPHPWGGGGRRV

SEQ ID NO: 82294 - DNA, 802 bp, Zea mays
  misc_feature: Ceres CLONE 1568056
  misc_feature: Encodes the peptide sequence at SEQ ID NO. 82295
tcaccgcggtggcggccgctctagaactagtggatcccccgggctgcaggaattcgtctcacccctagaaaaaagaaaaaccgtttccaccctctctctcgtggttctcccgtgctctgtgtccctagcggcgacgactgggcgatcgccgccgccttaagccaggtgctcaggtctgccacttggcacttcgccggcgacgagcacctaacagagagatggctggtggttttcgagtactgcatcttgtgaggccatttctggctttcttgccagaagtacagagtgctgataggaaaataccattcagagagaaagtgatctacacggtcatttctctcttcatttttctggtctgcagccagctcccactctatggcattcattcaactactggcgctgaccctttctactggatgcgtgttattcttgcatcaaaccgtggtactgttatggaactgggtatcactccaattgtaacatctggaatggtgatgcaacttctagtgggatcaaagattattgaagttgacaacagtgtgagggaggatcgtgctctgctaaatggtgcgcagaagttgcttggtatccttattgccattggagaagccgtggcgtatgttctctctggaatgtatggcagtgtgagccaacttggaactgggaatgctatcctcattatacttcagcttttctttggctggtatcattgtcatctgtctagatgaactcctacagaaaaggctagggtttggggatcctggcatctctcttgttcattggcaccaaatttctggtgaaa

SEQ ID NO: 82295 - protein, 169 aa, Zea mays
  misc_feature: Ceres CLONE 1568056
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFGWYHCHLSR

SEQ ID NO: 82296 - DNA, 760 bp, Zea mays
  misc_feature: Ceres CLONE 1568057
  misc_feature: Encodes the peptide sequence at SEQ ID NO. 82297
ctccccgcggtggcggccgctctagaactagtggatcccccgggctgcaggaattcgtctcacccctagaaaaatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcggggcagaggacgccggagccgccagggaaggtgagggagcggccaagaaggacggcaagaagcggtccatcgcccagctgctcacctcgctggcggcgctggaagccgaagaacacgcccgaccgcgcgggcgccgcggacgcgttccaggcggaagctgggcgcttgctcgagtccaacgcccaaccccggttggggaggccaccatgggactacctacggccaagaatgggaaaggaacttttcaagcccacccgccga

SEQ ID NO: 82297 - protein, 160 aa, Zea mays
  misc_feature: Ceres CLONE 1568057
MRPPTANDRPPSGGGGAAAAGAAAGDDDFAFYYSYLQDADAAAASATSTLALAVDDPNPSAAGMTNGRRRKQRGAEDAGAAREGEGAAKKDGKKRSIAQLLTSLAALEAEEHARPRGRRGRVPGGSWALARVQRPTPVGEATMGLPTAKNGKGTFQAHPP

SEQ ID NO: 82298 - DNA, 886 bp, Zea mays
  misc_feature: Ceres CLONE 1568065
  misc_feature (218)..(218): n is a, c, t, g, unknown, or other
  misc_feature (285)..(285): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaaatgaatgaatgaatacgaattcagagcacgagcgccgttgattggccgctactagtactaccagctaggccactgctcctctgctacccgctaacctcgcgccggagtcgtcgcccacgatggcctaccgatccgcagtgctcntttgccccgccccctccctaactggggccggtccccccgttcctttttggggggttttttccccccnccccccccccccgggggaaaaacggggagagggtgttgtctcccccaaaaaaaaaaaaaaaaaaaagggggcccccgccggaaaaaaacacacgcggggggggtccccccccccccccgccgtgggttggtttctctccggcgggggggggggaaaaaaaacaaaccccctcttttttttttttttataataaaaaaacaaaaacacccgcggaagagggccgtttttttttctgttcgccctcgcgccccgatcggcgggaaaaaaaaaaagtataataaacactaccctcgcacctcgcccccgcgcgcggagggggggccggtgttggcgagcctatatctgttataaattaacattagaagaatgtgagtggttattattaggccgggtccggccggccccataccccacttccacggagggagggggcgggcacacagtgggcgttaacggacagatgtgacgcttgtgtgtgtggggcgcctcttttctcacttcggttgggtggcgcgtnctccgggaggcgcggggagcggagcaggaggggcggaatggcgccgcgaaatagcgccgacattcactgcttttttttttcttt

SEQ ID NO: 82299 - DNA, 948 bp, Zea mays
  misc_feature: Ceres CLONE 1568066
  misc_feature: Encodes the peptide sequence at SEQ ID NO. 82300
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (370)..(370): n is a, c, t, g, unknown, or other
  misc_feature (378)..(378): n is a, c, t, g, unknown, or other
  misc_feature (379)..(379): n is a, c, t, g, unknown, or other
  misc_feature (381)..(381): n is a, c, t, g, unknown, or other
  misc_feature (382)..(382): n is a, c, t, g, unknown, or other
  misc_feature (387)..(387): n is a, c, t, g, unknown, or other
  misc_feature (388)..(388): n is a, c, t, g, unknown, or other
  misc_feature (425)..(425): n is a, c, t, g, unknown, or other
ggagctcaccgcggtggcggccgctctagaactagtggatcccccgggctgcaggaattcgtctcacccctagaaaaaccactcctcctgtcctcccttcctcgcttcccaatctccaaacctctcacttgcacgggacgggagcacgtacacgcggagccaaagcgatcggcgctgcggcggcaagacgtcgtcgtcggcgacgatgacgtggcacgaggacctggccactcacgtggggaacacgggcgttcgcctccccggcgccggaggtcacgcgccggcggcggcgaatgttgctgcggcgggggccgggtggtacggggaggaggaagaggggaggggcggaggaggggtnnnnnncnnnngngggggggnncnnggggnngaagggggggccccccggcgcggccggccggggggcngcgggccgccgcccgccggggagccccgccggccccgggggggcggccagggcggcgcggcggcgctcgggggggggcgccgggcggcccccggggcgggcgccctccggccgcctgcgggccgggtttctttcctgcgcggggtctgcgccccggcttggtggggttcgctctccccccggctgttctccgccttgttttgcggccgctcggcccctgtggtttttggggtttttgggtcggtgggaccggggacatctccgcgcgggaagggctccatgaggaaatctaaatgatcgctggcccccccacctgtgctctctttcgaatcccccggctgtccggagggggcggcggtgcagtggtggtcgtatccgggagatagcgggccttctcctctcgccgggcgcgaaacatttgttagttgtgttttgtctcctagaaaggggttattcactgatttatggcccggacggacagaaagcggtgcgcagattgtgggaccgtctccacaaagatgaaa

SEQ ID NO: 82300 - protein, 171 aa, Zea mays
  misc_feature: Ceres CLONE 1568066
  misc_feature (52)..(52): Xaa is any aa, unknown, or other
  misc_feature (53)..(53): Xaa is any aa, unknown, or other
  misc_feature (54)..(54): Xaa is any aa, unknown, or other
  misc_feature (55)..(55): Xaa is any aa, unknown, or other
  misc_feature (58)..(58): Xaa is any aa, unknown, or other
  misc_feature (59)..(59): Xaa is any aa, unknown, or other
  misc_feature (61)..(61): Xaa is any aa, unknown, or other
  misc_feature (74)..(74): Xaa is any aa, unknown, or other
MTWHEDLATHVGNTGVRLPGAGGHAPAAANVAAAGAGWYGEEEEGRGGGGVXXXXGGXXGXEGGAPRRGRPGGXGPPPAGEPRRPRGGGQGGAAALGGGRRAAPGAGALRPPAGRVSFLRGVCAPAWWGSLSPRLFSALFCGRSAPVVFGVFGSVGPGTSPRGKGSMRKSK

SEQ ID NO: 82301 - DNA, 788 bp, Zea mays
  misc_feature: Ceres CLONE 1568067
  misc_feature: Encodes the peptide sequence at SEQ ID NO. 82302
  misc_feature (493)..(493): n is a, c, t, g, unknown, or other
ccgcggtggcggccgctctagaactagtggatcccccgggctgcaggaattcgtctcacccctagaaaaaagcacgcccacacagcagcatcaacctcgggtgctctgcggccactggactgccctgccagtgcccgtgcccgcgcgcgctagcctagctgctcctgcctggttcgccgtagcccgtagcacaacaacaacaacaaaaaaaaaaaatctccgcgccgcggggggaggtggtctgttcaccttggggagcagcggcgggccggcggccgagaaatgcccggtggcgccttcctcctcaacggcagcggcggcggcatggcggactacggcggcggcctcaccgtacccgtcgtcgtgacctgcctcatggcggcctccggcggcctcatcttcggctacgacattggcatctcaggaggtgtgtcggagatggaggatttcttgaacaagtttttccccgggttgctcaagaggacggcgcgcngcaaccaggacgtgtactgcatttacaacaaccaaggcgctgacgggctttcacgtcgtccctgtacgcgtttcggcatggggggggaccctgcttgccaagacgcctgaacccggcggctgggggccccaaggccgtcatggctgaacgggggggggccttgttctttggcgggggccccttgtttaaagcccgccgggggccaaaaatcgccatgttttatttttcggggaaggaaaccttccccgcccctgggggggtttgggttttcttccggccaaggacaaccgccggg

SEQ ID NO: 82302 - protein, 106 aa, Zea mays
  misc_feature: Ceres CLONE 1568067
  misc_feature (71)..(71): Xaa is any aa, unknown, or other
MPGGAFLLNGSGGGMADYGGGLTVPVVVTCLMAASGGLIFGYDIGISGGVSEMEDFLNKFFPGLLKRTARXNQDVYCIYNNQGADGLSRRPCTRFGMGGDPACQDA

SEQ ID NO: 82303 - DNA, 816 bp, Zea mays
  misc_feature: Ceres CLONE 1568070
  misc_feature: Encodes the peptide sequence at SEQ ID NO. 82304
  misc_feature (414)..(414): n is a, c, t, g, unknown, or other
  misc_feature (415)..(415): n is a, c, t, g, unknown, or other
  misc_feature (654)..(654): n is a, c, t, g, unknown, or other
  misc_feature (667)..(667): n is a, c, t, g, unknown, or other
  misc_feature (741)..(741): n is a, c, t, g, unknown, or other
ccccgcggtggcggccgctctagaactagtggatcccccgggctgcaggaattcgtctcacccctagaaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaaaccgnnacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaaggcgtgctccgcacctacgaacacgtntttctctccgccngcgctccctggtgtccgacatcatcatgtacggcgccaccgactcgtgcttcgcgccctacgggcgacactttncgcaaggcgcggaggctggtcacggggcacttgctcaacgccagcaggtgcggtcccacgccgccgaaaaaaaaa

SEQ ID NO: 82304 - protein, 114 aa, Zea mays
  misc_feature: Ceres CLONE 1568070
  misc_feature: SWISSPROT Homolog: EC 1.14.13.68 4-hydroxyphenylacetaldehyde oxime monooxygenase
  misc_feature (65)..(65): Xaa is any aa, unknown, or other
  misc_feature (89)..(89): Xaa is any aa, unknown, or other
MKLPIIGHLHLMGDIPYVSLAALATRYGPDLMLLRLGAVPTVVVSSPRVAEGVLRTYEHVFLSAXAPWCPTSSCTAPPTRASRPTGDTXRKARRLVTGHLLNASRCGPTPPKKK

SEQ ID NO: 82305 - DNA, 813 bp, Zea mays
  misc_feature: Ceres CLONE 1568074
ggagctccccgcggtggcggccgctctagaactagtggatcccccgggctgcaggaattcgtctcacccctagaaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgctctgtctggggttcggtctcttcttcggctgcagatctggaagggtttcgtggtatccgtcgctacgatctgtcccagtcagagcacctgcatcatctcgggtcgggccatggagactctgctcatctcggaggagcgcaaccaccagctccaccacttctcgggtcgccgggaagaaagcgttagcagcgtcgcctcagtccacgcgcagctaccatgcgggcaaactgcggggcgttccactcggcatcaccgtcggcatcctgccgtccccgcccgcgcagagggttgcactgacccgctcctctcctgagcccaagacaccgaaacatcagctttcacatgggaaaaagcgcaagcggagcaatctctattaaccttttgacggtcccttccttctcgccctgagctctgggcttgccccgggggttctgcaattcgccggctccccagctcccttccggaatcccaaagtttccactcct

SEQ ID NO: 82306 - DNA, 803 bp, Zea mays
  misc_feature: Ceres CLONE 1568075
  misc_feature: Encodes the peptide sequence at SEQ ID NO. 82307
ctccccgcggtggcggccgctctagaactagtggatcccccgggctgcaggaattcgtctcacccctagaaaaaatccacacacacacaacacagcagagagattactacgatccaacagttctagagcaagagagaggaagacacaccgcagagttagcaggctaataacttgcaggagcagcaggaatggcggcgacgcgtcgcctctcttgccttctcctcgccgtgcttctggcaggagtggccgctgccaccgccttcgacgaagcggctgctgccggcttcgggcttggccacggcgcgcgtttcgcgcgcaagcatggacgagctgccgctgagatgccccagccggagccacaacctaaaactaagccggagccccatatgcagccactgccccagccagaacctaaaccgaaacctatgccacatccagagccaaagcctgaacctcaaccaaagcccaaccctgaacctcaaccaatgcccaagcctctaccaaaatccaaaccagagccattgcctacaccgaagccagaacctaagcccgaacctaagccagagcctaagcccgaaccgaaaatgaagccaaagccaaaacctgaatcaaaaccagagccaaagccagatcacaaaccctgagccaaagccagagcccgaaccaaaccagagcctaaaccagaacccaaacccgagccaaagccggagcccgcaaccaaaaccagagcctaagccagagccctaaccttggaaccgaaaccagaagcaaacccagagcccccaattaagccagagccttac

SEQ ID NO: 82307 - protein, 151 aa, Zea mays
  misc_feature: Ceres CLONE 1568075
MAATRRLSCLLLAVLLAGVAAATAFDEAAAAGFGLGHGARFARKHGRAAAEMPQPEPQPKTKPEPHMQPLPQPEPKPKPMPHPEPKPEPQPKPNPEPQPMPKPLPKSKPEPLPTPKPEPKPEPKPEPKPEPKMKPKPKPESKPEPKPDHKP

SEQ ID NO: 82308 - DNA, 855 bp, Zea mays
  misc_feature: Ceres CLONE 1568076
  misc_feature: Encodes the peptide sequence at SEQ ID NO. 82309
  misc_feature (591)..(591): n is a, c, t, g, unknown, or other
  misc_feature (674)..(674): n is a, c, t, g, unknown, or other
ggagctccccgcggtggcggccgctctagaactagtggatcccccgggctgcaggaattcgtctcacccctagaaaaatcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccggtggaagggaaacccgcgccggaggcaggctgcgcggtcggtgacggcgcgggtcccgacggcgggacggacgtcatcatcgtcggcgccggagtggctggatctgcgctggcgtacacgctcggaaaggatggccgcggggtgcatgtcatcgagagggatctgacagaacctgacagaattgtgggcgagctgttgcaacctggnagttacttgaaatataatgagttaggccttccagattgtggtggaagaaattgatgccccacggggtgcttgggtacgcattnattcaaagatgggaggaaaacacaaggctgtgcttaatccctaagaggaagttccaattctgatggttgcctgggagggagcctttcccaaaggggggaggtttattaccaaaggataggcgttcaaaaaaggctgcgcttctttgcccccaatggtccaattagaaaacaaggggactgt

SEQ ID NO: 82309 - protein, 130 aa, Zea mays
  misc_feature: Ceres CLONE 1568076
  misc_feature: SWISSPROT Homolog: EC 1.14.99.7 Squalene monooxygenase
MAAMAAAGGVGLHLIGAATATLIAAVLVAAVLGRRRRARAQAPPVEGKPAPEAGCAVGDGAGPDGGTDVIIVGAGVAGSALAYTLGKDGRGVHVIERDLTEPDRIVGELLQPGSYLKYNELGLPDCGGRN

SEQ ID NO: 82310 - DNA, 831 bp, Zea mays
  misc_feature: Ceres CLONE 1568078
  misc_feature: Encodes the peptide sequence at SEQ ID NO. 82311
ccccgcggtggcggccgctctagaactagtggatcccccgggctgcaggaattcgtctcacccctagaaaaactatgtggcgctgcaacgatgagcttcgtgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggttttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaggcgcccgctgctgcccccggaccttccccagacgacgagatcgccgacgtcatcggcgcgtttcacgtcctcgcggagctcccgcccgacagcttcggcccctacatcatctccatggcgacggccccctcggacctgctcgcccgtggaactcctgcaacgccgagtgcggcgtgccccaaccgcctgccccggggtgccgtctgttccaaaaagttggcccaactttaaatcgggcgccccccgttcccgggaaacgc

SEQ ID NO: 82311 - protein, 252 aa, Zea mays
  misc_feature: Ceres CLONE 1568078
  misc_feature: SWISSPROT Homolog: EC 4.1.1.31 Phosphoenolpyruvate carboxylase
MWRCNDELRVRAEELHSSSGSKVTKYYIEFWKQIPPNEPYRVILGHVRDKLYNTRERARHLLASGVSEISAESSFTSIEEFLEPLELCYKSLCDCGDKAIADGSLLDLLRQVFTFGLSLVKLDIRQESERHTDVIDAITTHLGIGSYREWPEDKRQEWLLSELRGRRPLLPPDLPQTTRSPTSSARFTSSRSSRPTASAPTSSPWRRPPRTCSPVELLQRRVRRAPTACPGVPSVPKSWPNFKSGAPRSRET

SEQ ID NO: 82312 - DNA, 806 bp, Zea mays
  misc_feature: Ceres CLONE 1568080
  misc_feature: Encodes the peptide sequence at SEQ ID NO. 82313
  misc_feature (553)..(553): n is a, c, t, g, unknown, or other
  misc_feature (578)..(578): n is a, c, t, g, unknown, or other
  misc_feature (615)..(615): n is a, c, t, g, unknown, or other
  misc_feature (668)..(668): n is a, c, t, g, unknown, or other
  misc_feature (697)..(697): n is a, c, t, g, unknown, or other
tccccgcggtggcggccgctctagaactagtggatcccccgggctgcaggaattcgtctcacccctagaaaaagtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaagatcttcagggaccaggggaagaacattcaggaatacaagggccctagggaggctgatggcattgtggattacttgaagaagcnggttggccctgcgtccaaggagatncagtcaccagaagatgcgacggcccttatcgatgacnagaagatctacattggtggtatcttcgctgaattcagcggcaccgaatttacnaaacttcatggagtcgcagagaagctgangtctgactacgactttgggccacactttgcatgccaccaccctcccaccgtgttgatgcaccaatgggacggcccattggtcaggctgctgaaacccttttaatgagct

SEQ ID NO: 82313 - protein, 224 aa, Zea mays
  misc_feature: Ceres CLONE 1568080
  misc_feature (35)..(143): Pfam Name: Thioredoxin Pfam Description: Thioredoxin
  misc_feature: SWISSPROT Homolog: EC 5.3.4.1 Protein disulfide-isomerase
  misc_feature (143)..(143): Xaa is any aa, unknown, or other
  misc_feature (151)..(151): Xaa is any aa, unknown, or other
  misc_feature (164)..(164): Xaa is any aa, unknown, or other
  misc_feature (191)..(191): Xaa is any aa, unknown, or other
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYEIQGFPTIKIFRDQGKNIQEYKGPREADGIVDYLKKXVGPASKEXQSPEDATALIDDXKIYIGGIFAEFSGTEFTKLHGVAEKLXSDYDFGPHFACHHPPTVLMHQWDGPLVRLLKPF

SEQ ID NO: 82314 - DNA, 865 bp, Zea mays
  misc_feature: Ceres CLONE 1568085
  misc_feature: Translation starting site: 131
  misc_feature: SWISSPROT Homolog: EC 2.7.11.1 Non-specific serine/threonine protein kinase
  misc_feature (865)..(865): n is a, c, t, g, unknown, or other
ctccccgcggtggcggccgctctagaactagtggatcccccgggctgcaggaattcgtctcacccctagaaaaaaaaatccatatgctcagctcccgcctcctcccatccccggaccccggaccccggccatgggcgcttgcttctcctccgcctctgccgcccccgccggcgccgccgtcgacgagcgccgcccgtccaaggagggcgacggcaagaagaggcgccgcgccgccggggcatcgccggatgccgcggcgcccgtgcgcgtggagttcggctacgagagggacttcgaggcgcgctacgaggtcggccgcctgctcggccacggccagttcggctacaccttcgccgccaccgaccgcggctctggggaccgcgttgcccgtcagcgcatcgacaaggccaagatgacccgcccctgtgctgtggaggatgtgaaaagagagtgaagattcttaaagcacttaaaggacatcagaatattgttcacttctaccatgcatttgaagatgattcatacgtgtacattgtgatggagctatgtgagggcgtgaaactattagatcgggattttggcaaaaaagaattaccgcctaaaatgaaaaagatgctgcagggggtaattccccaaatggcccaaaggacctggctgaattgccatcggcgtggggttaatttcccccaaaatttgaaggcctgaaaaattttccttttttaaaatcaaacaagggagggagttccccccttaaaagggcaacaaattttttgggttttgtcccaattttccctttaacccccggggaaaaaaagtttcccccggaaaatttgttggggagaaagcggatggtccatagggcccn

SEQ ID NO: 82315 - DNA, 846 bp, Zea mays
  misc_feature: Ceres CLONE 1568088
  misc_feature: Encodes the peptide sequence at SEQ ID NO. 82316
ggagctccccgcggtggcggccgctctagaactagtggatcccccgggctgcaggaattcgtctcacccctagaaaattaggagtacacagtcctccttataattggagttgcacaagccgctcagcaaccttcttcttcatcttctccagtcctccctcccgccccgtccatcgacacagcagcttgcttgtcaccaagctagccaagcaggaggagtaagagtacagccagagagagagagagagagagcaccaccctgattccacccaccgctgtcccttgcttatttacaggcgttcgtgatcaccaacagctactcgtcagctagagagagtgcaacgggccgggcagagctagagagagagagagagaaagcggccttctttttctgtgttcaccaagcaacaaccccagtccaagctctccgtgttggccgatcgtttccggcgaacagagcaagcaactcacagccccggaggcgactgactgactggcgcaactgtgttgctcgatccatcgaagcagacgcaggcggcggattcgcggaggagagatgatgagggagcagagcctcctggaagcgacgtgcggcgacttcttcgaccacatcgacgacctgctcgacttccccagggaggactcggcccgccgacgtgctccctgctgggacgcgccggcgcccggggagcccgcttgtcgtcggcgcgcaatcattaacgttcggcccgcgcctggcagtggcgcccgcttcccccccgggggtgggggcccgtcctcttccccgcgcaaaaaagaaaaccacccggcctttctttcgcccaccggcgggggccccaaaaatggt

SEQ ID NO: 82316 - protein, 97 aa, Zea mays
  misc_feature: Ceres CLONE 1568088
MMREQSLLEATCGDFFDHIDDLLDFPREDSARRRAPCWDAPAPGEPACRRRAIINVRPAPGSGARFPPGGGGPSSSPRKKENHPAFLSPTGGGPKNG

SEQ ID NO: 82317 - DNA, 828 bp, Zea mays
  misc_feature: Ceres CLONE 1568089
  misc_feature: Translation starting site: 322
ctccccgcggtggcggccgctctagaactagtggatcccccgggctgcaggaattcgtctcacccctagaaaaacttacccacaaatcagtttaaggcctaaaccaaggttagtcccaaacaatgcagtgttaggttgtctaatgtcttggtgagtagtgtgttcataattttgcaggcgttagtttgtaatggcttctttgcttctagtgtcattgttagtccattattatcattaaaattaactcacaatcagaaggatttgtactctttggaaaccattagtcgcaagttcggtgaagtgctcgaggcacttttctggatgtcaaacgatgtaattaggccaaaggatttagacttcactgagatatacccgagactaagggagactaggttttggtcacaattcaaggactgataggggcgatcgatggtagtcacttccctgcaagtgtcccaatgtcagagcaagcaaaatacatttgggaggcacgggtacgaatcacagaagaggattattgccttatcgattcccggtacccaaactggaaaggatacctggcaccatacaagggaatagaagtaccacgtggtcagattgggcagcatggaacaacacccagttgggtggtgaagagaggttttttaacttttgcacatttctttctttaaggaaatgttaataaaaaagggtttggggggaatacccaaaatgggtttccaaccttgccccggggtaggggaccccgggaaaactccccctccccgtgaagccctcccacctcctgggggcttcccccccccccccttttttccccccccccccccc

SEQ ID NO: 82318 - DNA, 861 bp, Zea mays
  misc_feature: Ceres CLONE 1568091
  misc_feature: Pfam Name: SRP-alpha_N Pfam Description: Signal recognition particle, alpha subunit, N-terminal
gagctccccgcggtggcggccgctctagaactagtggatcccccgggctgcaggaattcgtctcacccctagaaaaaaagggcccaaggcttctcctggcatagggatgaatgttagtctcgtcttgcctcttcctctgggaggatacgggcgccgtcccaggtagaggtagggtcgccaccatgctggaggagctgctcatcttcacccggggcggcctcatcctgtggtcgtcctgccgggcgctcggcgccacagccatcatgggctcccccatcgacgccctcatccgctcctgtctcgctcgaggagcgatccgccgacgccagcttctcccaggactattacgccctctagtggaccttccacaacgacctcgacctggcctggcactctcgagacaataagatacgccgcgtactcaacgtcgacaatctcctcgccgccgtccgaatggagttctcccagatgtactaccccaagcgcaactcctacgatgactttggggacatcgtccgccagctccaacgcatagactaggcgcgcgacgagtaaaaaaaagccaaagggggggcgctctcgtcccgtccgcagcctgctctcacccagaagaagcctgttcccaagggccgcgggcggtgattcccgcggccgccctgcctaacagggacggctcctggtgccaagcgatgacttctgatgggcgacgggctatggccaatccagaaccccccgtacttctggaaaaatggtgcctttcaaggggcccaagaaaaatggtggtccccaaggggagaattccttcccatgggcccgcactggttgtccaaggggaaaagggaggaatgggggcccccccat

SEQ ID NO: 82319 - DNA, 894 bp, Zea mays
  misc_feature: Ceres CLONE 1568094
  misc_feature (894)..(894): n is a, c, t, g, unknown, or other
cgcggtggcggccgctctagaactagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccgggccgccccgccgaagaagcccgcgctgcagggcgcggccatcaagccgctcctggccttcatcgcgaccggggtcctcatctggctcatcccgcccccccgcccggcgtgccccgaaacgcgtggggaactcctaacccttcttccttctccaccaatgggggggaataataacccaacccgcttgccccttgggcgcgggccgccctttcctggggctcggggggccgccggggcttaaggcgcaacgcttccagtttcgccggggggcccttttttcgggcctttcggggaaaccccgaatccctctggggcttaatcggggcttccgccttttcttcttttggggggagggggggatccaataaagaaaccggggcctctggggctcccgcgcgggcccctcttacgcccttgtcgtgcaaaccccctttttgtgggggtcctgttactccccttagaggcctatcgggggtattatatan

SEQ ID NO: 82320 - DNA, 781 bp, Zea mays
  misc_feature: Ceres CLONE 1568096
  misc_feature: Encodes the peptide sequence at SEQ ID NO. 82321
  misc_feature (592)..(592): n is a, c, t, g, unknown, or other
  misc_feature (655)..(655): n is a, c, t, g, unknown, or other
  misc_feature (781)..(781): n is a, c, t, g, unknown, or other
ctccccgcggtggcggccgctctagaactagtggatcccccgggctgcaggaattcgtctcacccctagaaaactcgcctcgccgtcgccgtcgtcatctcagctttaattcgcagcaggcgggcagtggcaggccaggccacggcgtccagcaccagctacgcctgtgcgcgcgcttgtgcagtacctacgttggtgggtgggtaggtagctagtgcggcggagcatcgatcgcgcggtactctcagttccatccgtcgagagatcgaccggtcgtcgatcgacatggcgggccggggaggagcctcggcggcggcgccgttgctggagaagacagcggcggcggcggagtcgggcggcgggtgctgctacgtggacgggtgccccgggtgcgccgtggaccggcacaaggcggcgaacccgggcattccctacggcaacttcatctacgtctggatcgtcaccctctgcacagccttaccgatatcgtcgctcttccccttcttgtatttcatgataagagacctgaatgtcgctaaaagaacagaagacatcgggttctacgctgggttttgtaggtgcctcattcatngttggtagatgcttgacttcaacagtatggggcatagcggcagaccgcgttgggaaggaaacntggtgtcgtgttcggcattttcctctgtagttgtgttccacaccattgtttgggtctgagtggtcaactactggaatggcaatacctaccccggtttctggcctgggtgccttgaaatggttttgn

SEQ ID NO: 82321 - protein, 104 aa, Zea mays
  misc_feature: Ceres CLONE 1568096
  misc_feature (103)..(103): Xaa is any aa, unknown, or other
MAGRGGASAAAPLLEKTAAAAESGGGCCYVDGCPGCAVDRHKAANPGIPYGNFIYVWIVTLCTALPISSLFPFLYFMIRDLNVAKRTEDIGFYAGFCRCLIHXW

SEQ ID NO: 82322 - DNA, 795 bp, Zea mays
  misc_feature: Ceres CLONE 1568099
  misc_feature: Encodes the peptide sequence at SEQ ID NO. 82323
  misc_feature (286)..(286): n is a, c, t, g, unknown, or other
  misc_feature (305)..(305): n is a, c, t, g, unknown, or other
  misc_feature (306)..(306): n is a, c, t, g, unknown, or other
ctccccgcggtggcggccgctctagaactagtggatcccccgggctgcaggaattcgtctcacccctagaaaaagaggccacacacagtacgtacaagcctctcatcagcaatggagtccaccaagctctccgcgctgctggtgctcgccatgctcgcgctctcctcgtccccgctggctctagcgtgggagaaggcggaaccggagtgccactcgtgcgagtccggctcgccaccctcgaccggcggcgtccccctgcctcccgtcagcataccgtcagtcccgnctgcccccctgtcagcatnnaccgtcgggtcccccctgcccccccctggtcaggcatacccgttcaggtgcccccttgcccggccgggtggaacccctcccctccccatttcccgaatccgttggggggggaaaaacccccaagcccccgaaccgaaaaaaaagggggaaccccccgggaaaggggggtggggcccccaccggccttcccgtgttttccccccccggaaaggcccccaaaaaaaccccccagggccccccaaaagggggccggtgtttccctttctgggggaaaaaaaaaggggggggccccccccccctattgggaaaaaacggccgcgccctctaaaaaaagctttcttgggggggggcgcccccccccgggggggtgggggggggaaaaaattttttttttcttcggggggggaaaaacaagaagagggggtgggggtgcaccattttttttttggggggggggaggaaaacaccccccccccaaaaatatgtttt

SEQ ID NO: 82323 - protein, 228 aa, Zea mays
  misc_feature: Ceres CLONE 1568099
  misc_feature (59)..(59): Xaa is any aa, unknown, or other
  misc_feature (65)..(65): Xaa is any aa, unknown, or other
MESTKLSALLVLAMLALSSSPLALAWEKAEPECHSCESGSPPSTGGVPLPPVSIPSVPXAPLSAXTVGSPLPPPGQAYPFRCPLARPGGTPPLPISRIRWGGKNPQAPEPKKKGEPPGKGGWGPHRPSRVFPPRKGPQKNPPGPPKRGPVFPFLGEKKRGGPPPPIGKKRPRPLKKAFLGGGAPPRGGGGGKKFFFSSGGEKQEEGVGVHHFFFGGGEENTPPPKICF

SEQ ID NO: 82324 - DNA, 820 bp, Zea mays
  misc_feature: Ceres CLONE 1568100
  misc_feature: Encodes the peptide sequence at SEQ ID NO. 82325
  misc_feature (303)..(303): n is a, c, t, g, unknown, or other
tccccgcggtggcggccgctctagaactagtggatcccccgggctgcaggaattcgtctcacccctagaaaaatgtccaggtaaaaggaaaaatcgccccatcccctgactatcactggctcactgcccttccacctacaggttccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcangcagtcgctgcagcagctattgacgaggtcgcccctgtaggtgcaggcactggtgatggcgatgcatctgcatcagcggcttttacgcaaccatccgatgttgccgaggcattacttgtggtgcaaacgccaaagtcaaccacttttgctgaagcatcacctgtggcacagacgcagaagccagcactgatgctgaaggattggtgcctgcacaaataccagccactgctgtagcatcagcttcgttgccaaacccaaaaccagctcaagctaatgctgatgctgcagctgcaattttctgccaacaagggcaatggggtgggtgctaataataataggggtgaatgttaaaataaaaaacaagaaggagaggccatgattgacaggggaaaggagttatgggggaggaggaattaggggaaaaaggttttttggtttctccggtaaaacaggctttttttacctaaaagaacaaaggggggcaaccctaagggtggcggggttttagttcggggga

SEQ ID NO: 82325 - protein, 127 aa, Zea mays
  misc_feature: Ceres CLONE 1568100
  misc_feature (50)..(50): Xaa is any aa, unknown, or other
MVKKPNGVAKATATSADAAAQPSKENPSTPGLVKASKFKKRKVKANRAKXAVAAAAIDEVAPVGAGTGDGDASASAAFTQPSDVAEALLVVQTPKSTTFAEASPVAQTQKPALMLKDWCLHKYQPLL

SEQ ID NO: 82326 - DNA, 1306 bp, Zea mays
  misc_feature: Ceres CLONE 1568102
  misc_feature: Encodes the peptide sequence at SEQ ID NO. 82327
  misc_feature (62)..(62): n is a, c, t, g, unknown, or other
  misc_feature (1092)..(1092): n is a, c, t, g, unknown, or other
  misc_feature (1253)..(1253): n is a, c, t, g, unknown, or other
  misc_feature (1306)..(1306): n is a, c, t, g, unknown, or other
aaaggataaaggctcccccaattatgtggtgtgttgatgtttcggtggtgtgtgacggggcntagaagattccctgcgagaaacggatataagggggtggcggccgctctagaactagtggatcccccgggctgcatgaattcgtctcacccctagaaaaaactgcaagagggaagagaagcatcgcatctctgagtctgaaaccctagccgcctgtctccctgtccggtctccactcgtccgggcgacgagacgacgacggagggtttctgcgggggatttgtttgtcgctgactctccggcgaccaagatgaggccggttttcgtggggaagctagattatgatactcgccactcggagctcgaccacctcttctaccgctatggcagggtcgagcgcatcgacgtgaaggcaggctttgctttttgtctactttgaggatgaacgtgatgggcagggagtgccataacatcctctctcacggctattctcattatggccccctagcaaaaccgcaggcctttccatgatatgatgtggtgcaccaggccgtgaatcacgaggcttgctaagaacgatggatgttgcgaaccgaaccggggcaccgagaagttatctttgagcgcccacttaagaaatcgatgaggtcttggcgatggtctaccacctatgtgaaaatcattaacgagggtaaccagcctcagcaactgctcccaggtttgtgataaatgtgccgggataaatgggaactgaccgtcgtggtaggccgaccgcgctgtatttttttgcgtgtaggaagacacaggagtgtcgcgttccgaacgtaggcttgggtcgcccttacactacaaaatagtataacacgcgtactataaagagacgaacatcgcggctctgtcgacggctgctctctatgggtgcggcctcgcacgggcgtgctctctacgcataacatcacgctctctatatcacatacagaggagaaatagcctctcgtcgacaaagcagacgcaggtgtatactctttgcgatgaaatagactcgatcattattctaccttgctgctgccataatgtcacgctgaatacatntttacacttcacaaagacatatgggagcggcgaaaatattcccaccagcgagatacataaagagtcgaagactagcgcatcgtgtctatcgggagcaatccacaccttgtccttactcgaattacggcgctgaggaagcgtccccaacaatcacccgtacnattgtattcgctcctcgtagataaacgtagagttatagctcgtgcttataaan

SEQ ID NO: 82327 - protein, 42 aa, Zea mays
  misc_feature: Ceres CLONE 1568102
MRPVFVGKLDYDTRHSELDHLFYRYGRVERIDVKAGFAFCLL

SEQ ID NO: 82328 - DNA, 1238 bp, Zea mays
  misc_feature: Ceres CLONE 1568103
  misc_feature (21)..(21): n is a, c, t, g, unknown, or other
  misc_feature (23)..(23): n is a, c, t, g, unknown, or other
  misc_feature (64)..(64): n is a, c, t, g, unknown, or other
  misc_feature (71)..(71): n is a, c, t, g, unknown, or other
ttatttttgttacccccctananacccgcgggtgggggggtgcgcggtgggatcacccacaccncccgaantgatggaggaatccccgcggtggcggccgctctagaactagtggatcccccgggctgcaggaattcgtctcacccctagaaaaatctgcgccatggaagacaagcggcggatctctatatctagaagggttcccgcctgtcacactgtacggaaatccactcgtccgggtgacgagacgaccacggagggtttccgccggggatttggttgtcgatgactcgcgggcgaccaacatcaagccggttttcgtggggaacctgggctatggggggggccgctcagaagatcaaccacctcatctaccggctatgacaaggtcgagggcatcgacatgagatcgggccttagctacttgtcttctttagaggctgaaggggacggaaaatgaagccgaacactgatcgtgtcgtaggggggtccccccacacctttagcataccacaggcctcttccgatgggcatgcttcacgccgtaggaatccaaggaagccctttcagctagagggacgaaccaaacccacagaaggtaaaccgccacaggtccacaccctacaaaacatgggggtaggagcgatgtgaagagtgtggcatgccggaaggggacacacccaattaacttaagaagggaaaatatcggcgaaacgcaaccaccctactcgcatatgcaccttcttttgtagatataaccgctacactcaagcgtacgatacacgtgcaccaaacccgggcaaacacacaagcctccagcggccattcactaaggtgacggagagccatgtagggagagaagcgaggccacaaacaactaaagatccccacaaacaacaggggcatagtaatatgaaaaacctccaaaccacgaatccgccagacggctctcaagagcaataccctggacaaagatacaagtacggaaaatcacacatgggtatggagaaaatgactccgtcctcctctggagggcgaatggccaacccagtaaacaactgatgtagcgcgcgccttattgatcaactgcgcgcggcgccgcagaatcaaaaatacaagatgcgtctagtgaattcattggactaattgcggcgaggctgacagtatatctgatcatcactgctcgagttcatataaaatgctaacagcgaacccgtttagacatccggtgaacgaag

SEQ ID NO: 82329 - DNA, 837 bp, Zea mays
  misc_feature: Ceres CLONE 1568109
  misc_feature: Encodes the peptide sequence at SEQ ID NO. 82330
  misc_feature (476)..(476): n is a, c, t, g, unknown, or other
  misc_feature (509)..(509): n is a, c, t, g, unknown, or other
  misc_feature (521)..(521): n is a, c, t, g, unknown, or other
  misc_feature (527)..(527): n is a, c, t, g, unknown, or other
ctccccgcggtggcggccgctctagaactagtggatcccccgggctgcaggaattcgtctcacccctagaaaaggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaagcggcggctacggcggtggcgggcgccgtgatggcngcggcggctacggcggtggcgggcgcggctacngtggcggcggcngctacngtggtgggtgcggcggctacggcgggtgcaaccgtggcggcggctacggcaactccgacgggaactggaggaactgagcggtgggggcccgcgcggccaagtatccctgtcgctaccggtgttgtttaccctagtccaggagggtttatcttcgttcgtctcatggttgttgttgcccatctgtggtttttgattgcaagggcccctttgtgtcagttggttaggggctgggttcatccccgggtttcggcaggacccctgcttcaaccaccattggactgcgggatcaatgggatgcttggttcccccc

SEQ ID NO: 82330 - protein, 156 aa, Zea mays
  misc_feature: Ceres CLONE 1568109
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (115)..(115): Xaa is any aa, unknown, or other
  misc_feature (126)..(126): Xaa is any aa, unknown, or other
  misc_feature (130)..(130): Xaa is any aa, unknown, or other
  misc_feature (132)..(132): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGSGGYGGGGRRDGXGGYGGGGRGYXGGGXYXGGCGGYGGCNRGGGYGNSDGNWRN

SEQ ID NO: 82331 - DNA, 879 bp, Zea mays
  misc_feature: Ceres CLONE 1568112
  misc_feature: Encodes the peptide sequence at SEQ ID NO. 82332
  misc_feature (422)..(422): n is a, c, t, g, unknown, or other
ctggagctcaccgcggtggcggccgctctagaactagtggatcccccgggctgcaggaattcgtctcacccctagaaaaactctcctctcgccccgcctcgtcatgtcacgtctcccaaagtcccatctcgccttcgcttaaacataaaccacacccatcgcacccagccagccctcgccatccatggccaccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgccgccgcccccaaccatgtccaccaccctccccatcaccaccagtcggtgccttcccccaggaccccctccacagtggtccgcgcanggacatccgcctccgccgccccgtggctatgggccctcaccgccgcagcaccagcatgtgccgcctccgccaccacgcggctacggacctccaacaaccgcctccacaagggcacgtacctccgccgccctccgccgagaaaagggcccacgggccttcaccacccgggcccagcacgtaatggccgccccctgctaccacacggcccccggacctcccgccaccggggccagcaaaatgccaaccgccacaacgggccaccgggccctccacccacgggggcaagggggtaaacggcggacttcgggccgcaaaaagggcaaggggccctccgcccacgggggggaagaaataaacggggggtcttccaacacacaaaagggacacgggggccttccaaccccccgaaaacgaaagggggaccccccccgccccccgaatccctgggggggggggc

SEQ ID NO: 82332 - protein, 292 aa, Zea mays
  misc_feature: Ceres CLONE 1568112
  misc_feature (140)..(140): Xaa is any aa, unknown, or other
GAHRGGGRSRTSGSPGLQEFVSPLEKLSSRPASSCHVSQSPISPSLKHKPHPSHPASPRHPWPPPPPSTCARSVPSPSPPRGHARSSTSSPGPSPLPNRPTPTALPLQRPPPPPPTMSTTLPITTSRCLPPGPPPQWSAXGHPPPPPRGYGPSPPQHQHVPPPPPRGYGPPTTASTRARTSAALRREKGPRAFTTRAQHVMAAPCYHTAPGPPATGASKMPTATTGHRALHPRGQGGKRRTSGRKKGKGPSAHGGEEINGGSSNTQKGHGGLPTPRKRKGDPPRPPNPWGGG

SEQ ID NO: 82333 - DNA, 829 bp, Zea mays
  misc_feature: Ceres CLONE 1568113
  misc_feature: Encodes the peptide sequence at SEQ ID NO. 82334
tccccgcggtggcggccgctctagaactagtggatcccccgggctgcaggaattcgtctcacccctagaaaaagtgctctcgaaagcgccggatctaaccttcaccacctccggggcctcctccgccaccgccgcctgccaggcggcctccactcctttggctgctacgcctcgccacaggcatcctcgatggtcgccaaccttgtggagggcgtgtcgtaccccttcttctactcgctcgccgacatgggtaccctccccgaccaccccacaagaacatcgctcgcctcctcaaggccaagcgcttccgcaagcccgatatctccgagaccatccaggagctgctcggcggcgaggtggggagggggcaaccatccggtgggttggtggtggacgtgggtgccaatgttggcatggcatcattcgtggccggctggccgccgtgacggagtttcgggtgctggcattcgagcccgtgttcgagatctgcagcggaatgcgacggggtgtacctcaacgggtgcaggaccgcatggggtgtatcacgctgcgtcgctgcaccttctgatcaaattgggactataccatgcacaaggggaatggtcaactgggaaaaaggctttttctgcagaagggacaaagttacctttcaagccaaaggccaaaattgctggtgaaaattccccaattcccttgggaaaaaatttttcccaaaaacgagaagatttttaaaaaccctaaggtaagtttcaagggcgggagaaacccccctctgggggagggggccaaaaattttttttttaaggggaaaaaaagaaaactcctttta

SEQ ID NO: 82334 - protein, 180 aa, Zea mays
  misc_feature: Ceres CLONE 1568113
MVANLVEGVSYPFFYSLADMGTLPDHPTRTSLASSRPSASASPISPRPSRSCSAARWGGGNHPVGWWWTWVPMLAWHHSWPAGRRDGVSGAGIRARVRDLQRNATGCTSTGAGPHGVYHAASLHLLIKLGLYHAQGEWSTGKKAFSAEGTKLPFKPKAKIAGENSPIPLGKNFSQKREDF

SEQ ID NO: 82335 - DNA, 789 bp, Zea mays
  misc_feature: Ceres CLONE 1568117
  misc_feature: Translation starting site: 183
  misc_feature: SWISSPROT Homolog: EC 3.6.3.44 Xenobiotic-transporting ATPase
ccccgcggtggcggccgctctagaactagtggatcccccgggctgcaggaattcgtctcacccctagaaaaactggatcccaccttttcaaggaatgcttgcttggggctttgtcttcaaaaacagtagtttatgttactcatcagattgaatttctaccggcagctgatctcattttggtcatgaaagatggtaaaatagcacaggcaggaaaatacaatgaaattcttggttcaggagacgagttcatggagttagttggtgcacacaaggatgctctcgcaaattggacacaataggtgctgcaaacagaagcaacgagggatccccttccagaggtacagcaaaacttaccagatctctatcatcagctgaaaagaaagataaacaggacgaagggaacaatcagagtggacagctggtgcaggaggaagaaagagaaaaaggcaaggttgggttttgggtctactggaaatacctcaccttagcttataagggtgcactcgtaccgctagtgttgcttgcacagctacttttccaagtcctacaaattgggagcaattactggatggcttgggctgctcccgtttcaaaggacgttgagcctccagtgagcatgtcaacactgatatatgtctatatcgcgttggctgttggaagctccttctgcgtcctctaagagcgttgtttcttgtacagcctcatatagacagcgactctattattcgacagatgcacatgtccatattcagagccgctatgtctttctttgattccactccgagtgaa

SEQ ID NO: 82336 - DNA, 822 bp, Zea mays
  misc_feature: Ceres CLONE 1568119
  misc_feature: Encodes the peptide sequence at SEQ ID NO. 82337
  misc_feature (544)..(544): n is a, c, t, g, unknown, or other
  misc_feature (545)..(545): n is a, c, t, g, unknown, or other
  misc_feature (557)..(557): n is a, c, t, g, unknown, or other
ctccccgcggtggcggccgctctagaactagtggatcccccgggctgcaggaattcgtctcacccctagaaaaaacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagttggtgatgggacaacttctgttgttgttctagctggagaacttttgaaggaggctgagaagttaattaacatgaaaattcatccaatgactattattgcaggttacagaatggctctcgagtgtgccagagattctttgctaaaaaagaccatggacnnacaagaaatacngataaattcagatctgatctcatgaatattgctatgactactcttagttcaaaatactttcccaagacaaggagtacttcgctgaacttgcggttgatgctgtcttgaggctttaagggtagcacccactttggaatctattcaaattcttgaaaaaacctggaggatcttctaaaggattccttttttggacgagggttccattcttgacaagaaaaattggcattggggcagccccaaacccatggaaatgcccaaaattttt

SEQ ID NO: 82337 - protein, 152 aa, Zea mays
  misc_feature: Ceres CLONE 1568119
  misc_feature (141)..(141): Xaa is any aa, unknown, or other
  misc_feature (145)..(145): Xaa is any aa, unknown, or other
MERVLKDDAVEEKGERARMASFVGAMAISDLVKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARDSLLKKTMDXQEIXINSDLIS

SEQ ID NO: 82338 - DNA, 713 bp, Zea mays
  misc_feature: Ceres CLONE 1568120
  misc_feature (143)..(143): n is a, c, t, g, unknown, or other
  misc_feature (465)..(465): n is a, c, t, g, unknown, or other
  misc_feature (466)..(466): n is a, c, t, g, unknown, or other
gggctcccgcggtggcggccgctctgaactagtggatcccccgggctgcaggaattcgtctcacccctagaaaaaaacctcatcttctctccttttgctcggaacgcacacacagcccggtccccgatctccgatcccctcgntcgatccaagatgcagatcttcgtcaagacccctcactggaaagactatcacccctcggagggtgggagtctttctggacaccattgacaacgtcaagggcaaagatccaggaaaaagggaggggcatttccccccgggaacccaagccaaagggggggctttcaattcttttccccttgggggaaaaaccaaaccctttctaaaggggaaaaacgggggggccccccccccaccccttttttgggcgccccgaaacttttttctcaaaaaaattatttttccccctaaaaaaaaaagagggggggaagaaaaaaaaaaatnncccccccccccctttttttttcaaaaaaaaaaaccctgggtggggggggtttccctacacccgcccgcgggggcccctttttttataaaaggggggggggggaaaaaaaaaaaaccctaattttttttttctccaaaaaaaaaaattatattttttttttgtgccggcccccacaaaaaaaaaaaaaaaccccccccccccttcaaaagaggggggggggggggggagaaaaaagagaaacctccct

SEQ ID NO: 82339 - DNA, 813 bp, Zea mays
  misc_feature: Ceres CLONE 1568121
  misc_feature: Encodes the peptide sequence at SEQ ID NO. 82340
tccccgcggtggcggccgctctagaactagtggatcccccgggctgcaggaattcgtctcacccctagaaaaagtcaccgcccccctcctcgccgtccactggtgccgagccggcgcgggtggagatccgttcgctttggatcgacttcttcgtgtttgggttgaagccgctcgatttgctcaccagaaattcagattttcgagtggaattcgcttaatatagcaatgcactagggtttactgtgcaccactaggctactgcctctgctattaggaagccgacatctgttgtttccgaagtctttcaagtctctgttgggtggcgttgctattgtgggtgtgataacatgataaagcaatttcttggacgtctccccaagaagccatcccaatctggagataagggatctattgggcgggccagcccttccgtgtcgcaccagccattgggtccgagaggctgagacaggcccaccaacttgagtagccctccacgggttatcttcaagctctgggcctcagttttgggaaggggatggatgttcccgcaattgcttcccgaaagggccccgtgaaacggggatttcggcccctttcacaatttttgggggggtttcccgaaggttttaagggggcgggccccacacacaaaaaaaaaaaaaaacttttttttaaaaggaaaagttgaaaattttggggtggcccccccatttttgtttttccccccccccccccccaaagaaaactttggggggggagaggggggataaaaagggggggccccccttttttgggggggagaccctcttttaa

SEQ ID NO: 82340 - protein, 38 aa, Zea mays
  misc_feature: Ceres CLONE 1568121
MIKQFLGRLPKKPSQSGDKGSIGRASPSVSHQPLGPRG

SEQ ID NO: 82341 - DNA, 796 bp, Zea mays
  misc_feature: Ceres CLONE 1568122
  misc_feature: Encodes the peptide sequence at SEQ ID NO. 82342
  misc_feature (622)..(622): n is a, c, t, g, unknown, or other
  misc_feature (696)..(696): n is a, c, t, g, unknown, or other
  misc_feature (712)..(712): n is a, c, t, g, unknown, or other
gagctccccgcggtggcggccgctctagaactagtggatcccccgggctgcaggaattcgtctcacccctagaaaaaaaggaaccacttcacactactctccgcggctctgccgtccgttctcctctcgccgccgccggccgcgcctccaccctcgcggcactcgcatggcggcgccggctctccgtatcactgcgcggctgggacttgcacttgacggtgccaccgccgcgagacggcgcgaggcctcggcgcctgtggcggtgccggccgcgccgtggctgaagaaggcggcggtccggtgccagcgagccgtcggtgccgctgttgccgagaagaaggatgcgccggtatcggttgcgcaggagagaagcggcgacgggggcgcggcgccggagctcaccgtcgtgatgaagttcggcgggtcgtcagtggcctcggccgagcggatgcgggaggtggcagacctcatcctcagcttccccgaggagcacccggtcgtcgtgctctcagcgatgggaaagacaccaacaaactcctcatggctggggaaaaagcagtgggctgtggtgcgaccaacgtctcggagcttgatgagctctcctttgtaaaagaattgcatnctgggacgcttgatcagcttgggctaaataaatcaattgttttgtggttttgttgaatgaacttgacaacttcntaaggggattgctatngatgaaggagctgactcttaggacacgagaatatctaggtttcatttggggaaatgcatgtctacaagaaatttttgctgccct

SEQ ID NO: 82342 - protein, 147 aa, Zea mays
  misc_feature: Ceres CLONE 1568122
  misc_feature: SWISSPROT Homolog: EC 2.7.2.4 Aspartate kinase
MAAPALRITARLGLALDGATAARRREASAPVAVPAAPWLKKAAVRCQRAVGAAVAEKKDAPVSVAQERSGDGGAAPELTVVMKFGGSSVASAERMREVADLILSFPEEHPVVVLSAMGKTPTNSSWLGKKQWAVVRPTSRSLMSSPL

SEQ ID NO: 82343 - DNA, 825 bp, Zea mays
  misc_feature: Ceres CLONE 1568124
  misc_feature: Encodes the peptide sequence at SEQ ID NO. 82344
ctccccgcggtggcggccgctctagaactagtggatcccccgggctgcaggaattcgtctcacccctagaaaaagaggagctctatagagcccatcctctgcttcgcataacctagcggcaccagcagctaaccgtccagagaacagaacagagatgaccaccagcgtccccgtccctctggcctcacagtcgcaggcgccgcagcgcaagccacggacctacaccccgagcccatggggtgacttcttcctccaccacaccccatgcactccgtcacagctcttgttgatgaaggagagggcaaaggtcaaggagcaacaggtgaggcagatcatacaggaaacaatggcctcctccaacctgcttcgcaagttggagcttgtggacacgctgcagcgtctcggggtggactaccgctacaacgaggagatcgaccagttgcttcgctctgtatacgacgacgacgacagggacggaggcggctccgacgatctctacttcacctcgctgcggttgtacttgctcaggaagcatgggtatacaacctcttcagatgtgttcgagaaattcagggacgagcgcgggagcgtctcgagcgacgatgcgggctgcttgctcatgctggatgacgctgctcatacgagaactcagggggaggagattcttgacgacatcatcgcttggagcaaaagccgctgcaatccctgctggaggagaagaccttggagccaaagcttgcaaaagaggggaggggcccttttgaaaacgcctcgtttcaggcgggtaaaacaagtggaggcaagcccttcttttccgtgaccgaa

SEQ ID NO: 82344 - protein, 176 aa, Zea mays
  misc_feature: Ceres CLONE 1568124
  misc_feature (1)..(176): Pfam Name: Terpene_synth Pfam Description: Terpene synthase, N-terminal domain
  misc_feature: SWISSPROT Homolog: EC 4.2.3.13 (+)-delta-cadinene synthase
MKERAKVKEQQVRQIIQETMASSNLLRKLELVDTLQRLGVDYRYNEEIDQLLRSVYDDDDRDGGGSDDLYFTSLRLYLLRKHGYTTSSDVFEKFRDERGSVSSDDAGCLLMLDDAAHTRTQGEEILDDIIAWSKSRCNPCWRRRPWSQSLQKRGGALLKTPRFRRVKQVEASPSFP

SEQ ID NO: 82345 - DNA, 812 bp, Zea mays
  misc_feature: Ceres CLONE 1568125
  misc_feature: Encodes the peptide sequence at SEQ ID NO. 82346
ctccccgcggtggcggccgctctagaactagtggatcccccgggctgcaggaattcgtctcacccctagaaaaactcatgctgctgcaacaaacagccgtttcacaattttctttaatcctagggcaagtccatcagaatttgttatacccctttcgaaatacatcaaggcagtttttcacacgcggatatcagttgggatgcgattcaggatgttgtttgagacagaggaatctagtgtccgcaggtacatggggacaataactgaagtgagtgatgctgacccagtgcgttggcctagttcctattggagatcagtgaaggttggctgggatgaatcaacagcaggagaaaggccacctagagtttctctgtgggaaattgagccactgacaacctttcctatgtatccatccctgttcccactgcgagttaagcatccatggtattcaggagttgctgctcttcatgatgacagcaatgctttgatgtggctgagaggagttgctggtgaagggggctttcagtctttaaacttcagtcacctggtgtaggttcctgggggacacagagactccatccatccttacttagcaatgaccatgatcagtatcaagctgtggttgctgccgcagctgcttcccaatcggatggttatccgaggcagcaattcctacactttcacaacctatgcagtccccaacagagcagtgcaatctcaatccgcctgtgcagcagcaaatactacagcaagggagcaaccagcagatgggtagtcctgatgctcaaaaaatccagtccgtgctcaaacca

SEQ ID NO: 82346 - protein, 117 aa, Zea mays
  misc_feature: Ceres CLONE 1568125
  misc_feature (1)..(41): Pfam Name: Auxin_resp Pfam Description: Auxin response factor
MRFRMLFETEESSVRRYMGTITEVSDADPVRWPSSYWRSVKVGWDESTAGERPPRVSLWEIEPLTTFPMYPSLFPLRVKHPWYSGVAALHDDSNALMWLRGVAGEGGFQSLNFSHLV

SEQ ID NO: 82347 - DNA, 991 bp, Zea mays
  misc_feature: Ceres CLONE 1568126
  misc_feature: Encodes the peptide sequence at SEQ ID NO. 82348
  misc_feature (12)..(12): n is a, c, t, g, unknown, or other
  misc_feature (16)..(16): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (127)..(127): n is a, c, t, g, unknown, or other
  misc_feature (128)..(128): n is a, c, t, g, unknown, or other
tttaataaatancacntaattttttcctatcgtgtgggagggaggaaaaggtgtttannnnntttttnnnnnnntaaaatggagctccccgcggtggcggccgctctagaactagtggatcccccgnnggctgcaggaattcgtctcacccctagaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagaaaaaagaaagggagggcatccaccaacccccggccaataaaaggggaggaaaaaaaagccccaagaagaaggggggaaaaaaaaagaaaatgagccgcttgccctgtggccttcccaaaaaaaaaaggagggggcccagccaaaggaaaaaaccccccccccaaataaacccccccccccccgggtccctccctttccaaaaacccaaaaaaacccccttccaaaaattttccaccctttctttcccctttaaaaaggggttttccccctcccaaaaggggggcattggtggaccccccccaccccatttccagaaaagccctttttttaaaaaaaagaacgggggttttcccccaaaaaaagttttccaaaaaacacccggggggtctctttttaacacagaaaaaccccccgagaaaatcttttgttaaaacgctcctttaaagagaccccgggcccaaaaaaccccccccgaggaacacggggggtttttcccctgttttcccgaaaactcccccgcgggtggggccgccctctgggggaaacaaagggggggccctccacccccgcgggagaagatttttacccctccccagaaaaaatacccctcctg

SEQ ID NO: 82348 - protein, 51 aa, Zea mays
  misc_feature: Ceres CLONE 1568126
MYTLPVRATTSSIVASLATPAPSSSSGSGSGRPRPRLIRNAPVFAAPATVV

SEQ ID NO: 82349 - DNA, 830 bp, Zea mays
  misc_feature: Ceres CLONE 1568132
  misc_feature: Encodes the peptide sequence at SEQ ID NO. 82350
ccccgcggtggcggccgctctagaactagtggatcccccgggctgcaggaattcgtctcacccctagaaaaagcctctgtgtctgtcttttcgtttaattagggtttccggatctgctctgcgtcgccgccgaccaacctccaccgcgcgacgccatggacttcgacgagtacgagtatctggagaagacggtggaagcgttcgcagcgccggccaacggttcgtcgccgcccgggtcggggtacaaggacaaggagcgcagctcacgccgccgctcaacgggcggtgacgaagagcgcgacaacgtagaacgcagatcgaagcgttctcgccccgaggaaggccgcgaccgcgatagagagcggcacaggtaccgcgacggcgaccggcaccgcagcagtcgggagcggcgggaccgtgaccgtgacgtcaaggagaaagagcagggcagggagaacgacaaggacaggaggagccgcgaccgcgaacgggagaaggaggagagggagaaggataggcagcggaggagtcggagccggtccgagcggcgccgtgatgacgaagagcgtgatcgctaccgtgaacgcgatgtcagacgtaggaaagaggaagttgctgaacctggaagttgatccagaaagagatcagagggacttgtgttttgccttaccagttattcttttgaagggcagatggaaagaagatggtattatgaaggttcctttttctaaggggcttggaaaaagggtcccgggggattggtttccgccctggaatttatggggaatcccgaaaaatttcaccgcaccgtgtttcctataaaggggggg

SEQ ID NO: 82350 - protein, 158 aa, Zea mays
  misc_feature: Ceres CLONE 1568132
MDFDEYEYLEKTVEAFAAPANGSSPPGSGYKDKERSSRRRSTGGDEERDNVERRSKRSRPEEGRDRDRERHRYRDGDRHRSSRERRDRDRDVKEKEQGRENDKDRRSRDREREKEEREKDRQRRSRSRSERRRDDEERDRYRERDVRRRKEEVAEPGS

SEQ ID NO: 82351 - DNA, 1137 bp, Zea mays
  misc_feature: Ceres CLONE 1568133
  misc_feature (1)..(1): n is a, c, t, g, unknown, or other
  misc_feature (2)..(2): n is a, c, t, g, unknown, or other
  misc_feature (22)..(22): n is a, c, t, g, unknown, or other
  misc_feature (24)..(24): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (479)..(479): n is a, c, t, g, unknown, or other
  misc_feature (1137)..(1137): n is a, c, t, g, unknown, or other
nntttttttttggcggccttantncttacacctttatatgttgaaaaaaaannnnnannnnnnnnnnnnnnnnnnntggaactccccgcggtggcggccgctctagaatagtggatcccccgggctgcaggaattcgtctcacccctagaaaaagcctctgtgtctggcttttcgggtacttagggtttccggatctgctctgagtcgacggcgaccaagctccaccgatgcgacgccatgcgactttaacgagtacgagtatctggagaagagggtggaagcgttcgcagcgccggacaacgggttgtcgccgcccgggtcggggtacgacgacaatgtatccagatcacaccgccgctcaccgggcggtgacgaacagctccaccacgtagaaggcaaatcgaagcgttctcgacccgaggaagggcgcgacctcgatagagagcggcacaggtaccaccacggctactgtggtgtnacacccccaggagccgcgggacccgggaccgtgacgtcccgggagaaagagcagggccaaggtagaacgacaagggaccgtgaggagccgccgaccgtctaacggggaaatgggaggaacaagtgacaaagggttaggccagccgccaaggagtcggggagtcggggtccccaaacccgcccgccgcgtggattgaaccaaaagagccccttcggattggtcttccccaggtgaaaccccctggattggctcctcgaggggggtaagtttaaaagacggggataatgttttgccccttaaaaacccttggacaaggatttgtgaattcccccgggaaataagaggaataattcccggaaggggaaacttgtttggtctttttggccttttaccacaagttataagttcattttgtatcgcgggcggggcgttgataaagcgcgcttgggttatgttgtgcgggtctcctcttttttcaaaaaggggtctttgttaaaagggggtccccggggattgtttccctcccttcatattttttgtgatatgcacaaatccctccccacagtggtgcttaaatggggcggtccgggggacaacattacgctaaatattgggaagttctctctctctgagagggtattcttcgccttcctctcan

SEQ ID NO: 82352 - DNA, 841 bp, Zea mays
  misc_feature: Ceres CLONE 1568136
  misc_feature: Encodes the peptide sequence at SEQ ID NO. 82353
  misc_feature (599)..(599): n is a, c, t, g, unknown, or other
  misc_feature (830)..(830): n is a, c, t, g, unknown, or other
  misc_feature (841)..(841): n is a, c, t, g, unknown, or other
agctccccgcggtggcggccgctctagaactagtggatcccccgggctgcaggaattcgtctcacccctagaaaaactaaccacgccatcacttctgttaactacattcgcagcggcagcgggagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgctctggaccgtctccgtcgccagcggttacaatctgcttagggatccccgttacaacaagggacttgcgttcacagagagggaacgtgagacgcactacctccgtggccttctgccaccagctattgtatcccaggagctccaggagagaaagatcatgaataatattcgacaataccagttgcctttgcagcgctacatggcactcatggatctccaggaagggaacgagaggcttttctacaagttgctcattgacaacgtcgaggagttacttccnatcgtgtacactccaccggttggcgaggcctgccaaaaatatggatccatatttagtcgccctcagggtctttatatcagtttgaaggaaaaagggaaagatccttggagggtgttgaagaactggccagagaggagcattcaggttatagtttgttactggatggtggaacgtattttggggggcttggagatctcggatgccagggggagggggatttcctgtttggtnacttttccccn

SEQ ID NO: 82353 - protein, 218 aa, Zea mays
  misc_feature: Ceres CLONE 1568136
  misc_feature (118)..(218): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MESTLKGIRGSDAPCVLDLDDAATVAGGVEDTYGEDRATEEQLVTLWTVSVASGYNLLRDPRYNKGLAFTERERETHYLRGLLPPAIVSQELQERKIMNNIRQYQLPLQRYMALMDLQEGNERLFYKLLIDNVEELLPIVYTPPVGEACQKYGSIFSRPQGLYISLKEKGKDPWRVLKNWPERSIQVIVCYWMVERILGGLEISDARGRGISCLVTFP

SEQ ID NO: 82354 - DNA, 809 bp, Zea mays
  misc_feature: Ceres CLONE 1568138
  misc_feature: Encodes the peptide sequence at SEQ ID NO. 82355
  misc_feature (703)..(703): n is a, c, t, g, unknown, or other
tccccgcggtggcggccgctctagaactagtggatcccccgggctgcaggaattcgtctcacccctagaaaaagcttttcctttccctcctcttctgtcgtactactacgctggcctggctgccagtgccacgcacgcacgaacgcgcgcttctctcagccctcgccccgcgtcctgcgctcacgttgtgcctcttccttgcctcgtattttgttcgtagaaataaccctctcatcgatcccctctatctttttttttctctctctcgttatactgccagtatctttggtaaaagccgctagggcggcggggttccgttggcctgcatgttttacatgacatttcgcccttctttttttttcattttgtttgcctcaggtgtgcgaagcggcgcaacggcggaggcggctctagcatcaccggccgacggtcctcctccttctcacgaaaggcactagaggagcggcggcggcggcggcgcatcaagcaccgcaccgatgggcccactggagccgcgctaccgtccaggcggcgcccccgaggacacgactaagagaagggccctcaagagcaagagtttcaaagacgccgagaacttcgaagtcctcgtccttgagaagagctgcgggtgcaagttcaagtctttgaggatcttgctcatagccatcatctccgcgacagtccttacccttgtaaccccgancttatacgagcgccagttgcagtcagcctccgggtacgtggatgtcggggtgaatgtgggacagagcgagttccgatccgcggacgcatcttctggcgatgtggga

SEQ ID NO: 82355 - protein, 104 aa, Zea mays
  misc_feature: Ceres CLONE 1568138
  misc_feature (69)..(69): Xaa is any aa, unknown, or other
MGPLEPRYRPGGAPEDTTKRRALKSKSFKDAENFEVLVLEKSCGCKFKSLRILLIAIISATVLTLVTPXLYERQLQSASGYVDVGVNVGQSEFRSADASSGDVG

SEQ ID NO: 82356 - DNA, 782 bp, Zea mays
  misc_feature: Ceres CLONE 1568140
  misc_feature: Encodes the peptide sequence at SEQ ID NO. 82357
  misc_feature (602)..(602): n is a, c, t, g, unknown, or other
ggagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggacccccaccgtcgagcgcttgaagagcgggttccagaagttcaagaccgaggtctatgacaagaagccggagctngtcgagcctctcaagtccggccagagccccaggtacatgttgttcgcctgctccgactcccgggtggggcccgtcggtgaccctgggcctgcagcccgggcgaggctttcaccgtcggcaacaatggcttccatggtccacccctaccaaaagatcaagtacccccggcccggggcccct

SEQ ID NO: 82357 - protein, 48 aa, Zea mays
  misc_feature: Ceres CLONE 1568140
MLFACSDSRVGPVGDPGPAARARLSPSATMASMVHPYQKIKYPRPGAP

SEQ ID NO: 82358 - DNA, 854 bp, Zea mays
  misc_feature: Ceres CLONE 1568148
  misc_feature: Encodes the peptide sequence at SEQ ID NO. 82359
  misc_feature (656)..(656): n is a, c, t, g, unknown, or other
  misc_feature (682)..(682): n is a, c, t, g, unknown, or other
  misc_feature (683)..(683): n is a, c, t, g, unknown, or other
  misc_feature (685)..(685): n is a, c, t, g, unknown, or other
tccccgcggtggcggccgctctagaactagtggatcccccgggctgcaggaattcgtctcacccctagaaaaaaaacaccaactcgcgatccatcgatttgcagaacaccacccaacagccaaaccatcactcgatcggtagacatggataaggcctacatcgccgccctctccgccgccgccctcttcttgctccactacctcctgggccggcgggccggcggcgagggcaaggccaaggccaagggctcgcggcggcggctcccgccgagccctccggcgatcccgttcctgggccacctccacctcgtcaaggccccgttccacggggcgctggcccgcctcgcggcgcgccacggcccggtgttctccatgcgcctggggacccggcgcgccgtggtcgtgtcgtcgccggactgcgccagggagtgcttcacggagcacgacgtgaacttcgcgaaccggccgctgttcccgtcgatgcggctggcgtccttcgacggcgccatgctctccgtgtccagctacggcccgtactggcgcaacctgcgccgcgtcgccgccgtgcagctcctctccgcgcaccgcgtcgggtgcatggcccccgccatcgaagcgcaggtgcgcgccatggtgcggagaatggaaccgcgccncctcgggccggcgggcggcggcttcnncncgcggtcaagctcaagcggcgggctgtttcgagctcctcccttcagcgtggctcatgggaagacaatcgccgcacaacaaaggacgttccccgcggccgagggcccgaccccccaactcgggaacatgttccacccggagggccccaccgagtttccaagcaagattcg

SEQ ID NO: 82359 - protein, 236 aa, Zea mays
  misc_feature: Ceres CLONE 1568148
  misc_feature: SWISSPROT Homolog: EC 1.14.13.89 Isoflavone 2'-hydroxylase
  misc_feature (171)..(171): Xaa is any aa, unknown, or other
  misc_feature (180)..(180): Xaa is any aa, unknown, or other
  misc_feature (181)..(181): Xaa is any aa, unknown, or other
MDKAYIAALSAAALFLLHYLLGRRAGGEGKAKAKGSRRRLPPSPPAIPFLGHLHLVKAPFHGALARLAARHGPVFSMRLGTRRAVVVSSPDCARECFTEHDVNFANRPLFPSMRLASFDGAMLSVSSYGPYWRNLRRVAAVQLLSAHRVGCMAPAIEAQVRAMVRRMEPRXLGPAGGGFXXRSSSSGGLFRAPPFSVAHGKTIAAQQRTFPAAEGPTPQLGNMFHPEGPTEFPSKI

SEQ ID NO: 82360 - DNA, 853 bp, Zea mays
  misc_feature: Ceres CLONE 1568149
  misc_feature (540)..(540): n is a, c, t, g, unknown, or other
  misc_feature (567)..(567): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (597)..(597): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (610)..(610): n is a, c, t, g, unknown, or other
  misc_feature (614)..(614): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
tccccgcggtggcggccgctctagaactagtggatcccccgggctgcaggaattcgtctcacccctagaaaaacggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcnaatgaaaattatttttccctaaaaaanannnnnnnnnnnnaannnnnnnnaaaaaanaannnnnnnaaanaaanannnncccttttatggtggtaagcttttttttcttttgaaaccaaatttggccttttgaacttttttccttaattttttcaaaccgggccccaggaaaacctcaatttggggttccaccctccttttaggaccctttgtttttcttggggagcccccccaatattaatttgggctttttcaaaacatctaaggggggtgacagggggtttccttgggccgggggaaacttatttttttg

SEQ ID NO: 82361 - DNA, 778 bp, Zea mays
  misc_feature: Ceres CLONE 1568152
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (604)..(604): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
caccgcggtggcggccgctctagaactagtggatcccccgggctgcaggaattcgtctcacccctagaaaaacggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttcccctaaannnannnnnnnnnnanannannnnannnnannnnnnnnanaaaaaaaaaaaaannnnccctttttgggtggtgagcttttttttctttagaaaaaaattggccttttaaactttttccataatttttaaaaccgggccccaaagaaaaatccatttggggttcaaacccttttaaggacccttggttttttggggaggccccccatttttattt

SEQ ID NO: 82362 - DNA, 749 bp, Zea mays
  misc_feature: Ceres CLONE 1568153
  misc_feature: Encodes the peptide sequence at SEQ ID NO. 82363
tccccgcggtggcggccgctctagaactagtggatcccccgggctgcaggaattcgtctcacccctagaaaaagtcgtcgtctagctcccatccgacctcctgcattccccactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggggacgccatcagtgctctgtctggggttcggtctgttctttggctgcagatctggaagggtttcgtgggatccgtcgctacgatctgtcccagtcagagcatctgcatcatctcgggttgggccatggagactctgctcatctcggaggagcgcaaccaccagctccaccacttctcgggtcgccgtaagaagggcgtagcagcgtcgcctcagtccacgcgcagctaccatgcgggcaactgccggggcgtcccactccggcatcacgttcgggatcctgccgtcccccgcccggcagaaggttgcactgacccgctccttttctgaagcccaggacaccgaaacttcggctttcccctgggaaaaaagcgcacccaaaccaatcttctatgaaatttttc

SEQ ID NO: 82363 - protein, 67 aa, Zea mays
  misc_feature: Ceres CLONE 1568153
METLLISEERNHQLHHFSGRRKKGVAASPQSTRSYHAGNCRGVPLRHHVRDPAVPRPAEGCTDPLLF

SEQ ID NO: 82364 - DNA, 831 bp, Zea mays
  misc_feature: Ceres CLONE 1568155
  misc_feature: Encodes the peptide sequence at SEQ ID NO. 82365
ctccccgcggtggcggccgctctagaactagtggatcccccgggctgcaggaattcgtctcacccctagaaaaacccttccattttaaatttcaaacccctctcccacctgcttcctcctcctctcccctgctgccacgaggcgcggctcagctcctcctcgaagcgggcggggaatacaggccgcgcggcggcggggcggaggaggaggaggagcgggggatgatggggtgcctcttcggctgcttccgcgcgtccggcgacggcggcgatgcgaagggcgccggagaccgcaacacgtccctggctcccgcgacgacgacgacgatccaacaggatggtacgggcaggaggatcaggccaccgtcgaggaacgcgctctccgccgtgtttcagcgagaagatgagggatcgagggcggcgcaggcggcgagctcgtgggcggaacagactgtggatcaggagcttgagccccagaccattatccaaaaaaactgtggtgcattgctgcaaactacaaacaacatccaaagtgtgctcagagatgcagattcagttcatcagaaggaaacacattcaggatgtcttccctgtatgtctgatgatgtacatttcatgaaggcgcaaaggttgagaactgtgaaactcttccaaggtctcatcagagcttcactgtaccagatgcaacgagttcttcaaaacaaatggagaattggcgtactttccgctactttcctaaaaaaaaacgtgggaagagtccacaaatgggaaacgattcttggggcctgtgttgccggggtgaaaaaccaacaaccaagttcggggatcttgg

SEQ ID NO: 82365 - protein, 203 aa, Zea mays
  misc_feature: Ceres CLONE 1568155
MMGCLFGCFRASGDGGDAKGAGDRNTSLAPATTTTIQQDGTGRRIRPPSRNALSAVFQREDEGSRAAQAASSWAEQTVDQELEPQTIIQKNCGALLQTTNNIQSVLRDADSVHQKETHSGCLPCMSDDVHFMKAQRLRTVKLFQGLIRASLYQMQRVLQNKWRIGVLSATFLKKNVGRVHKWETILGACVAGVKNQQPSSGIL

SEQ ID NO: 82366 - DNA, 785 bp, Zea mays
  misc_feature: Ceres CLONE 1568158
  misc_feature: Encodes the peptide sequence at SEQ ID NO. 82367
ccccgcggtggcggccgctctagaactagtggatcccccgggctgcaggaattcgtctcacccctagaaaaatcttcactgctcggggatttggaacaaaggccgtggttcgaagctggtgtgttcgttcaattgtgcggaaagaaaggccagtgttatgtgtgaagtagtgaaggctagcaggtaggctggctctcgcctcgccgagcgatggatctcgagttcggtaggggcctgaggtccccaaagagagactcgtggaagaccaccttgctgctggcgtaccagagcctgggggtggtctacggcgacctcagcatctctccgctgtacgtgtacaagagcaccttcgccgaggacatccagcattcggagacgaacgaggagatcttcggcgtgctctccttcgtcttctggacgctcaccctcatccctctcgtcaagtatgtctccgttgtcctgcgagctgacgacaatggcgagggaggaacgtttgccctctactctctgatttgcaggcacgccaatgtgagcctcctcccgaaccggcagatcgccgatgaggagctttccacctacaagctggaatgccctcctgaaatcaccgacaagtcccgcatcaaaggtgtggccttgagccgcacaaggaagctgcgcgtccgctctgcttggtcttgggttatgaaccgggaacatgcatgggttattcggggaaccgttgttcttcacgccaacctatatcccgtgtttccccggccagttttcaggggcctggaaggttcctc

SEQ ID NO: 82367 - protein, 191 aa, Zea mays
  misc_feature: Ceres CLONE 1568158
  misc_feature (22)..(187): Pfam Name: K_trans Pfam Description: K+ potassium transporter
MDLEFGRGLRSPKRDSWKTTLLLAYQSLGVVYGDLSISPLYVYKSTFAEDIQHSETNEEIFGVLSFVFWTLTLIPLVKYVSVVLRADDNGEGGTFALYSLICRHANVSLLPNRQIADEELSTYKLECPPEITDKSRIKGVALSRTRKLRVRSAWSWVMNREHAWVIRGTVVLHANLYPVFPRPVFRGLEGS

SEQ ID NO: 82368 - DNA, 922 bp, Zea mays
  misc_feature: Ceres CLONE 1568161
  misc_feature: Encodes the peptide sequence at SEQ ID NO. 82369
ggagctcaccgcggtggcggccgctctagaactagtggatcccccgggctgcaggaattcgtctcacccctagaaaaacaactcctgttaaaccctcgcctttccgccgcccgtcgcttcccccaaactatcgtgttcaccaccgacggcggcggcgaaacaccttgtcgccctctaccgaaatcccagcccaagcgtgagcgcccgctccccaccagtcaccatggcgccgcgctcccgcaagcgggcttcgcgccccaagccccgcccaggctcccgacgtggtggcggcggaggggacgacgaccccttcttcgagtccgcgcccaagcgccgccgcggggaccgtgacgaggacatagagagcgaggacagcgacaacgacggcgtggctgcgcttggccgcggatttgatgaggatggggacgagggcggtaaggaggatgaagacgaggaaactgtggggggagaagaagatgcggatagcgaaggaggtgcctgaagaaggtcactggaagtccctaagaggggggccggaggatgacccattaggattgaaaacttgtccgggaagggaaaaggggtggccgaaaaatccttgcaaaaaaaaacaatctccaaggaaaaaccggccagaaaccgcccggaaaattttccccccggggggttattaccccccgggcccctcggggaggggttttaagggtttttggggaaagcccccggaacccgggtaacgggggggtggctttttccaaggaatatggaaatagggggtttttccggggccaaaaaaaggggaaccttttttcctttgggggggtttgtaaccccggggaaaagtgtaaaaaatttttttgggcccaaaagaagaaatgttttgtgtttttttaccaccccaaaaaccccccatttattaaaa

SEQ ID NO: 82369 - protein, 92 aa, Zea mays
  misc_feature: Ceres CLONE 1568161
MAPRSRKRASRPKPRPGSRRGGGGGDDDPFFESAPKRRRGDRDEDIESEDSDNDGVAALGRGFDEDGDEGGKEDEDEETVGGEEDADSEGGA

SEQ ID NO: 82370 - DNA, 904 bp, Zea mays
  misc_feature: Ceres CLONE 1568162
  misc_feature: Encodes the peptide sequence at SEQ ID NO. 82371
tccccgcggtggcggccgctctagaactagtggatcccccgggctgcaggaattcgtctcacccctagaaaaatcgtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcagtccggggaggagacggcccgcgagatccaggtggtcagggaggcgtacccgccgcgagacggccgcgccgggctacgtcatacccgaagagccccccggccgtggtcgagctcgtcgggtggtaacatctacggggttctgctcctacttaatcaaccacctgggtggtgcgggtcctttttccgggccatattcagggaggggggccttccccaaactccaaaatttcccccccgaccccaagtaaaccccccgaggggggttccctggtttccttccccaaaaatgtccttgtgcccaagaggtttcacaaagccccccttttgggaacaagggggcccccgggagggcccccattgggcgggaaagggaaactttcttggggaaaaaccctttcctctcctggggggggcgcccttcccccccagaaaaggtgttcacctttttgagggggggggggagaaacaaaggtgtgtatatttttgtgggcgcccccccccttctggggggcttctttttcgcggggaaaaaggggtgttttaaaa

SEQ ID NO: 82371 - protein, 244 aa, Zea mays
  misc_feature: Ceres CLONE 1568162
MSEQQQPLPQPRSSMREALEKEDKEKAAAAAAAKEKAAVPKNGNGNGGKNGGGAGSGNGGAPPQSGEETAREIQVVREAYPPRDGRAGLRHTRRAPRPWSSSSGGNIYGVLLLLNQPPGWCGSFFRAIFREGGLPQTPKFPPRPQVNPPRGVPWFPSPKMSLCPRGFTKPPFWEQGGPREGPHWAGKGNFLGEKPFPLLGGAPFPPRKGVHLFEGGGEKQRCVYFCGRPPPSGGLLFRGEKGVF

SEQ ID NO: 82372 - DNA, 837 bp, Zea mays
  misc_feature: Ceres CLONE 1568163
  misc_feature: Encodes the peptide sequence at SEQ ID NO. 82373
ctccccgcggtggcggccgctctagaactagtggatcccccgggctgcaggaattcgtctcacccctagaaaaaaaactgtctcttccacgtccttccgggtcctatcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggaaatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggcctttggaactcttggaatcccgccttgatactttcattctgttagatgttccagatgaactccttgttgaaagggtggtttggaaaggcggcttgatccttgaacagggaaaatatattcttttgagtattctcccgcaggagaatgaaagaaatcccttccaaggcttacccaaaggatttgacgaattccgaagaaaagggtttagt

SEQ ID NO: 82373 - protein, 173 aa, Zea mays
  misc_feature: Ceres CLONE 1568163
  misc_feature (74)..(171): Pfam Name: ADK Pfam Description: Adenylate kinase
  misc_feature: SWISSPROT Homolog: EC 2.7.4.3 Adenylate kinase
MASSMAAAATALPLPSGTTQRPSAQGRLLFTAAPARSRCRSLRLRPAGRRSARSSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMAFGTLGIPP

SEQ ID NO: 82374 - DNA, 909 bp, Zea mays
  misc_feature: Ceres CLONE 1568165
  misc_feature: Encodes the peptide sequence at SEQ ID NO. 82375
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
nnnnnnnnaataaaccaaagatagccacgaacagcgcgcccggcgggcgtttttaagaaaaagaagaataagaaaaaatagaactccccgcggtggcggccgccgcctccgaccccacgcacggctggcagacggtgtcgtaccccaagcgccaccgcaagcaggcgcatcagccaccccgcgccatggctcccgatctggcgctgcaggccaacggcaaaggctccggtgtcttcgacgccgtcgagaagcgctcccaggagcgccaccgctcgctgctgcagcagctcgcatccagggcggccgacctcgacgacgcgcggatcgccgcggtcacaggcggcgcttactccgacgactccgactccgacgaggccaccgcccagcgccaggtgggggaggtgaagaagcctaagaagcctaaaatcctaaggtgacgatcgccgaggctgccgccctgatcgacgccgagaacctcgcagcgcacctcgtcgagatctcgtcatcatatgagaatcaacaggacattcaactcatgaggtttgctgattactttggccgggcatttgtagctgtaagcgcatcccaatttgcatgggcaaagatgttcaaggaatcaacagtgtctaagatggttgacatcccactgtgccatattcctgaggctgtcatcaagactgcgagtgattggatcagtcaaagatcttatgatgccctggggagacttttgttttgggggggtataggatagcatcatgtcctgaattgtcagggctcatccagctggaatctaaggggttccaaaggaaagtttggcccaaaaagtcctccaagagggcccaaggtttgccaaaacctttgggttggttccctggcgccaggaaccttttaaaaaaaagaaaaagcccc

SEQ ID NO: 82375 - protein, 83 aa, Zea mays
  misc_feature: Ceres CLONE 1568165
MAPDLALQANGKGSGVFDAVEKRSQERHRSLLQQLASRAADLDDARIAAVTGGAYSDDSDSDEATAQRQVGEVKKPKKPKILR

SEQ ID NO: 82376 - DNA, 909 bp, Zea mays
  misc_feature: Ceres CLONE 1568167
  misc_feature: Encodes the peptide sequence at SEQ ID NO. 82377
  misc_feature (766)..(766): n is a, c, t, g, unknown, or other
ccccgcggtggcggccgctctagaactagtggatcccccgggctgcaggaattcgtctcacccctagaaaaagctcgtgccgttgcgctgcggcaaagcctcccccccacacctctctcctccatccgccgcccccgcgggaccgaaaccctagctagggttctgcccgccgccgccgcagccgccttcgatcctgacgcggccaggcttcccgcaacaccgccatggacacggggcgcaagcggaccgcaccggagggcgccaacggcgcgggcgaccccaagcgcgcgagagaatcggagacaactggtgtaggaagcaaatccaagccgtgcaccaaatttttcagggtctaatctagcttaaaatgaacagtcatcgggtaacatctactatcgttattatgctcttctttttttaaataaaatttggtatgttactaaatgctgtgcttgatgctaacaaaaggggttggtctagattctgctaccgggagggttttatctaaacctttggctaagaaccctccacgggaataaaaaatgggaatccactgggcgggttaacccggggaaaaaatgggggccaacaggggaaacgtcctgcgtgtttttcccgtgggaaacccggtgcccaaaggggaaacccccgggggttatttccctgaaaagttcggaaaccggcaacaagggttttcaggggaagaaaacctttcctctccaagagggaaaaaattggtttcaaaaacccccggggaaagggggtnccctttggggaaattccccaaacattttttttttgcaaccgggggggcaccgggaataccccaccccccggggaaaagagcaacccacatattttggtgtaacaaaggagtattttctccattaacaagagagggggggcacc

SEQ ID NO: 82377 - protein, 43 aa, Zea mays
  misc_feature: Ceres CLONE 1568167
  misc_feature: The sequence is a functional homolog of SEQ ID NO 600 in the 10/666,642 US patent application
MDTGRKRTAPEGANGAGDPKRARESETTGVGSKSKPCTKFFRV

SEQ ID NO: 82378 - DNA, 808 bp, Zea mays
  misc_feature: Ceres CLONE 1568171
  misc_feature: Encodes the peptide sequence at SEQ ID NO. 82379
tccccgcggtggcggccgctctagaactagtggatcccccgggctgcaggaattcgtctcacccctagaaaaaatccacacacacacaacacagcagagagattactacgatccaacagttctagagcaagagagaggaagacacaccgcagagttagcaggctaataacttgcaggagcagcaggaatggcggcgacgcgtcgcctctcttgccttctcctcgccgtgcttctggcaggagtggccgctgccaccgccttcgacgaagcggctgctgccggcttcgggcttggccacggcgcgcgtttcgcgcgcaagcatggacgagctgccgctgagatgccccagccggagccacaacctaaaactaagccggagccccatatgcagccactgccccagccagaacctaaaccgaaacctatgccacatccagagccaaagcctgaacctcaaccaaagcccaaccctgaacctcaaccaatgcccaagcctctaccaaaatccaaaccagagccattgcctacaccgaagccagaacctaagcccgaacctaagccagagcctaagcccgaaccgaaaatgaagccaaagccaaaacctgaatcaaaaccagagccaaagccagatcacaaacctgagccaaagccagagcccgaaccaaaaccagagccctaaccagaaccaaaaccaggacccaaagccagagcccgcaacccaaaaccagagccttaagccagaggcctaaaccctgaaaccggaaacccggagccaaaaaacccagaagcccccaacctaaagcccaga

SEQ ID NO: 82379 - protein, 163 aa, Zea mays
  misc_feature: Ceres CLONE 1568171
MAATRRLSCLLLAVLLAGVAAATAFDEAAAAGFGLGHGARFARKHGRAAAEMPQPEPQPKTKPEPHMQPLPQPEPKPKPMPHPEPKPEPQPKPNPEPQPMPKPLPKSKPEPLPTPKPEPKPEPKPEPKPEPKMKPKPKPESKPEPKPDHKPEPKPEPEPKPEP

SEQ ID NO: 82380 - DNA, 798 bp, Zea mays
  misc_feature: Ceres CLONE 1568172
  misc_feature: Encodes the peptide sequence at SEQ ID NO. 82381
  misc_feature (607)..(607): n is a, c, t, g, unknown, or other
  misc_feature (627)..(627): n is a, c, t, g, unknown, or other
ctccccgcggtggcggccgctctagaactagtggatcccccgggctgcaggaattcgtctcacccctagaaaaacttccggtcctgcattttgttgtcccctcccctctccgtagcggagacgttcgttcactttctctctctcgcctcccgtttgccccgcgtgcgctctgtgtcgctccctctcttgtgaggagtgaggacgactggggcgaccgccgccgccgccgccgccctacgccagatgcccaggtaggggccattcgctagctcttcttcgtgcccttcgccggcgacgagcattcaccagttgctgatgcaaggctttcaaaagtttaacagtctcacttgatgcaaaagcaacacaatcactctaaaggtttggatcagtcatttcagagcatgggttcgcggtttccatcccatcagctaagcaatggcttgtatgtctctggccgacctgagcaacctaaagagaaggccccagtcatttgctcctcggctatgccgtacactggcggggacataaagaaatctggagaacttggaaagatgtttgatctccatagaaaatctggtccattgggtaatccgccttcaaggatacnttcctttggtggtgctgccngccactctgggacagtttccaatgctgtcggtcgctccaactactctggttctatttcgtctgcagttcctggcactggaggattctctaggacaaaatcaactctggacctctcaacgagctggagaaccaacaaagaggctttctgggccccaaatctcctgaaggaaa

SEQ ID NO: 82381 - protein, 149 aa, Zea mays
  misc_feature: Ceres CLONE 1568172
  misc_feature (86)..(86): Xaa is any aa, unknown, or other
  misc_feature (93)..(93): Xaa is any aa, unknown, or other
MQKQHNHSKGLDQSFQSMGSRFPSHQLSNGLYVSGRPEQPKEKAPVICSSAMPYTGGDIKKSGELGKMFDLHRKSGPLGNPPSRIXSFGGAAXHSGTVSNAVGRSNYSGSISSAVPGTGGFSRTKSTLDLSTSWRTNKEAFWAPNLLKE

SEQ ID NO: 82382 - DNA, 782 bp, Zea mays
  misc_feature: Ceres CLONE 1568176
  misc_feature: Encodes the peptide sequence at SEQ ID NO. 82383
ctccccgcggtggcggccgctctagaactagtggatcccccgggctgcaggaattcgtctcacccctagaaaaagcaaaaacttgcttccttcgacggccgcatcagtcttccacgtacgtcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtctgtggtggcggagctggagggtgcgctgcttcggagcgcggacacgctcccgtacttcatgctcgtggcgttcgaggcgtccgggctgccgcgcttcccgctgctgctggcgctgtgcccgctgctgcggctgctagagctgggcgggccgtcgcggccctggcgctgcgcccccgccccgtttcgtggccaccggcggggggggtgaacccccccccccaaacctggaagggcccttgttccccccgccccgtgggttgccccaaagttttcatgggggcccaaaaaaaaaagtttcaaaccccccccggggggcttgggggggggggcccttttccggggaaacccttccccaaaggggggggaaagggggcctccttttttttttttttccacacggggggatatgccccccccccgccttttattgggggtccaaaaaaaccccttttttcccccaaaaaagggagaaaaaacccctctttgtgggggcgcccccacaccccccccgcggggggggc

SEQ ID NO: 82383 - protein, 83 aa, Zea mays
  misc_feature: Ceres CLONE 1568176
MTPASQAAPPRARRSVVAELEGALLRSADTLPYFMLVAFEASGLPRFPLLLALCPLLRLLELGGPSRPWRCAPAPFRGHRRGG

SEQ ID NO: 82384 - DNA, 785 bp, Zea mays
  misc_feature: Ceres CLONE 1568177
  misc_feature: Encodes the peptide sequence at SEQ ID NO. 82385
tccccgcggtggcggccgctctagaactagtggatcccccgggctgcaggaattcgtctcacccctagaaaaaggcatctgtctgatcccattttccccaaaacaaaacgactcgttctttcccgggggaggggaggactggagaagcctggccagccatggacccgcccaaccctaaccccaacgatgccccgtcgctcccagccgaatccgcggccagactcgccgccctctccctttgtggcaccagggaccttcccccggacttccacaccgccgagatcctcgacgacgacgagggctacctcacctccgcgtccagaggcgggagcagcacctccgcgtggaaggaggcgcccgagggactccacgacgatgacaaggatggggacgatgtctcccagcccagccccagaagcagcggatacgctggcgagcgcggaagcagccttgatgacgacgccgaccccgaccccgaccccgaccaggattgggcgcgcggcaagaagcatccccacgaggacgatgcttcctcttcgtggaggaagaagaaaaaacatttcttcattctgagcaattctggcaagccaatatattccaggtatggggatgagcacaagctagccggattttctgctacgctgcaagcaaatcatttcttttgtccgagacagtggcgaccatatcaaaattggtgagagctgggcaacatcagatagtttttccttgggaaggggcaaatttatttaggtttggataaacctgccccgaagagtcttatgaac

SEQ ID NO: 82385 - protein, 179 aa, Zea mays
  misc_feature: Ceres CLONE 1568177
MDPPNPNPNDAPSLPAESAARLAALSLCGTRDLPPDFHTAEILDDDEGYLTSASRGGSSTSAWKEAPEGLHDDDKDGDDVSQPSPRSSGYAGERGSSLDDDADPDPDPDQDWARGKKHPHEDDASSSWRKKKKHFFILSNSGKPIYSRYGDEHKLAGFSATLQANHFFCPRQWRPYQNW

SEQ ID NO: 82386 - DNA, 815 bp, Zea mays
  misc_feature: Ceres CLONE 1568178
ccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgagcaccaccgggttggcgggttccccagcagtgtggcactgacgaacacgcttcagcgccgtcgtcgttctcgccgctatcttgtcgtcgccctcggcgacgagagccgaacaggaggccgcccctgtgacgatcgaggacgtggacctcagctctcatcagggcgcggccgacgacggggagctcgccgcgcggtgggcgggaggtcacggcagcaacaactgggaggggtctgctggacccatcgacggcggtgctcctccaggagctcatccgctacggcggagttcgcccgggccacttacgagagcttcgactacgaccgcttctccccctactgggggaggctggcagtacctgggggaagactttcttcaaagaagtcggcctcgggggggatggggtaggaaggcaccccgttccttttacgccacctggaaggggcctcagggttccccaactttcggaaagagggagggccgccaaggcccaggatggggaggggggtccgggcggtgttcatgggg

SEQ ID NO: 82387 - DNA, 872 bp, Zea mays
  misc_feature: Ceres CLONE 1568179
  misc_feature: Translation starting site: 163
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
ctccccgcggtggcggccgctctagaactagtggatcccccgggctgcaggaattcgtctcacccctagaaaaaacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggacattgttgagcaggctgccgtgagagatgtgcaggaggcctgtgtacatgatggatatgttctacccaaattgtatgcaaaggttcatcactgtgtctcatgtgcaatccatgcgcacattgtccggggtcgctctcgtgagaacaggaggaaccgtgagcccccgcagcgcttcagacgccggaatgatggcccaaagggctgggtcagggcccgcccccgcccagggggtgcagcttcctgcaactgcagctgctgctgctccctcgaaactaaaggtctggaaattagtttcggggccttagtttttgtgaaaacatttcctggttttgaaaaaccctttgtacctggtatccccttttgaggtccaactttttttaccacaattttggggttccaaaaaagggttggtttaaatgttccccccttnnnnnngagagggtggccgcggacgcaggacctacggggaaagagnnngaaaaagtttggtttttttttaaccggcccccctggcccaaaattttcttcccttccctccccccccccggcccccccctaaaaacccgcaaaaagagggttcccc

SEQ ID NO: 82388 - DNA, 822 bp, Zea mays
  misc_feature: Ceres CLONE 1568180
  misc_feature: Encodes the peptide sequence at SEQ ID NO. 82389
ctccccgcggtggcggccgctctagaactagtggatcccccgggctgcaggaattcgtctcacccctagaaaaaaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatcccggcagaccttccaaactctggaccctcgtacagggggagtgattgctcatgtggctgagggtgacgcaaaggacataaaccgtgcagtagctgcggctcgcaaggcttttgatgaggggccatggccaagatgactgcctatgagaggtcccgtatcttactgcggtttgctgatttgaaagagaagccaatgacgagcttgctgctttggaacatgggaacacggggaggccatatgagcaagcgcccaagattgaagtaccacatgttggcccgtccttagccgttactatggctggtggggccgaaaaaaaccaggggcttctttgggcccggctggatggccc

SEQ ID NO: 82389 - protein, 126 aa, Zea mays
  misc_feature: Ceres CLONE 1568180
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINGNFVDSASRQTFQTLDPRTGGVIAHVAEGDAKDINRAVAAARKAFDEGPWPR

SEQ ID NO: 82390 - DNA, 865 bp, Zea mays
  misc_feature: Ceres CLONE 1568184
  misc_feature: Encodes the peptide sequence at SEQ ID NO. 82391
tccccgcggtggcggccgctctagaactagtggatcccccgggctgcaggaattcgtctcacccctagaaaaagcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaagaggttttatggttgtgccaatgggagtcattttgacatgaatttatctgctctacgggcgaggattgatactggcctttaggtttgggtctgacgttgactttgttctgacttacaccgatgaggatggtgatattggcatgctagatgatgatgatgacttgcgtgatgcagctctccgtcagagattaaaccctctcagggatactggttccactgaagaaaaatcaaccaaccttgaaaaaaaagatccttctgccccagtggaaatcccgctgctcaaggatcccctatcccagttaatggtcagctattgaagggtttaaaccctgttcaggaaaaatagtctgggcccataaaaaattcagcttttggggggaagcaaatcaagttcttttcccaaaacccaatcccttgatggcttttgcaaaaccttttctcatgggaaatacttggatgcccgccccccccccccttttggcgggagctggag

SEQ ID NO: 82391 - protein, 61 aa, Zea mays
  misc_feature: Ceres CLONE 1568184
MSDWSSPAAPTFFPFGPQAEGWDVTFKVKYGDTLKRFYGCANGSHFDMNLSALRARIDTGL

SEQ ID NO: 82392 - DNA, 836 bp, Zea mays
  misc_feature: Ceres CLONE 1568187
  misc_feature: Encodes the peptide sequence at SEQ ID NO. 82393
  misc_feature (617)..(617): n is a, c, t, g, unknown, or other
ctccccgcggtggcggccgctctagaactagtggatcccccgggctgcaggaattcgtctcacccctagaaaaaactctcgctttcttctgtctcgcctcgccctcgcctttgttgatcttttcctctctcgcgttcccctctcgccttcttcttcctcccccacacccaccggtcgccgcccccgtcgccccgtcctcctcggtccagagacgagggggtccgcgccgttccgacgccacaccgcaaccgcatcacatcacacaccgcctgctcccaccgtccgtccgccctccctcgatcgcgccccccggatcgctggtacctccgcgcgcggctccgacctcatcttcctccatcgactggcatcggcagcggcggcgtgttcccggccagccttcgaaagggtaatcaatcgccagacttttgggagctctgttgggggggaccggggggaagagccaagttactgcagaggctaacatttcggttgtcgagtgatggcgcaaggcatcaacttccctgacttcatcggcgccgtgggtggccatgatggtggtgtggactttggtgggaacttctgtgacatggccttctaccagaagctaggggagggcnacaacatgtcggtcgacagcctcaacagcatgcagaccagcatgcatgggggggtcattcgcatgtctgtggacacaacagcagcgtttggctctaacagtgactcccgcactggcatgcttggtcatcctgggtctcaaggggcctgccattgtgggaaactactcggttgggcacagcatcttcccgccctgggcggggggtcccacgccttggagt

SEQ ID NO: 82393 - protein, 112 aa, Zea mays
  misc_feature: Ceres CLONE 1568187
  misc_feature (40)..(40): Xaa is any aa, unknown, or other
MAQGINFPDFIGAVGGHDGGVDFGGNFCDMAFYQKLGEGXNMSVDSLNSMQTSMHGGVIRMSVDTTAAFGSNSDSRTGMLGHPGSQGACHCGKLLGWAQHLPALGGGSHALE

SEQ ID NO: 82394 - DNA, 795 bp, Zea mays
  misc_feature: Ceres CLONE 1568189
  misc_feature: Encodes the peptide sequence at SEQ ID NO. 82395
  misc_feature (705)..(705): n is a, c, t, g, unknown, or other
  misc_feature (708)..(708): n is a, c, t, g, unknown, or other
  misc_feature (732)..(732): n is a, c, t, g, unknown, or other
ctcaccgcggtggcggccgctctagaactagtggatcccccgggctgcaggaattcgtctcacccctagaaaaaaaaaaaaaacaccaacctttagcaccaggcaaaccaaacactaggccaacgcaattctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctggccgtggacgggcacccggtcctgctggacgtgccggccaacatccgtctcaccccggcgtcgacgctcgtgcccgccgcggacgtccccgcagcgggcggcggcagcttcctcggcttcgacgcggcggcggccgagagccggcacgtggtgcccgtcggaaagctccgtgacattcggttcatgagcatcttccgtttcaaggtgtggtggacgacgcactgggttgggggacagcggcagggaacgtgagaacgagacgcagatgatggtgctcgaccgctcccgcggcgagcccgtcggcggcggccggaccctacgtgctgctgctccccatcatcgagggctcggtccgggcctgcctcgaggccggggaagtggaagactacntgnacctgtgcttggaaaaacgggtcntccgcggtgcccggcgccccgttcgggacctcgctgtacctgccgcgggcgacaaccgttcct

SEQ ID NO: 82395 - protein, 119 aa, Zea mays
  misc_feature: Ceres CLONE 1568189
  misc_feature: SWISSPROT Homolog: EC 2.4.1.67 Galactinol--raffinose galactosyltransferase
MAPNLSKKTPAGLLGDEVAPVEGLKPSRFTLKGKDLAVDGHPVLLDVPANIRLTPASTLVPAADVPAAGGGSFLGFDAAAAESRHVVPVGKLRDIRFMSIFRFKVWWTTHWVGGQRQGT

SEQ ID NO: 82396 - DNA, 845 bp, Zea mays
  misc_feature: Ceres CLONE 1568190
  misc_feature: Translation starting site: 158
  misc_feature: SWISSPROT Homolog: EC 6.2.1.1 Acetate--CoA ligase
  misc_feature (723)..(723): n is a, c, t, g, unknown, or other
acccgcggtggcggccgctctagaactagtggatcccccgggctgcaggaattcgtctcacccctagaaaaagacggacgccgccccaccagacctccgcccggatctcgccgcctctcccgcccctgctcgcgagccgccgtcgacagccaccgccatgggcacggccaacggccagcagccggcagagggcgctccctctgacaagctccgccacgtcgagtccatgtcggagctgccctccggcgccggcaagatctcggggatcaacgccgtcgtgctcggggagtcgctcgccgccgaggagaacgacctcatcgtccccagccccgagttctctgccagcgccctcgtctcttctccgaaacagtatcgcgagatgtatgagaggtccattaaggacccggccgggttctggtcggagattgccgagaccttttactggaaggagaagtggaaccccgccgaggtctgctcggagaacctcgatgtcaccaagggacccgtccagatcaactggttcaagggagggaaaacaacatatgttacaacgctgttgaccgcaacatcgagtctggcaatggcgacaaggttgcaatgtactgggagggtaatgagcccggtcaggatggggaagcttacctattccgagctcttgggagaaggtttgccagcttgcaaaatactttgaaaagccctgggtgtcggcaaggggtgatgctngttataatataccctaccaatgttggctggagcttcccattggcaatgcttggcctggtgcccccaatgggggcggttcccctccgggtggggtttgctgggctttccaagcagattccgcc

SEQ ID NO: 82397 - DNA, 834 bp, Zea mays
  misc_feature: Ceres CLONE 1568193
  misc_feature: Translation starting site: 221
  misc_feature (622)..(622): n is a, c, t, g, unknown, or other
ctccccgcggtggcggccgctctagaactagtggatcccccgggctgcaggaattcgtctcacccctagaaaaaaaggtcgcgtcagcgcccagatctctcgctcgctcgccggcgccccggctagatctgggcggagctcggaggcggagccgtgcgccagtgtccaagtttggtaagacccaaagcggtgaggaggcgagggaagacgcgcggacgccatggagctggctgtcggcggcgggatgcggcggtcggcgtcgcacacctcgctgtcggagtcggatgacttcgagctcacgcggctgctcagcaagccgcggataaacgtcgagcgccagcgctccttcgacgaccgctcgctcagcgacgtctcgcactcgggcgggtacagcaggggaggcttcgacggcatgtactcgcctgggggcggcctgcgctccctcgtcggcacgccggcctcctccgggctgcactccttcgagccccaccccatcgtcggcgacgccctgggaggcgctccgccgctcccttgtctttgtttcgcggtcagccccttggcaccgttgccgccgtcgaccacgcgtccgaggaagtccttcactacgaccaagtgtttgtgnagggattcgtgccgagcgccctggcgtttctgatgaatggcgagccagatatcgtcaagactttccttctgaagaccctgctgctgcagggctgggagaaaaaagtcgatcgggtccagctccgggaggggagcatggcgggctagccttcaggttatgcatgaccccaaggagggggttcaggaccctacatggctgatttgggggaaagc

SEQ ID NO: 82398 - DNA, 853 bp, Zea mays
  misc_feature: Ceres CLONE 1568196
  misc_feature: Translation starting site: 148
  misc_feature: SWISSPROT Homolog: EC 1.4.1.2 Glutamate dehydrogenase
ggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctggggcctggtgagaagccaatgattgttgtccagcacaagggggaggaggagcagtttgcagcttgaggagatctcctctatggttcttatcaagatgcgtggagattgctgaagcttactttgggtagcacgatcaagaaatggctggggtcacagtcccctgcctacttcaatgacctcacagagggcaggcccacaaagggatgctgggggggattgcctggccttaaatgggcttgcgttatcatcaacgaagccaacaggttgcagcttatccgcttatggtccttgacaagaaaggctacccggtgtccgggaagaaaaaatggccccccccctttgaacctggggggggggaccctttgaatgccccccctcctccccccttgggggaagggaatcttttgg

SEQ ID NO: 82399 - DNA, 819 bp, Zea mays
  misc_feature: Ceres CLONE 1568197
  misc_feature: Encodes the peptide sequence at SEQ ID NO. 82400
  misc_feature (362)..(362): n is a, c, t, g, unknown, or other
  misc_feature (373)..(373): n is a, c, t, g, unknown, or other
  misc_feature (389)..(389): n is a, c, t, g, unknown, or other
  misc_feature (394)..(394): n is a, c, t, g, unknown, or other
  misc_feature (401)..(401): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (819)..(819): n is a, c, t, g, unknown, or other
ctccccgcggtggcggccgctctagaactagtggatcccccgggctgcaggaattcgtctcacccctagaaaaaacaaacagagagctcaccaattcaactgaacagcaagcgcacctaccctacctgcaagcgcaccgcccgccgcccgccgtcgaaggcgaagacctagctcccggtccgtcgcgatggctgccgcggcccgccgcggccccggggcgcgcctccttgcggcgctcctcctgctggcgctggtcgtctccgggcactgcctggacgcgcaccaccgcgggctgaagcgccggcggcggaagcacgagatccattccccggtcaagacggtgggtggtggtggttgatggnagaaccgcagncttcgacccacatccntcggntgggctncgncnngcacccgcccccgacattcgacgggcctcacgggggccgccgaggtcgaacccgccctcaacgggccttccgacccccgccttcccccggggagaatctttcgttcaacccaaacgaagggccgggggtttacttaaaaaattcccaaaacccccgggccccaggggttttttcaagggggaacacttcggggggaagaaaaaaaaattttttttgggggttttcgcccgccaaaaaaaaccctttctcggggggggggggggcgcccccccccccccccacatgttttcccggggggagatttcttccccccccccaaaaaaaaaaacccccccccccccgcgccaaaaaaggggggccctccctccccgcgggggaggtgtacgccccacaaaaaaaaaaaaaaaaaatn

SEQ ID NO: 82400 - protein, 56 aa, Zea mays
  misc_feature: Ceres CLONE 1568197
MAAAARRGPGARLLAALLLLALVVSGHCLDAHHRGLKRRRRKHEIHSPVKTVGGGG

SEQ ID NO: 82401 - DNA, 1176 bp, Zea mays
  misc_feature: Ceres CLONE 1568199
  misc_feature: Encodes the peptide sequence at SEQ ID NO. 82402
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (1115)..(1115): n is a, c, t, g, unknown, or other
gggggggtggcgcccccccccacccgtgtttggggctttgttgggtgcgggattttnnnncgannnnnnnnaaagctggagctccccgcggtggcggccgctctagaactagtggatcccccgggctgcaggaattcgtctcacccctagaaaaaacaaacagagagctcaccaattcaactgaacagcaagcgcacctaccctacctgcaagcgcaccgcccgccgcccgccgtcgaaggcgaagacctagctcccggtccgtcgcgatggctgccgcggcccgccgcggccccggggcgcgcctccttgcggcgctcctcctgctggcgctggtcgtctccgggcactgcctggacgcgcaccaccgcgggctgaagcgccggcggcggaagcacgagatccattccccggtcaagacggtggtggtggtggtgatggagaacggcagcttcgaccacatcctcggctggctccgccggaccccccccaacatccacggccttcacgggcccgcgaaggtgaaccgcctcaaacgcctccgaaccccgccttccccggaaaatcttccgtcacccgacgaaggccccggctacgttaagacctccaaacccccggccccacggctttccgaagggaaaatcccgggggaaccaaaaattcttttgggggtttccccgcccaaaacacctttgacgcgagaggggggcctcgcgccccccccctccaaggtgttccgggggagattttacccccccaccaaaaaaataccttaccggctggcggggggggaattggggggccccctttctcgggggatatatgcgccggagaaaaagaaaaacctgtccccattgggtagcggcgggccttttacaaaggacggcccgggtagagcgccaccgtttccaccccatttctataaccggcccctttccacttttatgcacgagaacaaaaaacttttcctgcacgtgtgggtttacgagaccccgccgtaggtgtatcttgtcctcctcgggagcgcgcgcgagctctccgaagtagagagacctctaacaccgcgcggggtttgccttccggccctcctgggacgaaacttcccccaagacgtgnctcttccgtctttttaacacccccgcccaaagagaaccccccgttacatggggactttccg

SEQ ID NO: 82402 - protein, 243 aa, Zea mays
  misc_feature: Ceres CLONE 1568199
MAAAARRGPGARLLAALLLLALVVSGHCLDAHHRGLKRRRRKHEIHSPVKTVVVVVMENGSFDHILGWLRRTPPNIHGLHGPAKVNRLKRLRTPPSPENLPSPDEGPGYVKTSKPPAPRLSEGKIPGEPKILLGVSPPKTPLTREGGLAPPPSKVFRGRFYPPTKKIPYRLAGGELGGPLSRGIYAPEKKKNLSPLGSGGPFTKDGPGRAPPFPPHFYNRPLSTFMHENKKLFLHVWVYETPP

SEQ ID NO: 82403 - DNA, 1027 bp, Zea mays
  misc_feature: Ceres CLONE 1568202
  misc_feature (1)..(1): n is a, c, t, g, unknown, or other
  misc_feature (17)..(17): n is a, c, t, g, unknown, or other
  misc_feature (28)..(28): n is a, c, t, g, unknown, or other
  misc_feature (56)..(56): n is a, c, t, g, unknown, or other
  misc_feature (57)..(57): n is a, c, t, g, unknown, or other
  misc_feature (60)..(60): n is a, c, t, g, unknown, or other
  misc_feature (62)..(62): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (91)..(91): n is a, c, t, g, unknown, or other
naaaatttggaaaaaanaatagagaacnaccaaaccagtgactgcgctggtggccnnccngngggtgggatannnnnnnggtgtatnnnanaaaaaaaggagctcaccgcggtggcggccgctctagactagtggatcccccgggctgcaggaattcgtctcacccctagaaaaccgactccgacctgctcttgcatatagattgggcagagagtgagagagcgcgcgcgcgctcaaggggtgccaaaaggagattttttttttaatccagcttcttagcctcactgtctttgatcccggagagcagccgccagcccaactaatccttgctgctggcgcgccggggctccgattgcgctccagatctgaggcacctgctcggtggattccaggaatcggagcaccaactcgacaggggagttctcagggtaaaagagctgagagcgcgttggagattttgactataagaggcgagcgagccagctgggtgccttgctgcccttgaggacgccgtcagaaaaaaccccgtgggagggggagggcctataaaaatgagggaattcttggcccccgggttaatagaactatttttaaaccccttgtttgggggcccccccggtttttctttggggggggacccccgggggcaaaagggggtttccaaaaacccccctcggggcggggaaaagaaaaacgcccttcccctcttgtgaaaaaaaaggaaacccccccggggaaaattttttttcacccggggggggggtgttttcccattggcccccctgggggtccaaagacccacaacccaatttttttttttgagagccccaaaaacccccgcgggggaaaatccccggaacacccccttcccccggggggaaaaaaaccggggcccgccggggggagaccttttttttgggggggttttatataaaaggccccagggggcgccccccaaaaaaaccccccgggttttataaaaaaaaaacccctcttttataaattttttggaggatattttcccccc

SEQ ID NO: 82404 - DNA, 794 bp, Zea mays
  misc_feature: Ceres CLONE 1568204
  misc_feature: Encodes the peptide sequence at SEQ ID NO. 82405
ctcaccgcggtggcggccgctctagaactagtggatcccccgggctgcaggaattcgtctcacccctagaaaaagaggtgggtattcgaccgccaagcgccaactgcttagctcactcgtacatcgccacatcggtgaagtggtgtcgtggtgaccatggcgcctggcctcctcgctgccgccgccgtgctggccgcggtggcggcgtccctcgcggcccacgtcgcgctcaactgccccgtgcagccggtgccgtcgcatcgcccgccgcccactccgccgcccaacaacctactacaggttaacgaaccgtcccgcgaaaacctttgatcgttcttgccattacgtttccgttcgcgcgcgcgtgcgtgagtgacgctgggggcgtgcggaaacaaaattaaattgttacgcgcgcgccgccgtgcagaggctggagaagctcggggaaggggcgctggacgcgccggaggacgtgtacgtggacgcggcggcgggcggggcgctgtacacggccacgagggacggctggctgcagcggatgatgcaccccaacacggctcctgggaggcgtggcgcttcgtcggcggcacggggctgctcggggtcgccgccgtccgccgacggcaccatgcttcttctgcgacggccaacaaggtacaccgtacaccgatccgacaggctaccttgggttcggttgtggtaatagttacctggttaggccatttaggagcccctcttcggtgtccggattccccaaccgaactaccaaatcggatggacccgggggctta

SEQ ID NO: 82405 - protein, 57 aa, Zea mays
  misc_feature: Ceres CLONE 1568204
MAPGLLAAAAVLAAVAASLAAHVALNCPVQPVPSHRPPPTPPPNNLLQVNEPSRENL

SEQ ID NO: 82406 - DNA, 843 bp, Zea mays
  misc_feature: Ceres CLONE 1568205
  misc_feature: Encodes the peptide sequence at SEQ ID NO. 82407
ctccccgcggtggcggccgctctagaactagtggatcccccgggctgcaggaattcgtctcacccctagaaaaagcacgaccaaaggcaagtgggcggcagactgccttcactctcactcccgcccgtgtccctcgccctgtccgcgctgcggtgcgccctccctgcgccgctgttaatggaaacggcgcggcgtttccttcccaccacctcctcctcctcctcctgcacggcctcttcttcgctacgattcgccgcttctccgctcttcttctccttcccctgcagataaagcggctggttgccctggaagccttgcggtggagacggtctcggtctcggatccaggggagacacgcggatttgctgccatggtgaggtggggcgagatggtggaggaggaagaagacgacgagtacgctaagctggtcaggaggatgaatccaccgagagtggtcatcgacaacgactcgtgtggcaacgcaactgtcatccgggttgatagggtcaataagcatggcattttactggaagcagttcaggtccttgtcgatctcaacctcgtcatcacaaaggcttacatttcttcagacggcaactggttcatgcatgtgttcaatgtgaccgatcaggacgggagtaagcttcataacagggaggtcattgaccatattcagaaatgcctggaatcagacggcttaccttgttcctccggcgaaacggtatgcgctgccggaagaacaagttcaccctccttggaactgaccggccgcggaccccccgggccttctttctagaggggggcgcccgtgcctccccccccctgaagctgcaacatcgtgga

SEQ ID NO: 82407 - protein, 141 aa, Zea mays
  misc_feature: Ceres CLONE 1568205
  misc_feature: SWISSPROT Homolog: EC 2.7.7.59 [Protein-PII] uridylyltransferase
MVRWGEMVEEEEDDEYAKLVRRMNPPRVVIDNDSCGNATVIRVDRVNKHGILLEAVQVLVDLNLVITKAYISSDGNWFMHVFNVTDQDGSKLHNREVIDHIQKCLESDGLPCSSGETVCAAGRTSSPSLELTGRGPPGPSF

SEQ ID NO: 82408 - DNA, 808 bp, Zea mays
  misc_feature: Ceres CLONE 1568206
  misc_feature: Encodes the peptide sequence at SEQ ID NO. 82409
cgcggtggcggccgctctagaactagtggatcccccgggctgcaggaattcgtctcacccctagaaaaaaaaaaaatgattgcgacggtcctcgaggatgctggaggcaatgtgatttctgcccagtgctctgaatgtcaaagtgaagaaattcaaccaagcgcgggtaaacggcgggagtaactatgactctcttaaggtagccaaatgcctcgtcatctgattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagcctccgggcgcaagtgaaataccactacttttaacgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccactgctactcctacatcgatcagtgctgtgtagacaagaaaagcgggcagcttcgttcacccccgagaaagcttggagcagagcagggggggcgaagagacgatggtcgcgatcttctccaggttctccgccggcc

SEQ ID NO: 82409 - protein, 55 aa, Zea mays
  misc_feature: Ceres CLONE 1568206
MPRHLISDAHEWINEIPTVPVYYPAKPQPRERAWRNQRGKKTLLSLTLVRLCEMT

SEQ ID NO: 82410 - DNA, 833 bp, Zea mays
  misc_feature: Ceres CLONE 1568208
  misc_feature: Translation starting site: 322
ctccccgcggtggcggccgctctagaactagtggatcccccgggctgcaggaattcgtctcacccctagaaaaaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagtggaggtattgtggttactaatgatgggtatgcccatttttgagggaaatagacattgcacaccctgctgccaagtctatgatcgaactaagtcgtacacaggatgaagaagttgggtgatggcactacatctgtcaatgttctagctggagagatgctacatgtggcacaggcattcatcgacaagaactacatccaactgttatttgccgagcatatacaaagccgcttgatgatgcttatgctgtacttgacaaaatggcatgggctgttaatttaaatgaaccgggggcaatgctgggccttgtgaagagctctttggaacgaaattcctgggccaggttgggtgat

SEQ ID NO: 82411 - DNA, 894 bp, Zea mays
  misc_feature: Ceres CLONE 1568209
  misc_feature: Encodes the peptide sequence at SEQ ID NO. 82412
acccgcggtggcggccgctctagaactagtggatcccccgggctgcaggaattcgtctcacccctagaaaaaaaccccgccttccgcttcccacccgccccgcctgtctccacgcgccgccgccgcctccggatcgcggcctccctcctgccctgcagcgaagctttgcgcgctcggctcggcccggcccggcccatgccccgccgtgggtgaccagcgcctccacgtccggccatgggctgcgtgcacggccgccccgccacctccagccccgcgcccgccgccacctcctccagccgccgggaccatcccacggcctcccagacgcacaaggacggggtcgattccgccgccgccgcacctccggtggacgccgaggcgccggagcagcaggcggccgagaagccccagaaagtcaagcgggagcggcggtcgcggtcgtcgcgctccgccgccttcgcggcgcacaccgaggtgcgcctgggggcgggagcttcgccaacaaggcgcgcgggcgagaaggtcgcccccggctgggcccgctttggttctcccctgtcgccgggcgaggccatccgaaaggatggaaccccgggccgggccgaattccttttgaaaaaaatcaaaaaaaatcggcccagggggaacgaaaaggaaagggggtacaaggggcggaaaattcccttaaagcggaaaaaattggggggcctccaaaaaggggggcctttcaccaacccgtggacccccaaaaggcggggggtttttaggggggcccgaaaaatcttgtcttggggccggcctctccaccaccccccagtgtggttctagatctctcaggggggttctccctccctctcccccgaggtgttggcgggacctcttccctcccttttt

SEQ ID NO: 82412 - protein, 197 aa, Zea mays
  misc_feature: Ceres CLONE 1568209
MGCVHGRPATSSPAPAATSSSRRDHPTASQTHKDGVDSAAAAPPVDAEAPEQQAAEKPQKVKRERRSRSSRSAAFAAHTEVRLGAGASPTRRAGEKVAPGWARFGSPLSPGEAIRKDGTPGRAEFLLKKIKKNRPRGNEKERGYKGRKIPLKRKKLGGLQKGGPFTNPWTPKRRGVFRGARKILSWGRPLHHPPVWF

SEQ ID NO: 82413 - DNA, 940 bp, Zea mays
  misc_feature: Ceres CLONE 1568213
  misc_feature: Encodes the peptide sequence at SEQ ID NO. 82414
  misc_feature (940)..(940): n is a, c, t, g, unknown, or other
tggagctccccgcggtggcggccgctctagaactagtggatcccccgggctgcaggaattcgtctcacccctagaaaaaagtagcagcagcaacgaaccaacgaagcactggttggtaggtgcacgcaccccatccccccacccaatccctcgcggcgggcgggcgagagagcgagcggcgatggcggcactggaggcggtgaggtcgtgggcggtgtccgtcatcccgccggagctcgccgccgccgcggggggagacccgctcgccgcgctggcagccaccgccgcggcccttgtcgcggggctgcttatcctcgccgtctggttccgatccggaagcgggggcgccgtccaagccggtcgccacgccattacggccgccgcccggtgaaagtggacgccgtaccccgacctgggacaccgggcgggaagcgcgtcaccatctttcttggggacgcagaccgggccccgcccgagggattcgccaaaggccgattgggggaacgaggcctaggggggcgggacgagaaagggccgtggtttaaaagtgggggggatcctgggaaggaactttggccccggggggggacaagggaaattcccaaggggagaaagcttggaaaaaaagggaaaaccttggtgggcggcttggttcctttcctttaggcaaacaataatgggggggattggggaggaaccccaaaactggaataaaacccaagccaaggaattccctacgcaaatgggtggtttgccggggagggggaaataaaagagaaagcggaaactcttgggggctgaaaagggatcccttaaaagaaaggggggggatttttttggggccctggggaaaacccggggaggatatggaaacaatttttttatataagaggcgcggaaataggggtggtaaaaatgagcctccccataaagggaggcn

SEQ ID NO: 82414 - protein, 69 aa, Zea mays
  misc_feature: Ceres CLONE 1568213
MAALEAVRSWAVSVIPPELAAAAGGDPLAALAATAAALVAGLLILAVWFRSGSGGAVQAGRHAITAAAR

SEQ ID NO: 82415 - DNA, 893 bp, Zea mays
  misc_feature: Ceres CLONE 1568215
  misc_feature: Encodes the peptide sequence at SEQ ID NO. 82416
  misc_feature (441)..(441): n is a, c, t, g, unknown, or other
ggagctccccgcggtggcggccgctctagaactagtggatcccccgggctgcaggaattcgtctcacccctagaaaaaaaaaaggttcagacttcagaggtgctctaggcttcaaggggcggctgggtgagggcagagctctcaactaaatgcccaaagttaggatatatccagcaaaggacagaatgaaagtggtctctgtacaccttgctgctgctgttgctgttctacttctgttggcggcaaagcgcacccccgctattgcggttcctagccctcaatgccaatggcaatgcggcggcgttgacattgcgtttccgttcggcatcggtgacaactgctcgctatcacgaggatttcacctcagctgccaggaggtccaaagtggcgtctacaggccattcctaggtaatgttgaggtgctcaacatctccttgaatnaatggcacgatccggggggctgaccacatctcgacatactgctacgactcctcctctggttccatggagcccagtacctggcattacaacgcgagcggaaccccgtaccggtttttcggacgtccagaacaagtcccccgtcataggggggccatacccttccctacttcacgggacacaccgaacagaagctacccagaggggggtggcctctccgacgttgccaaaaattgtttccaaccctaaacgaaacggattcctgccccgggaattgggtttgtcttccaaaaagaaaaattccccaagaaaaaatgggcttttccacaaaaagtaaaccttcgcacccgtgggttccccaaaccaaagccaaaatttctccggggtggggcgcccttggagaagctttaaaatattattccctgtgctttaatggggaggccgggaaaggaatt

SEQ ID NO: 82416 - protein, 104 aa, Zea mays
  misc_feature: Ceres CLONE 1568215
  misc_feature (98)..(98): Xaa is any aa, unknown, or other
MPKVRIYPAKDRMKVVSVHLAAAVAVLLLLAAKRTPAIAVPSPQCQWQCGGVDIAFPFGIGDNCSLSRGFHLSCQEVQSGVYRPFLGNVEVLNISLNXWHDPGG

SEQ ID NO: 82417 - DNA, 827 bp, Zea mays
  misc_feature: Ceres CLONE 1568216
  misc_feature (355)..(355): n is a, c, t, g, unknown, or other
  misc_feature (364)..(364): n is a, c, t, g, unknown, or other
ctccccgcggtggcggccgctctagaactagtggatcccccgggctgcaggaattcgtctcacccctagaaaaagaccgttgtgcctaaagcccacaatgaccacatcgcgcagcatatccgaacctagccaaccagccccagcgcccaacgcacgaactgtaagaaaccctagcggagcaactgacacactcgcctacatcctcggccgccagctcgccaccatcgcctcccggtcggccgcgccacctcccggaagattggataacaatatcatgccattaggtggataacacttgacgtgctcctggtttgttcatttccgggcatcatcaaaatgtcaggaccgctgaatncaaacattnagtgggggcccctcgaaccttagagattccacaggaaggccatttacatcatcgttttctggtcaatctggatcaacttcaagttttcatcactacaggtcacaacacatttcatggaaatcttaattctgcaaatattctctggatcatttgccaccccaaattaattcaatggagggcatcccgtccggccaggggtcaacaaacccagtgggggggcatttcccggtgggccgtttcccccccaataatcttcaaaccttccttgggccccaaattcccccttgggcaattccggggattgccaaccaaggagggtttaaattttttggggggaaaaaccccggggaattgggagaggaaccagaaaaagggccttttggggggggcccaaaaaacaaggtgtttctccccacaaaacttgggggcaaaggtgtggggggaaaccccccatacttcttct

SEQ ID NO: 82418 - DNA, 822 bp, Zea mays
  misc_feature: Ceres CLONE 1568217
  misc_feature: Translation starting site: 245
  misc_feature: SWISSPROT Homolog: EC 2.3.1.119 Icosanoyl-CoA synthase
  misc_feature (76)..(76): n is a, c, t, g, unknown, or other
  misc_feature (624)..(624): n is a, c, t, g, unknown, or other
tccccgcggtggcggccgctctagaactagtggatcccccgggctgcaggaattcgtctcacccctagaaaaaaancaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctccgcgttcctggtcgtcttcgtcggcaccgtgtacgtgatgtcgcgccccaggccggtgtacctggtggactacgcctgctacaagccccccgcagctgccgcgtgcccttcgccaccttcatggagcacacgcgcctcatcagcgacgacgacaagagcgtgcggctccagaaccangatcctggagcgctcggggcttcgcgaggaacaagtgcttcccgcccgccaaacactacatcccgcccaaccccagcatggaggcctcccgcgccgagggccacctcgtcatctttttccgcatcgacgacctccgtccgccgcagggggctcaagccccaggaaaatcgaaaatccctcgtcgttaattggaaccca

SEQ ID NO: 82419 - DNA, 906 bp, Zea mays
  misc_feature: Ceres CLONE 1568219
  misc_feature: Encodes the peptide sequence at SEQ ID NO. 82420
aacacacagacagtcacacactcacagttccgctcgcttcgctctttcgctgtagccaagaactcgttctcgtcctcgtcccgttccaaagatccagcagcaatgaagggcatgggcgcgacggagacggcgccggcgggcaaggcggctccggcctcgcacatgccgatgccgatgacgcagcacgcgtccttctcctggggcgaccgcccggtggtgctgttcgcggggtggcccggcgcgcgcggcgcgggcgcgtacctgctctgcctcctcctcgtgctggcgctcgccgcgctcaccgaggcgctcgccgccgcctcgcgctgcgtcgcgcgccgcggcgcgggggcagaggcgggacgccgcgtcccggcgtcctcggccgcgctgctcgcggcggcgcacgcggccaggatgggcacggcgtacctcgtcatgctggccgtcatgtccttcaacggcggcgtgctgctcgccgccgtcgccggccactcgctcggcttcctcctcgcgcgaagcagggtcgtgcaccctggcggcggaggtgccgccgcagccgctggccgtgaccacgggctcggcggtggtgtcgtgggcgtccatcctccggatggctccaaggcctaaggctgcagcagggcaaatgcgctcgggttaaacaaatgactgactgtctgtctcgtgcttgtctgttgttgtagttgtctgaacacattcaggatactttttccatggttctcaaaccccgatgtcatctccctgtctatcgtgctatgggttattagtgtatgctgtaaagacggtataatgtgctaagtttccacgtgaattgattataacgttgtatttgtatccaagaacaaagagtttctcccttttgcgatacaaaaaaaaaaaaaaaaa

SEQ ID NO: 82420 - protein, 175 aa, Zea mays
  misc_feature: Ceres CLONE 1568219
  misc_feature (23)..(142): Pfam Name: Ctr Pfam Description: Ctr copper transporter family
MKGMGATETAPAGKAAPASHMPMPMTQHASFSWGDRPVVLFAGWPGARGAGAYLLCLLLVLALAALTEALAAASRCVARRGAGAEAGRRVPASSAALLAAAHAARMGTAYLVMLAVMSFNGGVLLAAVAGHSLGFLLARSRVVHPGGGGAAAAAGRDHGLGGGVVGVHPPDGSKA

SEQ ID NO: 82421 - DNA, 806 bp, Zea mays
  misc_feature: Ceres CLONE 1568223
  misc_feature: Encodes the peptide sequence at SEQ ID NO. 82422
  misc_feature (578)..(578): n is a, c, t, g, unknown, or other
ctccccgcggtggcggccgctctagaactagtggatcccccgggctgcaggaattcgtctcacccctagaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtgcaacgagtgcgccttccccgtctgccgggactgctacgaatacgagcgccgggagggcacgcagaactgcccccagtgcaagactcgatacaagcgcctcaagggctgccagcgtgtgaccggtgacgaggagggagacggcgtcnatgacctggacaacgagttcaactgggacggccatgactcgcagtctgtggccgagtccatgctctacgggcacatgagctacgggcgtggaggtgaccctaatggcgcgccacaagctttccagctcaaccccaatgttccactcctcaccaacggccagatgggtgatgacatcccaccggagcagcacgccctggtgctttctttcatgggtgggggggggaaat

SEQ ID NO: 82422 - protein, 182 aa, Zea mays
  misc_feature: Ceres CLONE 1568223
  misc_feature: SWISSPROT Homolog: EC 2.4.1.12 Cellulose synthase (UDP-forming)
  misc_feature (107)..(107): Xaa is any aa, unknown, or other
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEGDGVXDLDNEFNWDGHDSQSVAESMLYGHMSYGRGGDPNGAPQAFQLNPNVPLLTNGQMGDDIPPEQHALVLSFMGGGGK

SEQ ID NO: 82423 - DNA, 977 bp, Zea mays
  misc_feature: Ceres CLONE 1568228
  misc_feature: Encodes the peptide sequence at SEQ ID NO. 82424
  misc_feature (185)..(185): n is a, c, t, g, unknown, or other
ctggagctccccgcggtggcggccgctctagaactagtggatcccccgggctgcaggaattcgtctcacccctagaaaaaaacgcccatctgcacgggccacgcgaagcgttcgagctcctcccacggcagccatggtcaccgccaccacctccccgctcttctccctctcctccctccgcgccntccctcccttcacccacccgatttcacacgtctctctcgctccgagccctctccccacgtgcccgtctctctgcctccctccctttcgcctccccactcgtttcaggcgggtacgggacctgggcggcgacttcagtgtcgtccgcgggaaggttgagacggcgggggctgtgaggtggttgtgcgaggccaccactgggcggggggccggacccggtttaaaaagagggaagcgcccgaacgacaaggcaccgcatcccaaaaatcacgcgcgccaaggcctaaaatgcgcacctagggaatgaaaaaagggcttaaagaacctccttgaaaaaaaccttaggaaaaaaaaccttgaaccccccagaccctggaaaaaaaaaaaatttgaaaaataaagagaaaaaccggaatcccccccgaaaggccaataacaaaaaggccacttgtgaaccaaggaaccggggtgaaaaaggtttggggcccccacattgtcaatttatggaaaaacaccgggcggaaaccccaattccggaaaaaatcctccgacctggggctaaaggaatagaaagaaaaaggcccatcccaaaaaaaactcccccgtgggggtttggggatagtttccaaaaaacacactaaaaacctggtgtggcgggacacacctagggaaattccttggaaaaaaatcgggctatttccgggggggcccccatttattaatttttgggggagaacatattgacattttccacggggccccacacaagacttttgcgagattttctccaattg

SEQ ID NO: 82424 - protein, 118 aa, Zea mays
  misc_feature: Ceres CLONE 1568228
GAPRGGGRSRTSGSPGLQEFVSPLEKNAHLHGPREAFELLPRQPWSPPPPPRSSPSPPSAPSLPSPTRFHTSLSLRALSPRARLSASLPFASPLVSGGYGTWAATSVSSAGRLRRRGL

SEQ ID NO: 82425 - DNA, 829 bp, Zea mays
  misc_feature: Ceres CLONE 1568229
  misc_feature: Encodes the peptide sequence at SEQ ID NO. 82426
ctccccgcggtggcggccgctctagaactagtggatcccccgggctgcaggaattcgtctcacccctagaaaaagtttcgaactcacgcaacgcaagctgagcaaccgctgccggccgcgcacggccgcccacccaccagtccaccactaaagcctcacaccgccacagcagctgccgcggccgagccgacgacgaggatgagcggggccgcgctgtgcgcggcgctgacggagctggggttcgacggggaggacccgctggacgcggatgcgctggagtggccgttccagtatgaggaggcgcgaccgctgcttgcctggatctgctcctgcctccgcccctctaacgtcctctccccgtcccacctggcccagtatgaacaactcgtggaagagggaagactgttagagggtgaagatttggactctgcttttgatagtatttcagctttttcaagcaagaaagacaatcaagaggctgtgtttggatcggaagaaaccattcttgatatccgtgaagcaaaactagcatatagagccgaagtttttgagttacaaaagcagctggtgcggcagcaagcacaatttgatttgcttgcagggcaggctttcactctttatcaaggtagaagatcacgtgtatctgctatgtctgcagttagtggagagcttatatcgctagatgagatactttcttcccagaaacttggagatgaattcagttcctgggaggaatcactgctactaccccaggacttagccattatcatttcggggaatgagggaagtatatatttggcataatcaaacttccactcctatgttggtg

SEQ ID NO: 82426 - protein, 201 aa, Zea mays
  misc_feature: Ceres CLONE 1568229
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGSEETILDIREAKLAYRAEVFELQKQLVRQQAQFDLLAGQAFTLYQGRRSRVSAMSAVSGELISLDEILSSQKLGDEFSSWEESLLLPQDLAIIISGNEGSIYLA

SEQ ID NO: 82427 - DNA, 828 bp, Zea mays
  misc_feature: Ceres CLONE 1568230
  misc_feature: Encodes the peptide sequence at SEQ ID NO. 82428
ccccgcggtggcggccgctctagaactagtggatcccccgggctgcaggaattcgtctcacccctagaaaaatcgatcgagagccactagttctctcgctttccgaaccccatccactcggctcgccgcccgcacacgcccattccattccactttccaccatggcttccctctgcgtccaccatacctcgctaccactctccccgccccaccaggtcaccgtccccgaaccctctcgcgcgctgcccccatcctcgcgcctccccgccctgccgtcctcctccaaccatgtcagcgccctccctcgacccgcggcggcggcttcctccgccttcgcgtgccactgcaaagcaccggtgcgggaccacgacgctgagctcctccgcgctctacggtccaacggcaacggcaccctccacggggacacagcaccgccgcaagtcctcgactcgcgctccgacggaccgggcggcggcgacggcagcaagaagtcgcgtttctgcgcccgtgattgcgcgaagcggatcatggagctgcccgtggaagaagcggtgaaggtgctcgacctcctgccgcgcgacgacgcggcgctcaccgtctccgaatacaacgacatcctctcggcgctggctcgcgcggggggacacgccacgggcgtcgcgctggtccgcggcatgcccgtcgcccccgacgcacactctttcgccaccgccgtgcagtgcctcttgccgacagggcgcgcccgaaaaagccaagctcgccctccaaccaaatggtgggcccccgggtttccgccccagcgttggcaccggtcctcagcccggtggg

SEQ ID NO: 82428 - protein, 100 aa, Zea mays
  misc_feature: Ceres CLONE 1568230
MELPVEEAVKVLDLLPRDDAALTVSEYNDILSALARAGGHATGVALVRGMPVAPDAHSFATAVQCLLPTGRARKSQARPPTKWWAPGFPPQRWHRSSARW

SEQ ID NO: 82429 - DNA, 789 bp, Zea mays
  misc_feature: Ceres CLONE 1568231
ctggagctccccgcggtggcggccgctctagaactagtggatcccccgggctgcaggaattcgtctcacccctagaaaaactttttctcccactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccgggccgtgggggccccacgagcccccgcaagggtgctgacatccctcggtcgaggtccctcgaggggctgcgggcgtcccccgaacttccttcgccctaacccccggggggggccggtccattgggggaatccccccaagggaactttaaccccgggttccccccggttgatttgcgccaaaaccaaccccttttttcccgccccccaaaaaaaaaagggggggggggggcccctttttggcccggccctaccccgggggttaaaggggggggggttccccatttgggggggcccccacagtttcggggggggtttttttggaaaaattttgacccaacccctttcccggggggcccccccgggggggggccccccccccaaaaaaccctttattttttctctttcccggggaaagtttttttttgggcaaaaaaaaaaacaagttctttgggtatccgcagaaaaa

SEQ ID NO: 82430 - DNA, 795 bp, Zea mays
  misc_feature: Ceres CLONE 1568233
  misc_feature: Translation starting site: 200
  misc_feature: SWISSPROT Homolog: EC 1.4.1.2 Glutamate dehydrogenase
ggagctccccgcggtggcggccgctctagaactagtggatcccccgggctgcaggaattcgtctcacccctagaaaaactcgtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaacaggtcggcatggaacccatcaacaccgtctttcgacgcgaaggcgggtcatcgggcgggggcttcctcttgacccttcgggtgcaaagtgaccccaaaccatgggcctttccagggggaacccggggctcccgggaaaaagccccatgatcggggggggcattttcagggggcaaaggaaaaaaaagtttcccgggcccgaaggaaaataagccccccgggataccctgaaaacaaattttaaagggaaaaaggcccaaaagttttttcctccgggggcccccccctttaaaaaaaaggtggtgggttaacccgggtccccggggcctattttttaaaaaaaattcccccaggggcgcaggggggcaccaaaaggggagaaccccggggggtttttattcctggggggccctaaa

SEQ ID NO: 82431 - DNA, 796 bp, Zea mays
  misc_feature: Ceres CLONE 1568234
  misc_feature: Translation starting site: 394
  misc_feature: Pfam Name: CitMHS Pfam Description: Citrate transporter
  misc_feature (594)..(594): n is a, c, t, g, unknown, or other
  misc_feature (678)..(678): n is a, c, t, g, unknown, or other
  misc_feature (732)..(732): n is a, c, t, g, unknown, or other
  misc_feature (733)..(733): n is a, c, t, g, unknown, or other
ccccgcggtggcggccgctctagaactagtggatcccccgggctgcaggaattcgtctcacccctagaaaaagtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcagggagcagccgcgagcgagccatggccatggatcccgttctgaaggtggccctgggctcggcggcgttcgccgtgttctgggtgctggcggtgttcccggcggtgccgttccctgccatcgggcgcacggcgggctccctgctgggcgccatgctgatggtgctgctgggcgtgatgagcgccgacgacgcctacgccgccgtggacctgccccatctgggncctgctgtcggcaccatggtgggtgagcgtgtacttggagcgcgccgacatgttccggcacctggggcgcctgctgtcgtggcngaaccagggcgggcgggacctgctgggtgcgcacctgcgccgtggtcgggctcnngctcgcgctttaaccaacgaacacctgctgggtctggctcaccgagtccatcctcaagatccg

SEQ ID NO: 82432 - DNA, 883 bp, Zea mays
  misc_feature: Ceres CLONE 1568241
  misc_feature: Encodes the peptide sequence at SEQ ID NO. 82433
  misc_feature (384)..(384): n is a, c, t, g, unknown, or other
  misc_feature (501)..(501): n is a, c, t, g, unknown, or other
  misc_feature (528)..(528): n is a, c, t, g, unknown, or other
  misc_feature (529)..(529): n is a, c, t, g, unknown, or other
tggagctccccgcggtggcggccgctctagaactagtggatcccccgggctgcaggaattcgtctcacccctagaaaaatttgcttcctcctgtgccgtgtttcatttctttgacacaacgacgtccgggcagccgcctcctgtcgccagttcgccactctctggttgctgcacgcctctagtcggcggggccaagaggtggaaaagggcaggatgaagtccggcgagcggccgaagcagatgcggggcgtccggcaggaatctcggcggttccggcttctggtcatcgtcgccggcttcttcctcgtctccctgaccttcgtcgtcatctccaagcccgattccatcctgtccagcctgaacggcaagctgccggtggaccangcgccgacgtccatcctgatccagcagaaaggtaactcgccccccgccaccgcacttgagacctccaccgacgcactgcgtggagaccctagaggtgtcgatgacgaagcccatccnagaccacaggggttcaagggctaaganngaaaaaaccgggtactgagccagccggacccgaccagcgggataaacgagctgaccccccaaaaaggacggggcggcccgtaaatccaacaagaaagtgctaagccggcgaagggtcccgccaaggggaaaaaataaggggggaccccgccccccggcccgaaaaaacaaaaaagagggccccccaacggttttccaaatccctttttttggaacccgggagacccccaaagtgccccgggagaaattatattttttttccccccgggggggaaaaaccccctgtggatcccttaatattttaaaaaaaaaatggtgaaaaaaaaggggggaaaaatttaaaaacacccaaaaa

SEQ ID NO: 82433 - protein, 103 aa, Zea mays
  misc_feature: Ceres CLONE 1568241
  misc_feature (57)..(57): Xaa is any aa, unknown, or other
MKSGERPKQMRGVRQESRRFRLLVIVAGFFLVSLTFVVISKPDSILSSLNGKLPVDXAPTSILIQQKGNSPPATALETSTDALRGDPRGVDDEAHPRPQGFKG

SEQ ID NO: 82434 - DNA, 827 bp, Zea mays
  misc_feature: Ceres CLONE 1568243
  misc_feature: Encodes the peptide sequence at SEQ ID NO. 82435
ggagctccccgcggtggcggccgctctagaactagtggatcccccgggctgcaggaattcgtctcacccctagaaaagcccccatcgtcgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccttctctgcactatccacggccactcgaggctgatcccggggctcccggatgaggtctctctgcagatcctcgcgaggatgccgcggatggggtacctcaaggccaagatggtctcgcggagctggaaggcggcggtgaccggcgcggagctgtaccggctgaggatgtagctcggcgtggccgaagagtggctgtacatactgacgaaggcggcggcaggggggcagaaactgggtctgcacgctcttcgatccggttagcaaccaatggcagaagctgccgctcattgcctgggaatcaaatgcagaagtgggccgcttgtaccgggctgggcctgccgggacctggtgaagcgcccggcttaggtattcttcgacggtcatcagaaggcttggctcggggaaaaaagaagctgtcagggcggcgtaaaccaccggttccggtgggctggcc

SEQ ID NO: 82435 - protein, 90 aa, Zea mays
  misc_feature: Ceres CLONE 1568243
  misc_feature (44)..(91): Pfam Name: F-box Pfam Description: F-box domain
MGASLGSAASKNRQQEHGGEAPRPDPCKKTRLSTLLCTIHGHSRLIPGLPDEVSLQILARMPRMGYLKAKMVSRSWKAAVTGAELYRLRM

SEQ ID NO: 82436 - DNA, 806 bp, Zea mays
  misc_feature: Ceres CLONE 1568246
  misc_feature: Encodes the peptide sequence at SEQ ID NO. 82437
ctggagctccccgcggtggcggccgctctagaactagtggatcccccgggctgcaggaattcgtctcacccctagaaaaaaagaaccccgccgtgctcgcttccactgccttcgattcctttggctctctctgtcgttggtcgtcctcgcccaccccaaccaaaaccccacggacggaacccaagaaagaagagaggggcacgagtccccatgaacgacgccggcgaggccgaggcgcaagaactcgccccacccggcgcctccgccgccgccggcctgcaaggcagggcggaggtcgacacctcgacgcccttcaagtcggtgcgcgaggccgtcgaccgcttcggcggcagcgcccgcctggagctcccgacctcatccaggcgtatgttccgcgctgccccccgagccccaaaaaagcagggagggggggcgaacaaaactgggccaaaccttggaggaaccataacccgcgccagcttagaaaaaagggacctccgggcgtccaagggaaaagggggaaacccccttggaggtggcccccaaaagaaaggtggggagatccccccccacaaaaaaggggggggccccccaaaaatttttaaaaaacccttaaagaatatccccaaaaccccaaatggggggcccccggggggacatttttttgggcgcccccccccctaaaaaaaaaaaaagtgggtttcccgggggggggtcaaaaacaccccaaaaaattttttccccccacattgtgggccccctttttaaaaaaaaaaggggggttgtgccaaaaaaaaaagaggccc

SEQ ID NO: 82437 - protein, 157 aa, Zea mays
  misc_feature: Ceres CLONE 1568246
MNDAGEAEAQELAPPGASAAAGLQGRAEVDTSTPFKSVREAVDRFGGSARLELPTSSRRMFRAAPRAPKKQGGGANKTGPNLGGTITRASLEKRDLRASKGKGGNPLGGGPQKKGGEIPPHKKGGGPPKIFKKPLKNIPKTPNGGPPGGHFFGRPPP

SEQ ID NO: 82438 - DNA, 810 bp, Zea mays
  misc_feature: Ceres CLONE 1568247
  misc_feature: Encodes the peptide sequence at SEQ ID NO. 82439
  misc_feature (665)..(665): n is a, c, t, g, unknown, or other
ctccccgcggtggcggccgctctagaactagtggatcccccgggctgcaggaattcgtctcacccctagaaaaaaagcaagagactgagagaggcaggtaatacatatagctgctgcgacgagtgatcagtaaagcttcatcttcttcctcctcctcctccggcctcttcctcagtgctgcacgcagtgcgcgggtaggaaggaactcgcgtacgtgtgctagctagctagctcgaccacgcgcagcacgcaggcgcgtagtagctcgatcgatcgaccgccggccggaaatgtcgaccaactcgaggtccaactccagggccaacttcaacaacgagatccatgacatcggcacggcgcagaactccagcatgccccccacgtactacgaccggtcgctggcggacatcttccctccccacctcctcaagaaggtggtctcggaggtggtgtccacgttcctgctggtgttcgtcacgtgcggggcggcggggatctacggcagcgacaaggaccgcatctcgcagctggggcagtcggtcgccggcgggctcatcgtcaccgtcatgatctacgccgtcggccacatctcgggcgcgcacatgaaccccgccgtcacgctcgcgttcgccgtgttccggcatttcccctggatccaagtcccngtctactgggcggcgcagttcacgggagcatctgcgcgtcgttcgtgctcaaggccgtgctgcaccccatcgccgtgctgggcacaaccacgccggacggggccgcactggcactccttcgtaatcaagatcatcgtcaccttta

SEQ ID NO: 82439 - protein, 173 aa, Zea mays
  misc_feature: Ceres CLONE 1568247
  misc_feature (39)..(167): Pfam Name: MIP Pfam Description: Major intrinsic protein
MSTNSRSNSRANFNNEIHDIGTAQNSSMPPTYYDRSLADIFPPHLLKKVVSEVVSTFLLVFVTCGAAGIYGSDKDRISQLGQSVAGGLIVTVMIYAVGHISGAHMNPAVTLAFAVFRHFPWIQVPVYWAAQFTGASARRSCSRPCCTPSPCWAQPRRTGPHWHSFVIKIIVTF

SEQ ID NO: 82440 - DNA, 842 bp, Zea mays
  misc_feature: Ceres CLONE 1568250
  misc_feature: Translation starting site: 442
tccccgcggtggcggccgctctagaactagtggatcccccgggctgcaggaattcgtctcacccctagaaaaaatcttcgtcttcgtcttggcgtcctccagcgctctgccttcctgagctggcttcttgtccgcaggatccatggcgaaggactacccagcttctccaaaagctcagcagctgcaggaatccaagaagcagcgcctgacatacatcctcgtcgtaagctgcgctctgcatcgccttctacgtccttggcgcatgacataacaccacgcttccaaagcccataggcaactcggcgatcacccgggttggctgcgatcccactgccgccacgacacagtcctctggctctgtgccgacatttgcgccacgctcctgcgaggtgcttgacttctacgcacaccaccggctcaccatcaacaacacggacagcaatggggaactgcagcagtttcccggcgtgccctctacacttcagtgagtacacgccgtgtgaggaccgtaggcgcgggcgcccgttcgaccgacacatgctagtgtatacggagcgccactgtcctggcaaggacgagaaggtcagatgcctcatcccagcaccgtctgggtacaagaccccccttcaagtggcctcgtagcagggactacgcctgatttcacaacatcccccacagggagctcagcattgaagaagggggcgcagacctggatccaggttgaagggcgacgagttcaagttcccccggtgggtggcactaatttttcccccgggggtgcctgattcccctctgtgggatgacttccattaagccccgtctcgggattcaaaatgggaaaa

SEQ ID NO: 82441 - DNA, 872 bp, Zea mays
  misc_feature: Ceres CLONE 1568252
  misc_feature: Encodes the peptide sequence at SEQ ID NO. 82442
cggccgctctagaactagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggggtcctcatctggctcatccccccccccgccgggggtgccccgcaacgcgtggaagctcccaaaccatcttcctcatcaacaatggtcggcaatcatcaccacagccggctgcccccttaggcgcgggtcgccactcctccggacctcggccccccgccgtggcttaaacccgcaacgctaaacatgtcgcccgcgggactttctcgggcctttgggaaaacccgaatccccttggggttcaatgggggctccccctttcttcctttgggagaggggggttcactcaaaaaacgggcgcttgggtcccccggggtgaggcaaagggccttttctgggccgcccccttcgggggtcccccccccccccggggccctgaagcaaacaccctctcggtgttcg

SEQ ID NO: 82442 - protein, 72 aa, Zea mays
  misc_feature: Ceres CLONE 1568252
MSPAGLSRAFGKTRIPLGFNGGSPFLPLGEGGSLKKRALGSPGVRQRAFSGPPPSGVPPPPGALKQTPSRCS

SEQ ID NO: 82443 - DNA, 911 bp, Zea mays
  misc_feature: Ceres CLONE 1568254
  misc_feature (344)..(344): n is a, c, t, g, unknown, or other
cccgcggtggcggccgctctagaactagtggatcccccgggctgcaggaattcgtctcacccctagaaaaacagcggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaagattggctctgagggttgggctcgggggtcccggccccgaccccgtcggctgctggcggaatgctcgagctgctcncgcggcgagagcgggccgcccccttgccgggccgggggacggaacccccacccccccccccgggggcccttccccggccggtgaaacaacgaactcaaaaactgggtcgggacaaggggaattccgaatgttttaatttaaaaaaaacattggcaccgggccctcgagaagcttgaccccattttgatttttcccccccgggccccaaatgttccaaggggaaaaaattttccccccccgccgggggaaaaagggggggagaaacattaaccatcttttaaggggaccaaaaagccccccccctctttttttttgggccccccccaaaaagggttattcaaaaatttcccccgtgtccccgtttttttttttgggggaaaaacccccccgagggggaagggggttgtgggggaaacccggggggaaaaaaaacaccccgtgtgggctttcctccctcccccccctttttaaaaaaccctcgggggggtggaaaaaagggggggccccctcgcgcccaaaaaaaaaaaccccccccttcacgctttttttttcctcgcgcggggggag

SEQ ID NO: 82444 - DNA, 805 bp, Zea mays
  misc_feature: Ceres CLONE 1568255
  misc_feature (528)..(528): n is a, c, t, g, unknown, or other
  misc_feature (737)..(737): n is a, c, t, g, unknown, or other
agctccccgcggtggcggccgctctagaactagtggatcccccgggctgcaggaattcgtctcacccctagaaaaaccccccccccccccccgcaccatcctggtctcaccgtcactacgaccgatcttgctcgccactcgcctccctggctctctccctacttcccatgctgatctcggcgtaaggcagactgatcccggcgcctgttctcagcgctctcctttttttttttcttcatccggttcatgcatgttctgcggttgttgtttacttataccctttgagatttcgctcttgcggattctccaacctgtgtttatgtccccctgcatttccttgtccggtgccacctcacgtctcctcacctagcaaagtagcggtcattttaatagtagcatttccacatcaagctctctaatctgcgcttctcttaattaatttattcgcccacaggcggttgctggatcctttggcgttccccatccggccaagaatcctgcaagagcctgcttggagttggagccggncaaacttgctgccgtcgacgtctcgggcgaggcagccttcagcatcagtctccttgacgaaggcagccagccatgatgagctttcagggaccccaagggggttccggtcacagggtgtccccggaaaaccccgcggggaaaaaaaaaaacccccccccggggccccccccctccccccacaggagggggggggggggggcgccaccctntccccctttttttttttttggggggagagaaaaaaaacaccccccccctcccctgcttcgtttgtggg

SEQ ID NO: 82445 - DNA, 850 bp, Zea mays
  misc_feature: Ceres CLONE 1568256
  misc_feature: Encodes the peptide sequence at SEQ ID NO. 82446
  misc_feature (477)..(477): n is a, c, t, g, unknown, or other
  misc_feature (531)..(531): n is a, c, t, g, unknown, or other
ctccccgcggtggcggccgctctagaactagtggatcccccgggctgcaggaattcgtctcacccctagaaaaacgttcgtctgacttgggtataggggcgaaagactaatcgaaccatctagtagctggttccctccgaagtttccctcaggatagctggagcccacacgagttctatcgggtaaagccaatgattagaggcatcgggggcgcaacgccctcgacctattctcaaactttaaataggtaggacggcgcggctgcttcggtgagccgtgccacggaatcgggagctccaagtgggccatttttggtaagcagaactggcgatgcgggatgaaccggaagccgggttacggtgctaaactgcgcgctaacctagaacccacaaagggcgcccgtcgattaagacagcacgacggtggtcgtggatacaacaacttagcataacaaaagcccttgcccacgccatgacnctcagcaagaagcaaggcgcaggccctgatccgcaagcctggctggatgctcanctgcagctttagcgacaccacaatggtttttggcaagccatgggcctcaagggccccttaaaccctcccataggggaacccatccccgggaggggggttcaaccccccctttgaagaattcccacagggcccccttcccccgtcaaaaaaacattgctggaagccccctgggcgggggccctcccccggggggtttaaaagaaaccccgggcccttttttaaaaacccctttttagggccccccggccctccctttggggggggggggggggaaaaaaaaaccctccgagaaccagagaggaaaattttttggggcccc

SEQ ID NO: 82446 - protein, 37 aa, Zea mays
  misc_feature: Ceres CLONE 1568256
MNRKPGYGAKLRANLEPTKGARRLRQHDGGRGYNNLA

SEQ ID NO: 82447 - DNA, 804 bp, Zea mays
  misc_feature: Ceres CLONE 1568257
  misc_feature: Encodes the peptide sequence at SEQ ID NO. 82448
ctccccgcggtggcggccgctctagaactagtggatcccccgggctgcaggaattcgtctcacccctagaaaataacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtacacggccgagatctcgccggcggcgtcccgcggcttcctcacgtccttcccggaaagtgtcatcaacgtcggcatcctgctcggctacctgtcgaactttgcgtttgcgcgcctaccgctcccgctcggctggcgcgtcatgctcggcatcggcgccggcgcgggcgggctgctcgcgctcatggtgctctggatgccgaagtcgcctcgtggcttgtcatgaagggccgcctcgccgaccccagggcggtgctggagaaaaccttcgcttccccggaggaagcccccaagcggctggttgacatcagggttgccc

SEQ ID NO: 82448 - protein, 210 aa, Zea mays
  misc_feature: Ceres CLONE 1568257
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFLTSFPESVINVGILLGYLSNFAFARLPLPLGWRVMLGIGAGAGGLLALMVLWMPKSPRGLS

SEQ ID NO: 82449 - DNA, 845 bp, Zea mays
  misc_feature: Ceres CLONE 1568258
  misc_feature: Encodes the peptide sequence at SEQ ID NO. 82450
tggagctccccgcggtggcggccgctctagaactagtggatcccccgggctgcaggaattcgtctcacccctagaaaaaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagataccgttcagagaaaaagtatatacactgttatttccctcttcattttcctggtctgcagccagctcccactctatggcattcattcaacaactggagctgatcctgtctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctggatggtgcacaaaaattgcttggtatcctgattgctattgggggagctgtggcatatgtcctggtctggaatggatggcaaggtaaagcaacttggaacagggaatgctatcctcattatacttcagctttttctttgctgggattctttggcgtcctgtctgggataaacttcccccgaaagggttatgggctggggggatctgggaatttccccgggttccttggctcccaaattatctggcgaagaatttccatcctgggaagggattttagccccccaaaccctttaaaaaggggggggcggggggg

SEQ ID NO: 82450 - protein, 152 aa, Zea mays
  misc_feature: Ceres CLONE 1568258
MRVILASNRGTVMELGITPIVTSGMVMQLLVGSKIIEVDNSVREDRALLDGAQKLLGILIAIGGAVAYVLVWNGWQGKATWNRECYPHYTSAFSLLGFFGVLSGINFPRKGYGLGGSGNFPGFLGSQIIWRRISILGRDFSPPNPLKRGGRG

SEQ ID NO: 82451 - DNA, 798 bp, Zea mays
  misc_feature: Ceres CLONE 1568259
  misc_feature: Encodes the peptide sequence at SEQ ID NO. 82452
  misc_feature (505)..(505): n is a, c, t, g, unknown, or other
tacccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcggggagtcccacgcagcnaacactgggagggtctgctggaccccatcgacggcgtgctcctccaggagctcatccgctacggcgagttcgccaggccacctacgacagcttcgactacgaccgcttctccccctactgcggcagctgcaagtacccggggaaagactttctttcacgacgtcgggctcgggcgcatcggctaagaagtcacccgctacctctacgccacctggaaggaccttaagttcccccaacttcggatcaggaagccgccaaagccaaaaatggggggggatcccggacctttcttg

SEQ ID NO: 82452 - protein, 147 aa, Zea mays
  misc_feature: Ceres CLONE 1568259
  misc_feature (87)..(87): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWRGVPRSXHWEGLLDPIDGVLLQELIRYGEFARPPTTASTTTASPPTAAAASTRGKTFFHDVGLGRIG

SEQ ID NO: 82453 - DNA, 778 bp, Zea mays
  misc_feature: Ceres CLONE 1568262
  misc_feature: Encodes the peptide sequence at SEQ ID NO. 82454
  misc_feature (672)..(672): n is a, c, t, g, unknown, or other
  misc_feature (709)..(709): n is a, c, t, g, unknown, or other
ctccccgcggtggcggccgctctagaactagtggatcccccgggctgcaggaattcgtctcacccctagaaaaaaacagctactccgcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggttcccatgggcggatgcctctcgcaggaggagcaccggctccagagcaggccagctgaagctgctggagcagatggattgcggaagtctaaatctgattctaaagctgtagcaagtgttcttgctcctccaaagatgtggtggacctgcaagtagaaggatatggaaatgtgaatattttcacatatgacgaattnagagcagccacaaaaaacttccggccagatcaaatcntgggagaggtgggattttttgagttgtttacaaaggtgtaatttggatgaaattgttaagagcaagttt

SEQ ID NO: 82454 - protein, 49 aa, Zea mays
  misc_feature: Ceres CLONE 1568262
MGGCLSQEEHRLQSRPAEAAGADGLRKSKSDSKAVASVLAPPKMWWTCK

SEQ ID NO: 82455 - DNA, 865 bp, Zea mays
  misc_feature: Ceres CLONE 1568263
  misc_feature: Encodes the peptide sequence at SEQ ID NO. 82456
  misc_feature (544)..(544): n is a, c, t, g, unknown, or other
ctctccgcggtggcggccgctctagaactagtggatcccccgggctgcaggaattcgtctcacccctagaaaactgcatctgattccattctggaagcaccccactccaatccactctcagacccgggtcccccaccgccgtctctcccgctccggtagatataatttgatgggaagatgaatggtgcagaggaggaggagccgcctcacgtcagcagcatgcccaagacgcaagacggtgttaccaagcccagtctagggaaagagcccatcccagggagcgagctctggacggatgggctcatctgtgcttttgagctggtcaagagtcacaggaagcctgttcagcacaaatcatggctgggcactgagcagatacaggagaagggccccactatgtgcacgagggagcactcaagaaggaatgggcaccagatcactgagccggaagtggatgagagcattgtgttggaaaacccccagcagactgatttcagtaacgattcttcagtgctcaaaggataggcattgtatgctggggagnattttggatcataaatgggtgccttattggatggaataggatcgccaagctggtcctggagggtttattcagactccagctggggaaaatgagtttatgggaaattattgaataccgaggatgattttccccggggggctgatctttgcgacctccatatgggggaggccccctggggggaacccaacttgggggggggtccagtgccccccccggggccaaccccttcaaaaaaaaaagcgccggggggtgaaaaaaaccccccccccccggggggggcgcccccccggcccccccacaaaattattctgcccgcgggaa

SEQ ID NO: 82456 - protein, 115 aa, Zea mays
  misc_feature: Ceres CLONE 1568263
MNGAEEEEPPHVSSMPKTQDGVTKPSLGKEPIPGSELWTDGLICAFELVKSHRKPVQHKSWLGTEQIQEKGPTMCTREHSRRNGHQITEPEVDESIVLENPQQTDFSNDSSVLKG

SEQ ID NO: 82457 - DNA, 815 bp, Zea mays
  misc_feature: Ceres CLONE 1568264
  misc_feature: Encodes the peptide sequence at SEQ ID NO. 82458
  misc_feature (353)..(353): n is a, c, t, g, unknown, or other
ctccccgcggtggcggccgctctagaactagtggatcccccgggctgcaggaattcgtctcacccctagaaaaactggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcanaggcgaagctgaaggtggcgatcaacggcttcggccgcatcggccggaacttcctccggtgctggcacggccgcgaggactcgccgatcgacgtcgtcgtcgtgaacgacagcggaagcgtcaggaacgcgtcccacctcctcaagtacgactcgatgctcggcaccttcaaggccgacgtcaagatcgtggacgaaacgaccatcagcgtcgacggaaagcccatcacggtcgtctccagcagggaaccgctcaagctcccatggggggaagctcggcattgaaaatcgccatcgaggggccccgaaatctttcgtcgaagggcccccgggcccgggaaaaaaaattccaggccgggggccgaaaaaagggaattattcacgggctccccgcccaaggggcgccaaaattcccgaacctttggtcggccggggggtaaacaaaggggggaacataccaccc

SEQ ID NO: 82458 - protein, 173 aa, Zea mays
  misc_feature: Ceres CLONE 1568264
  misc_feature (83)..(174): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (80)..(80): Xaa is any aa, unknown, or other
MATHAALAASRIPAGARLHSRAPASSRHGVQRLDFADFSGLRPGSCSVSAAAREASFSDVLGAQLVAKATGENAVRAPAXAKLKVAINGFGRIGRNFLRCWHGREDSPIDVVVVNDSGSVRNASHLLKYDSMLGTFKADVKIVDETTISVDGKPITVVSSREPLKLPWGEARH

SEQ ID NO: 82459 - DNA, 915 bp, Zea mays
  misc_feature: Ceres CLONE 1568265
  misc_feature: Encodes the peptide sequence at SEQ ID NO. 82460
  misc_feature (746)..(746): n is a, c, t, g, unknown, or other
  misc_feature (785)..(785): n is a, c, t, g, unknown, or other
ggccgctctagaactagtggatcccccgggctgcaggaattcgtctcacccctagaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaacggtggcaagaagtctagcagtagtcggtccatgatggatgaagctccccttggctacagcattgaggacgttcgacctgcccggaggcgccaaaaaatttccagtctgctggcttactccaactggcgcaaaggagcccatcccgaatatcccctttttgggcttcctcggttcctagtaagtttgagggatttcttttttcgggacaccttccgattcccttaccgaattccccccctggggccctggcctggctttttcctgtgaacgaagccggaccccggtttcccccccaggtctttggctccccccggaaaggcccctcgccgtcccttccgtagttgccaagggggtggtggtttcccgacctccacccgtgcccccaaaggggcgtgtttcccgtacttgntagaaggaggggaccccccgcggggcctccagttattgngagtttttaaaggggggtgttgaaaaggccccctgtgggatacacctttcccttgaggaccccctgggcgttttggggacccccggtggagccgggtttgcgctcgccccctcctggggtccaagaattg

SEQ ID NO: 82460 - protein, 92 aa, Zea mays
  misc_feature: Ceres CLONE 1568265
  misc_feature (1)..(51): Pfam Name: AdoMetDC_leader Pfam Description: S-adenosyl-l-methionine decarboxylase leader peptide
MESNGGKKSSSSRSMMDEAPLGYSIEDVRPARRRQKISSLLAYSNWRKGAHPEYPLFGLPRFLVSLRDFFFRDTFRFPYRIPPLGPWPGFFL

SEQ ID NO: 82461 - DNA, 805 bp, Zea mays
  misc_feature: Ceres CLONE 1568267
  misc_feature: Encodes the peptide sequence at SEQ ID NO. 82462
ctccccgcggtggcggccgctctagaactagtggatcccccgggctgcaggaattcgtctcacccctagaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcggggacggggccagcattgctcgccgctgaggggcgtcgttgacgccccggcgatacagacgaccaaaaagaagggtgttccacttcgggcagggcaagagcgagggcaaacagaccatgaaagaactgcttgggcggcaggggcgcgaacctggcggaaaaggcgagcatccggctgtccgtgcccgcagggttcacggtgtccaacggagcctggcagcagtacaaggagcccgggtgccccctccccccggggctctgggccaaaatcctcaaacgcctgcagggggggggaggattacatgggcgccaccctgggggatacgaaggcccggctcctgctctcggtccgctccggggcccccg

SEQ ID NO: 82462 - protein, 65 aa, Zea mays
  misc_feature: Ceres CLONE 1568267
  misc_feature: SWISSPROT Homolog: EC 2.7.9.1 Pyruvate, phosphate dikinase
MTASVSRAICVQKPGSKCTRDREATSFARRSVAAPRPPHAKAAGVIRSDSGAGTGPALLAAEGRR

SEQ ID NO: 82463 - DNA, 831 bp, Zea mays
  misc_feature: Ceres CLONE 1568272
  misc_feature: Encodes the peptide sequence at SEQ ID NO. 82464
ggagctccccgcggtggcggccgctctagaactagtggatcccccgggctgcaggaattcgtctcacccctagaaaaaatcggtgaggaaccacttgtcccgtcgtccactccactccaggtgccagcccctcctcctacttcactacttcttcaagagtccaatctgctccctgcgcatcctctattcctcttcccctcccactccccagctcctgccgccccgctccacgttccagaacatctgggggggtatcccactcgcatggtcaccccataaccccgcgagaaaccaccccaccgacgcacaggcagcaatggcggcgggcagcggcctggacctgtaccacgtcctcggagtggccaactgcgtggcgctgctgtacttcaccttcagcgaggtggacatccggcacatctcgctcacgtgcttgcccgtctcccggacgtccccctatcgagcggctgcagtggcggcaccattcatggagaggcgcggcgcgcacctgttcctggcctgccggtccttctacgtgaacggggggaactcctactggctcatggaccacgccgcggaaccgaggtccagggaccgcgtctcccgaatgttccggaccggcgccaagatggacctcaccgtgtggcggctccgggggcgttcaaggaggggctcctacaaacaacactccaggtcctccccccggggcatcttcaaaccaagggcgtcttttcaaggggggatgtggacccggggaggggtccccccaaaaggccctgggacgtggacccggggggttcggccggcctttgaaacccctgagaaccccctggg

SEQ ID NO: 82464 - protein, 171 aa, Zea mays
  misc_feature: Ceres CLONE 1568272
  misc_feature: SWISSPROT Homolog: EC 3.2.1.78 Mannan endo-1,4-beta-mannosidase
MAAGSGLDLYHVLGVANCVALLYFTFSEVDIRHISLTCLPVSRTSPYRAAAVAAPFMERRGAHLFLACRSFYVNGGNSYWLMDHAAEPRSRDRVSRMFRTGAKMDLTVWRLRGRSRRGSYKQHSRSSPRGIFKPRASFQGGMWTRGGVPPKGPGTWTRGVRPAFETPENPL

SEQ ID NO: 82465 - DNA, 803 bp, Zea mays
  misc_feature: Ceres CLONE 1568273
  misc_feature: Encodes the peptide sequence at SEQ ID NO. 82466
  misc_feature (616)..(616): n is a, c, t, g, unknown, or other
  misc_feature (623)..(623): n is a, c, t, g, unknown, or other
tccccgcggtggcggccgctctagaactagtggatcccccgggctgcaggaattcgtctcacccctagaaaaaagaggcgaccggccagcgccatatcccgcgccgccgccgccgccgccaacgcttaatgctagtgttcctccggcgaggcctcttgctcgtccggcagcccaccacccgcgtccttgccaaaccgtctctccgccctgcttgtctcttcgtccaccacttcgccgtcgacacgatgggtgagggttctgctgctggtaaggacgcgaaggggaaggggaaggggaaggggaagaccaaggccgccgccgcggattcggccctggtcgttcgcgacgactcctacctagaggcggtcactcagaagaagattcgcttcttcgaggagatccaggcaaggcaagccgtcgagcggctgaatatcggcggcgaagttatcaaggtaactttgcctgatggcgctatcaaggagggtaagaaatggataacaaccccaatggatattgctaaggagatatcaagtggatttgcagctagttgtttgatagctcaagtggacgaaacactctgggacatggggaagccactcgaaggtgattgtaattngcaaatngtcaagtttgataccaatgaaggtcgtgacaccttctggcactcaagtgctcatattcttgggagaatctattgagagagcatatggatgcaagctgtgtattgggccttgcacacaagaggggaaggtttctactatgatgcttactacaatgatcagaccttgaatgaggagcacttg

SEQ ID NO: 82466 - protein, 150 aa, Zea mays
  misc_feature: Ceres CLONE 1568273
  misc_feature (68)..(128): Pfam Name: TGS Pfam Description: TGS domain
  misc_feature: SWISSPROT Homolog: EC 6.1.1.3 Threonine--tRNA ligase
  misc_feature (124)..(124): Xaa is any aa, unknown, or other
  misc_feature (126)..(126): Xaa is any aa, unknown, or other
MGEGSAAGKDAKGKGKGKGKTKAAAADSALVVRDDSYLEAVTQKKIRFFEEIQARQAVERLNIGGEVIKVTLPDGAIKEGKKWITTPMDIAKEISSGFAASCLIAQVDETLWDMGKPLEGDCNXQXVKFDTNEGRDTFWHSSAHILGRIY

SEQ ID NO: 82467 - DNA, 854 bp, Zea mays
  misc_feature: Ceres CLONE 1568274
  misc_feature: Encodes the peptide sequence at SEQ ID NO. 82468
ctccccgcggtggcggccgctctagaactagtggatcccccgggctgcaggaattcgtctcacccctagaaaaaacgggccacggcaccatctccagactcccgaggggaccatcactgccgcctgcctttccttctccgacctgcaccgccgcctccatttcccgcccgccccactgccattgtgcgcccccggaatggcgtcacgcggaggagatccggtaaaccaactctagctgaagtgacgagtggcagcattgttcaaccgtgcggcttctgcttgactggaattgtgatggatccagaaaaacaaaatgaaatgagcttgatggacaagagacaactagtatacgaagttgcaagatggccgcaaggtgccgtggagattcttaagtgctggactcgaagggaacttcttgagcttatctgtgttgagctgggcaaagagaggaagtataccaatgtcccaaaagctaagatgatcgcttatctcttgaaattagtttcacgaaagagtggaaagaatgggcaaatcaaggatgataatgcaaatgttatgttattagagcaggataacaaagatgaaacccaaatgaaggaatctggaggaacaatcacgaccacctcaaaactgcaaacctctgacttcatcaataccgtagaagaggctcatgccctgttagttcagtgggtgtgcaaccaatgttggcattgcctagcccccacggaattggcaggaaaaaaattatttggaaaaccgttggctcttggcgggcattttccaaatatattgtgaatgaataaccaaaaaaccccctggccttgggtgggttgggttttgcaaggcctctgaat

SEQ ID NO: 82468 - protein, 166 aa, Zea mays
  misc_feature: Ceres CLONE 1568274
MDPEKQNEMSLMDKRQLVYEVARWPQGAVEILKCWTRRELLELICVELGKERKYTNVPKAKMIAYLLKLVSRKSGKNGQIKDDNANVMLLEQDNKDETQMKESGGTITTTSKLQTSDFINTVEEAHALLVQWVCNQCWHCLAPTELAGKKLFGKPLALGGHFPNIL

SEQ ID NO: 82469 - DNA, 929 bp, Zea mays
  misc_feature: Ceres CLONE 1568276
  misc_feature: Encodes the peptide sequence at SEQ ID NO. 82470
  misc_feature (827)..(827): n is a, c, t, g, unknown, or other
  misc_feature (857)..(857): n is a, c, t, g, unknown, or other
ctccccgcggtggcggccgctctagaactagtggatcccccgggctgcaggaattcgtctcacccctagaaaaaacccatcctcctgctcttacccgcgggagggaggtccatggcccgtgctggacgacctgtaccatgtcgatcgaggagtatgcatggagcctcctcttcacattcagcctagggcgtggctcatgcggcctgctcgcggcggcgcctatgctcccgctgtggccagcaccatcccgttctcggcgcggcagagatctggctcctagcgcttgcctccgtctcggtcatgtacctccccccgccgcgagacgacaaccacgccgcggtggcgtcgtcgactcggcgctgggaggaccgtccactgccgaacatgtccggagccagctgctgcgacagaacttagcggcccaagatttcccgcggctccaagcactggatcgggcttggcagcacgacctttgggcggatcaagcctggctcccggatgttagcggaaggggcaattccggcgcccccgttcctggggcccgcgggtaccacgtacccccgccgtggcgacctgattcgtgggacggaaggccaagggggggccccccggggccccccgggaagaatgagagaaaacttcctcggcctttcccccgggtgccctcgaatgtttaattaagccaacacccggggcggcggccccggagttgggacccaagaaatccgtgtgcgggggaccgatcccatttcccccttttccacggaaaatggttttttccccccaaaagggagaaaagactcccgcccctttctaatatttttttntaaaaggtgggcggtgggcccgctctcacnattagggggagggggaccctttgggcggttcccccgcgggggaggggaggtcgcccccgcaattatgggggg

SEQ ID NO: 82470 - protein, 179 aa, Zea mays
  misc_feature: Ceres CLONE 1568276
MSIEEYAWSLLFTFSLGRGSCGLLAAAPMLPLWPAPSRSRRGRDLAPSACLRLGHVPPPAARRQPRRGGVVDSALGGPSTAEHVRSQLLRQNLAAQDFPRLQALDRAWQHDLWADQAWLPDVSGRGNSGAPVPGARGYHVPPPWRPDSWDGRPRGGPPGPPGKNERKLPRPFPRVPSNV

SEQ ID NO: 82471 - DNA, 802 bp, Zea mays
  misc_feature: Ceres CLONE 1568277
  misc_feature: Encodes the peptide sequence at SEQ ID NO. 82472
  misc_feature (480)..(480): n is a, c, t, g, unknown, or other
  misc_feature (576)..(576): n is a, c, t, g, unknown, or other
tcaccgcggtggcggccgctctagaactagtggatcccccgggctgcaggaattcgtctcacccctagaaaaactcgcagctcttctccagctctcggaggcccgaggtttcatcgacccgcgctccttcatcctcgacacctcactccggcggcgcgggtccgcagtgctgcacatcgcgagccgcgcggcacagccgcacttgttgtccttcgtgcgtggggtgcggttcgacgcgggcggcgggatggcggcgagcgcgcgggacagcaccgatgcagcggagcgagttgtggatgaccacgacggctgggcgtcggacgccgagatggacgtggagatgggatgtggtggaaggcgagttccacgaccgcgatgccgaccggagggacggcggcgcggatggtgatgatgagtacttgctgctcactaggataagggacacatcagcagctgaagcaagggcaggaaaggatatancaggtataccatgggagaggatacacatagccaggcaagattaccgaaaagctaggtttggacagtataagaactatgaaaatttcccctcatcangagagctcatgggatagctgtgcaagcaagtggagaagagcagcaagtattatgaattttcagcacacactagatcagtgaagccatcaattctcccatttcagcttaggaatttggtatgggcaacatcgaagcatgatgtctattttatgtcaaattcacaggaagccactggtcatcattgtctcacaattatcagaggttcttgacttctctgggcatgtgg

SEQ ID NO: 82472 - protein, 105 aa, Zea mays
  misc_feature: Ceres CLONE 1568277
  misc_feature (69)..(69): Xaa is any aa, unknown, or other
  misc_feature (101)..(101): Xaa is any aa, unknown, or other
MQRSELWMTTTAGRRTPRWTWRWDVVEGEFHDRDADRRDGGADGDDEYLLLTRIRDTSAAEARAGKDIXGIPWERIHIARQDYRKARFGQYKNYENFPSSXELMG

SEQ ID NO: 82473 - DNA, 803 bp, Zea mays
  misc_feature: Ceres CLONE 1568279
  misc_feature: Encodes the peptide sequence at SEQ ID NO. 82474
  misc_feature (571)..(571): n is a, c, t, g, unknown, or other
  misc_feature (693)..(693): n is a, c, t, g, unknown, or other
tccccgcggtggcggccgctctagaactagtggatcccccgggctgcaggaattcgtctcacccctagaaaaatcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgcntacagccggccgacgagctcaaggtgtccagggcggagttcatcgacctggcgcgcaagtccggcaagttcgacgaggacagcctggcgttccagtcgcgtctgctggacaagtccggcatncgggacgagtcgtacatgcccccgctgcgtgttcgagcccaacggcagctgcgccaccatgaaagaagggccggcgccgagggcgtcccgggcatgttcgcggcgctgga

SEQ ID NO: 82474 - protein, 207 aa, Zea mays
  misc_feature: Ceres CLONE 1568279
  misc_feature (115)..(207): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (131)..(131): Xaa is any aa, unknown, or other
  misc_feature (171)..(171): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACXQPADELKVSRAEFIDLARKSGKFDEDSLAFQSRLLDKSGXRDESYMPPLRVRAQRQLRHHERRAGAEGVPGMFAAL

SEQ ID NO: 82475 - DNA, 652 bp, Zea mays
  misc_feature: Ceres CLONE 1568280
tccccgtggcggcgctctaactgtggatcccccgggctgcaggaattctctccccctagaaaaaactcgtacaaactacaaagagaagagacaagtgtatttattttattaatcattagtactatttgattagtatttattgaaaacagaagggcattgccgaattcctcacccccgggcgaacccaatggggaatcgggaagggttaaaaatcaccgggggcccggtttcctttggggttttggggcccccggccccccccggccccgaaagcggttccccccccccctttgccccgggaaaccaaggttaaaaggtttccggggggttggggggtttaaacccccccttttttgggggggggggggcccttttttttggggcccccccttttttacgccccaaaaaaattttaaaaaccctcccccccttggggggaaaaaaatcccccccccgggttaaaaaattccccccccggggggggcttttccctccgaaatattttttttttggggggccccccccccccccccttttaaaaaggggggggggcggccccttttttaaaaaaaaagaagtttttttcggccccctcttttttttctccccaaaaaaaaaacctcttttttttttttttggaaagaaaaaaaga

SEQ ID NO: 82476 - DNA, 792 bp, Zea mays
  misc_feature: Ceres CLONE 1568283
  misc_feature: Translation starting site: 181
  misc_feature: SWISSPROT Homolog: EC 6.2.1.3 Long-chain-fatty-acid--CoA ligase
  misc_feature (503)..(503): n is a, c, t, g, unknown, or other
  misc_feature (602)..(602): n is a, c, t, g, unknown, or other
  misc_feature (656)..(656): n is a, c, t, g, unknown, or other
  misc_feature (658)..(658): n is a, c, t, g, unknown, or other
  misc_feature (660)..(660): n is a, c, t, g, unknown, or other
  misc_feature (707)..(707): n is a, c, t, g, unknown, or other
tggagctccccgcggtggcggccgctctagaactagtggatcccccgggctgcaggaattcgtctcacccctagaaaaaatcgccagggcgtcggatcggagcgagctcattctcaactcgactcaagagctctgcctcctccatctccccttctctggcctccggagccacgctgagagatggaggcgaatcccaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcaggctctgcgttgcagaagctgggagtgcagccaggttcccngggtggggatctacggagcgaactgtcctcagtggatagtggcaatgcaggcttgcaatggctatagtctagtctgtgtcccactgtacgatactttangtgcgggagctgtcgactacatcatcgatcatgccgagatcgatgttgtcttcntncngggacagaaaataaaagagatactgtcccccaactgcaagtctgccnagagactgaaagcattggtggcggttcacttcggcgaacacctgacagaaacaagaagcggatcaaattgggatcaaaatgttgc

SEQ ID NO: 82477 - DNA, 822 bp, Zea mays
  misc_feature: Ceres CLONE 1568284
  misc_feature: Translation starting site: 143
  misc_feature: SWISSPROT Homolog: EC 3.4.23.12 Nepenthesin
  misc_feature (574)..(574): n is a, c, t, g, unknown, or other
caccgcggtggcggccgctctagaactagtggatcccccgggctgcaggaattcgtctcaccccctagaaaaatcggcgcgacgacctctcccccaggagagcctaccccctccctcattccccgcgcgacgaggccgcttaatggcgggtcgcggccggcctcggccgggctcgcaccaggctctcgtcgtcgccgccgtcatcctactcctggccgccgcgtccggggccggcgctggatcccccgatcggcccgcgccggggccgccgctgttcctcccgctcacgcgctcgtcccccaacgccagccggctcgccgcctcgctgcggcgcggcctcggcgacggggtccaccccaacgcgcgcatgcgcctccacgacgatctcctcaccaacggggtactacacgacgaggctgtacatcgggacgcccccgcaggagttcgcgctgatcgttgactccgggagcaccgtcacctacgtgccctgctcctcctgcgagcagtgtggcaccaccaggatccacgatttcaaccctgacctctccagttcatattcaccagtaaaatgcancgtttgattgtactttgtgacagtgacaaaaaacagtgcaccttatgaaaaggcagtatgctgaaatgagcctccagcagtgggggtgcttgggtgaagaacattgttgtcctttttggccaaagagagggaactttaaaccccccgccatgcctttttttttggcttgggaaaaattctaaaaactggaaaattttgtcccgctcaaccatcgctaattggtattaagggggggctggggccccggg

SEQ ID NO: 82478 - DNA, 838 bp, Zea mays
  misc_feature: Ceres CLONE 1568285
  misc_feature: Encodes the peptide sequence at SEQ ID NO. 82479
  misc_feature (838)..(838): n is a, c, t, g, unknown, or other
ctccccgcggtggcggccgctctagaactagtggatcccccgggctgcaggaattcgtctcacccctagaaaaactcgcaaacactggttcacgtccgtccacctctctacgcctttcctcttatcctcccgtctcgcgccgtcgcgcgtctcgggtctctcttctctctctcggctctcgcctccctcccggtccgggtcgcacgcaggtcgcagccagcagtgcatttttatgcgccgcgctggtggttttggggcgcggagtccatatccatggtcatggacgctggcctgcacgagccgtgcgcgctgctgccgggatccaagcgcgacagccacatgctagtctacccccaaatcgccgccgccgctaatgggttcacggcgcaggagctcgagtcgctgctgttcctgtcgtctgatgggattactttggctgcgggcagtggcggtggcggcggcggcggaagctatctgaatgtcgcgcctaccactgtggtcccgcccgccccgaccaaccgcgcgtcgccgccgaggtatgtgtccgccgcgccgccctcggtggggcagccggatgattcggaggcgttctcggacatcgtccctgggctacatcaaccggatggctatgggccgaaggacatccaacaaaaaatttcgaacactaacccggaacaacccccccggtgtgctcccccgccaaaaaaaccccttccccccaaaaatccccggccgaaggggggcccttcgaaactcccgggggggccaaccccccggttgggaaaaacccccgggggggggcaaacaaagtggtgggggagaaaaacctctttggccn

SEQ ID NO: 82479 - protein, 188 aa, Zea mays
  misc_feature: Ceres CLONE 1568285
MVMDAGLHEPCALLPGSKRDSHMLVYPQIAAAANGFTAQELESLLFLSSDGITLAAGSGGGGGGGSYLNVAPTTVVPPAPTNRASPPRYVSAAPPSVGQPDDSEAFSDIVPGLHQPDGYGPKDIQQKISNTNPEQPPRCAPPPKKPLPPKNPRPKGGPSKLPGGPTPRLGKTPGGGQTKWWGRKTSLA

SEQ ID NO: 82480 - DNA, 794 bp, Zea mays
  misc_feature: Ceres CLONE 1568286
  misc_feature: Encodes the peptide sequence at SEQ ID NO. 82481
  misc_feature (513)..(513): n is a, c, t, g, unknown, or other
  misc_feature (568)..(568): n is a, c, t, g, unknown, or other
  misc_feature (571)..(571): n is a, c, t, g, unknown, or other
  misc_feature (574)..(574): n is a, c, t, g, unknown, or other
ctccccgcggtggcggccgctctagaactagtggatcccccgggctgcaggaattcgtctcacccctagaaaaagcaaaaacttgcttccttcgacggccgcatcagtcttccacgtacgtcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtctgtggtggcggagctggagggtgcgctgcttcggagcgcggacacgctcccgtacttcatgctcgtggcgttcgaggcgtccgggctgccgcgcttcgcgctgctgctggcgctgtgcccgctgctgcggctgctagagctggcgggccgtcgcggcctggcgctgcgcgccgccgcgttcgtggccaccgcgggggtgacacgcgccgagctggaggccgtgtcccgcgccgtgctgcccaagttcatggncgacgacgtcgaccccgcggcctggcggccttcgggagctgcgagggggagcccntcntcntcacgcggatgccccgcgtcatggtcgagcgcttcgcaaggagcaccctcgcgcgcacgccgtggtcggctctgacctcgagtacagcgggctcaggcgctccacgggggctcctcaaaggggcctgcccacaagacgtcgcccagccgtggtccggcggctgttcgccggcgaagaactggccggaccttccgaaatcgccggttcaaagatgggccca

SEQ ID NO: 82481 - protein, 143 aa, Zea mays
  misc_feature: Ceres CLONE 1568286
  misc_feature: SWISSPROT Homolog: EC 2.3.1.15 Glycerol-3-phosphate O-acyltransferase
  misc_feature (99)..(99): Xaa is any aa, unknown, or other
MTPASQAAPPRARRSVVAELEGALLRSADTLPYFMLVAFEASGLPRFALLLALCPLLRLLELAGRRGLALRAAAFVATAGVTRAELEAVSRAVLPKFMXDDVDPAAWRPSGAARGSPSSSRGCPASWSSASQGAPSRARRGRL

SEQ ID NO: 82482 - DNA, 846 bp, Zea mays
  misc_feature: Ceres CLONE 1568287
  misc_feature: Encodes the peptide sequence at SEQ ID NO. 82483
ggagctccccgcggtggcggccgctctagaactagtggatcccccgggctgcaggaattcgtctcacccctagaaaaacttttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgctcctcccagcaccagcatgagacacaatcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagacagagatcgcgatcgccaccacagggaccatcgagagcgcagcgagaaaagggaacaccgtgatcgttctgatgatcgtgaccgtcaccgtgatggtcgtgaccgccaccgtgatgatcgtgattctgagaggagaagagatcgtgacagagatggtcatcgtaggcatcgctcccgctccccttctaagagtcgtgaccgtgaccgcagatctagatctcgttcacgctctcgatcaaagagcaggcgcgtggagtggttttgaccaagcacctccccaacatgcaacttcctattgttggctgctggtgctatccccgggtcaggcttcctggtatcactgctcctaattcccgggggttgggggtgcttccaacctggtataaatttggtggcgggaaggtccaccccccttggttatcacgccccagt

SEQ ID NO: 82483 - protein, 188 aa, Zea mays
  misc_feature: Ceres CLONE 1568287
MSEYDERYQGNADMPAPPSTSMRHNHMTVVPRNLEKGTENAIRARIGSVTGIVAEKRGGTETGIRIVKEVTETEIAIATTGTIESAARKGNTVIVLMIVTVTVMVVTATVMIVILRGEEIVTEMVIVGIAPAPLLRVVTVTADLDLVHALDQRAGAWSGFDQAPPQHATSYCWLLVLSPGQASWYHCS

SEQ ID NO: 82484 - DNA, 848 bp, Zea mays
  misc_feature: Ceres CLONE 1568290
  misc_feature: Encodes the peptide sequence at SEQ ID NO. 82485
ccccgcggtggcggccgctctagaactagtggatcccccgggctgcaggaattcgtctcacccctagttatgtccgccttcgtcccgcacgcttgccgtccaaccgctcccacaggtcgaggcggggagggggaggaggatgactagcttctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactaccttgcgagagaataggcgtggttttgatgttataataagtgatgtccacatgccggatatggacggattcaggctacttgaacttgtaggccttgagatggaccttccagttatcatgatgtctgctgattcaagaaccggattttgtaattaaacggaattaaacattggagcatggtgactttttttataaaaacttgtcagaatgggagggactgaaataacatcttgggctacatgtttttttaggaaaaaatttttatgtaaaacaagggaccatggagcatttctggttagcctttgattgaacccgatttttaacctaaccacccaattattgataattgaaatcccctttcctcccccaaattaatggaagttaatgggcaccttggtaaattttctggttgttgaaatggaggggaaaggaggatgtttggacctttacctcga

SEQ ID NO: 82485 - protein, 103 aa, Zea mays
  misc_feature: Ceres CLONE 1568290
  misc_feature (15)..(98): Pfam Name: Response_reg Pfam Description: Response regulator receiver domain
  misc_feature: SWISSPROT Homolog: EC 2.7.13.3 Histidine kinase
MAAAEARGGEFPVGMKVLVVDDDPTCLVVLKRMLLECRYDVTTCPQATRALTTLRENRRGFDVIISDVHMPDMDGFRLLELVGLEMDLPVIMMSADSRTGFCN

SEQ ID NO: 82486 - DNA, 847 bp, Zea mays
  misc_feature: Ceres CLONE 1568291
  misc_feature: Encodes the peptide sequence at SEQ ID NO. 82487
ctccccgcggtggcggccgctctagaactagtggatcccccgggctgcaggaattcgtctcacccctagaaaaaaaaatccatatgctcagctcccgcctcctcccatccccggaccccggaccccggccatgggcgcttgcttctcctccgcctctgccgcccccgccggcgccgccgtcgacgagcgccgcccgtccaaggagggcgacggcaagaagaggcgccgcgccgccggggcatcgccggatgccgcggcgcccgtgcgcgtggagttcggctacgagagggacttcgaggcgcgctacgaggtcggccgcctgctcggccacggccagttcggctacaccttcgccgccaccgaccgcggctctggggaccgcgttgccgtcaagcgcatcgacaagggcaagatgacccgccctgttgctgtggaggatgtgaaaagagaagtgaagattcttaaagcacttaaaggacatcagaatattgttcacttctacaatgcatttgaggatgattcatacgtgtacattgggatggagctatgtgagggcggtgaactattagatcggattttggcaaaaaagatacccccctatgtgaaaaaggatcctgcaatggtaatccccccaaatgccccaaataactggctgaatgccctcctgcctgggggttattccccgaaatatgaaaccctggaaacttcctttttcaattcgaacagggggaattccccccttaaaggggcaagaattttgggttgtgccaattttccttaaccccggggaaaaaaattcccctaacattttttggagaagtgctttctattgttccgccccaaaaag

SEQ ID NO: 82487 - protein, 216 aa, Zea mays
  misc_feature: Ceres CLONE 1568291
  misc_feature (59)..(210): Pfam Name: Pkinase_Tyr Pfam Description: Protein tyrosine kinase
  misc_feature: SWISSPROT Homolog: EC 2.7.11.1 Non-specific serine/threonine protein kinase
MGACFSSASAAPAGAAVDERRPSKEGDGKKRRRAAGASPDAAAPVRVEFGYERDFEARYEVGRLLGHGQFGYTFAATDRGSGDRVAVKRIDKGKMTRPVAVEDVKREVKILKALKGHQNIVHFYNAFEDDSYVYIGMELCEGGELLDRILAKKIPPYVKKDPAMVIPPNAPNNWLNALLPGGYSPKYETLETSFFNSNRGNSPLKGARILGCANFP

SEQ ID NO: 82488 - DNA, 797 bp, Zea mays
  misc_feature: Ceres CLONE 1568294
  misc_feature: Encodes the peptide sequence at SEQ ID NO. 82489
  misc_feature (668)..(668): n is a, c, t, g, unknown, or other
  misc_feature (670)..(670): n is a, c, t, g, unknown, or other
  misc_feature (675)..(675): n is a, c, t, g, unknown, or other
  misc_feature (694)..(694): n is a, c, t, g, unknown, or other
  misc_feature (697)..(697): n is a, c, t, g, unknown, or other
  misc_feature (703)..(703): n is a, c, t, g, unknown, or other
  misc_feature (704)..(704): n is a, c, t, g, unknown, or other
  misc_feature (778)..(778): n is a, c, t, g, unknown, or other
ggagctcaccgcggtggcggccgctctagaactagtggatcccccgggctgcaggaattcgtctcacccctagaaaaaagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactccacggacgtggccttcgcgccgtacggcgagtactggcgcacggcgcggaaggtgggtcacacgcacctgctcagcgccaagatgggtctctcaancngcggnagcgggaagaagaagtgcnccntggtgnntggcgcgatccgcgacgctgccgaggcgtccccggggacggcgctcgacatgacggagctgctggggggctacncaagcgacttcgtggtgcc

SEQ ID NO: 82489 - protein, 212 aa, Zea mays
  misc_feature: Ceres CLONE 1568294
  misc_feature: SWISSPROT Homolog: EC 1.14.13.68 4-hydroxyphenylacetaldehyde oxime monooxygenase
  misc_feature (170)..(170): Xaa is any aa, unknown, or other
  misc_feature (171)..(171): Xaa is any aa, unknown, or other
  misc_feature (179)..(179): Xaa is any aa, unknown, or other
  misc_feature (180)..(180): Xaa is any aa, unknown, or other
  misc_feature (182)..(182): Xaa is any aa, unknown, or other
  misc_feature (207)..(207): Xaa is any aa, unknown, or other
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVGHTHLLSAKMGLSXXGSGKKKCXXVXGAIRDAAEASPGTALDMTELLGGYXSDFVV

SEQ ID NO: 82490 - DNA, 840 bp, Zea mays
  misc_feature: Ceres CLONE 1568297
  misc_feature: Encodes the peptide sequence at SEQ ID NO. 82491
ctccccgcggtggcggccgctctagaactagtggatcccccgggctgcaggaattcgtctcacccctagaaaaagtgtccgatggctcgcccccgccgcctcctctgacggtctgactgacccccgcctccccggagagcggctccgctgtctcgccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccagcggcaacggaggctaggcggcggccgaggcgggcgctctcgacgcggcgggtggcgacagcggcgctcgtgctgggcgcgctcgcggtcgccgcctactactgcttctactcggacgtggtcgtgctgttcctgcggatggagcatgacgaggagctgaggaacgagaccaggtctttcctgctgccgctctaccccaaggcgcgtcagggccgcgccctgcgcgagttcggggacgtcgagctcgccttcaggagggtagacgacggccgatgaaaggctaggaactggatggaggtcgcgaaggcggccacggcgatgaccaattcgacggcgttgctcccgatcaaagctcatgtccttccccgatggccagtatgacacatcctatcctttatggccaaccctccggaccataactttcttgatgttcgaaccgggaagccacttgacggtgcatccaagggggatgcaccatgggacaaacggcggaaag

SEQ ID NO: 82491 - protein, 152 aa, Zea mays
  misc_feature: Ceres CLONE 1568297
MAPPRPPPNPAGEQQPQLHGVVIITLPPADQPSKGKTVTAFAYTNDPPPPRSPPDPVMGYPAATEARRRPRRALSTRRVATAALVLGALAVAAYYCFYSDVVVLFLRMEHDEELRNETRSFLLPLYPKARQGRALREFGDVELAFRRVDDGR

SEQ ID NO: 82492 - DNA, 851 bp, Zea mays
  misc_feature: Ceres CLONE 1568298
  misc_feature: Encodes the peptide sequence at SEQ ID NO. 82493
  misc_feature (563)..(563): n is a, c, t, g, unknown, or other
ggagctccccgcggtggcggccgctctagaactagtggatcccccgggctgcaggaattcgtctcacccctagaaaaaaccccgccttccgcttcccacccgccccgcctgtctccacgcgccgccgccgcctccggatcgcggcctccctcctgccctgcagcgaagctttgcgcgctcggctcggcccggcccggcccatgccccgccgtgggtgaccagcgcctccacgtccggccatgggctgcgtgcacggccgccccgccacctccagccccgcgcccgccgccacctcctccagccgccgggaccatcccacggcctcccagacgcacaaggacggggtcgattccgccgccgccgcacctccggtggacgccgaggcgccggagcagcaggcggccgagaagccccagaaggtcaagcgggagcggcggtcgcggtcgtcgcgctccgccgccttcgcggcgcacaccgaggtgcgcctgggcgggagcttcgccaacaaggcgcgcggcgagcaagtcgccgccggctggcccgcttggctctccgctgtcgcnggcgaggccatcgaaggatggaccccgcgccgcgccgactccttcgagaagatcgacaagatcggcccagggcacgtacagcaatgtgtaacaagcgccgagactcgctgagcggcaagatcgtgggcgctcagaaaggggcgctttcaacaacccggaggccggagaagcgggcgggttactgggcgcgggaaaaatcttattctggggcccgcttcgaaccaccccaatggtcgtcaaagcttggagggggtttcgtaacccccccgaatggttccgggaggcctt

SEQ ID NO: 82493 - protein, 144 aa, Zea mays
  misc_feature: Ceres CLONE 1568298
MGCVHGRPATSSPAPAATSSSRRDHPTASQTHKDGVDSAAAAPPVDAEAPEQQAAEKPQKVKRERRSRSSRSAAFAAHTEVRLGGSFANKARGEQVAAGWPAWLSAVAGEAIEGWTPRRADSFEKIDKIGPGHVQQCVTSAETR

SEQ ID NO: 82494 - DNA, 833 bp, Zea mays
  misc_feature: Ceres CLONE 1568300
  misc_feature: Encodes the peptide sequence at SEQ ID NO. 82495
  misc_feature (592)..(592): n is a, c, t, g, unknown, or other
ctccccgcggtggcggccgctctagaactagtggatcccccgggctgcaggaattcgtctcacccctagaaaaattataacaatggcgaggcatttatggtggggcccagccttttagctcaaggaatatacgaagagggccagaaatcagtgtcggtctaccttcctgggaaggagtcatggtatgacttgagaaatggatctccatacaagggaagcgcgacacacaagctacaggttttagaagatagcattcccagcttccaaagggctggtacaattgtgccaagaaaggacagattcagacgcagttctactcagatggtgaatgatccatacactctggtgatagcactcaatagctcaggtgctggagaaggcgaactttatgtggatgacgggaaaagttatgagtaccagcaaggggcattcatccatcgccgatttgtctttgcagacaataagctaacttcattcaatattgggcctgacgatttgggcaagaaatttagaagtgattgcgtgattgaaagattataatcctcgggttacgatccggagtgaagaagctattattgagcctggaaatcangaactagaaattgatcagggcaatttagtttagggagtgtttcagcccagttgcgccaacaatccggaggcccaattgttgcattgcagacagttggactataaggatagcataaaagatgtatcggctatatgctgtcaaagacagaaaggaatccgttgtcttttcggcatttaggggttcccggattattggtgaaagcgaaatgagggggagtggaggacaaataactgatggggag

SEQ ID NO: 82495 - protein, 147 aa, Zea mays
  misc_feature: Ceres CLONE 1568300
  misc_feature: SWISSPROT Homolog: EC 3.2.1.84 Glucan 1,3-alpha-glucosidase
MVGPSLLAQGIYEEGQKSVSVYLPGKESWYDLRNGSPYKGSATHKLQVLEDSIPSFQRAGTIVPRKDRFRRSSTQMVNDPYTLVIALNSSGAGEGELYVDDGKSYEYQQGAFIHRRFVFADNKLTSFNIGPDDLGKKFRSDCVIERL

SEQ ID NO: 82496 - DNA, 610 bp, Zea mays
  misc_feature: Ceres CLONE 1568306
ctcccgcggtggcggccgctcagaacagtggacccccgggctgaggaattcgtctcacccctagaactgattcgagctcattgttcttcactccaaaaaaaaagctgacaccagacgcgccagggtttcaggcttccacaaatctccccgccgccctcaattcccctcggcgccgccgcctcctcccctcgcttcggtcctcggttagttaaccatccagttctgtcaagatgtctgaatagcgatgagaactgacaggaaacattgggagattttggaaaaatttaagaaaacttattcaaagccctttggaaattccccccgaaaggggcaatgggggaccaaagcccctgaaaacccccccgggaaaaaaaaggccccccccccccggggaaaacccccgggtttcttccccccaaaggggggcgcccaaaaaaaaatttttttggggggggaaaaaaaaaaaaaaatggggggggggacccccccccccccttttacctgtaaaaaaaaaaccccctctcccccagggggggggggggggcgaccgcgccttttttttttataaaaaagcgggggggcggcgccccaaaaaataaaaatctttcgg

SEQ ID NO: 82497 - DNA, 864 bp, Zea mays
  misc_feature: Ceres CLONE 1568309
  misc_feature: Encodes the peptide sequence at SEQ ID NO. 82498
ctccccgcggtggcggccgctctagaactagtggatcccccgggctgcaggaattcgtctcacccctagaaaaaccccttcccctcctcacctcaccaccatctccagctccatccgcaccaacatctccaccaaccgacacggcgaggagatgaacgcgtcgcagttcatggacaagcagatcctcggcctcgccgcctccgcctccccgtccggcggcggcgcggggggcggtgggggtgtggatctcagcgatctgatgatcccgatcccccaggaggacggcgaggaccgtctccgtcgccggcgtagcagtagcagcgtcaacggcacatcagacgacatgctacccagctacgatttccagccgatccgcaccggcggcgccaccgccgccgcccccgtgtctcaggcctcgtggggatcgctcgactccaaggcaccctccgcctctgcctctgcctccgccgccgcctcatacaacctcaagagtgctggtatattggagccacatgtgctgaagaaagttagtcatgaggaagaacagagtaacttccctacagttactattgccgatattgatccgaccctggagaaggcctctggaaaactttttgcaggccccggaaggtggaagtttcaaggctttcccgaagggggggccgaaacccccccacttgaaacccttgggtggaggagtggaaattaacaattgggagaaatttaaggggggcccctgaggggaaaaacccggggccccttggaaaacaggtctcgaaaagggcccaacggcgggggggcgctattttttcaaaaaaccggggggaattatttgtggggggcccacctccccccttgtgaaaa

SEQ ID NO: 82498 - protein, 185 aa, Zea mays
  misc_feature: Ceres CLONE 1568309
MNASQFMDKQILGLAASASPSGGGAGGGGGVDLSDLMIPIPQEDGEDRLRRRRSSSSVNGTSDDMLPSYDFQPIRTGGATAAAPVSQASWGSLDSKAPSASASASAAASYNLKSAGILEPHVLKKVSHEEEQSNFPTVTIADIDPTLEKASGKLFAGPGRWKFQGFPEGGAETPPLETLGWRSGN

SEQ ID NO: 82499 - DNA, 907 bp, Zea mays
  misc_feature: Ceres CLONE 1568310
  misc_feature: Encodes the peptide sequence at SEQ ID NO. 82500
  misc_feature (715)..(715): n is a, c, t, g, unknown, or other
ctccccgcggtggcggccgctctagaactagtggatcccccgggctgcaggaattcgtctcacccctagaaaaagtcaccgcccccctcctcgccgtccactggtgccgagccggcgcgggtggagatccgttcgctttggatcgacttcttcgtgtttgggttgaagccgctcgatttgctcaccagaaattcagattttcgagtggaattcgcttaatatagcaatgcactagggtttactgtgcaccactaggctactgcctctgctattaggaagccgacatctgttgtttccgaagtctttcaagtctctgttgggtggcgttgctattgtgggtgtgataacatgataaagcaatttcttggacgtctccccaagaagccatccaaatctggagataaggatcctattggccggcccagcccctcggtgtcgcaccagccattgggtccgagagctggagacagggccacccacttgagtagccatccaccggttatctccagctctgggctcagttatgggagtggcatgcatgtcgggcaatgcatacacgaaggcacacgtggacgggtgattcggccgcttcagcattttcggtcgttgccgagctttcaggacgtgcccaacacagaggaaaccggaacttggtttaatgaggaagtttgaacttggggcttgcgcccaaatttggactttccccggttcccancaaagaaaccttaaggggaggaagggagataaaagggggccaaaacctttggggggggagccttctgtttaaccttatttttggccctcgcggccccggtgggggaaaaaattttcctgggaagggccaagctcttttgccaagaaaatatctcccccaaaaaagtgggtgttttctctggccaaaaacccc

SEQ ID NO: 82500 - protein, 107 aa, Zea mays
  misc_feature: Ceres CLONE 1568310
MIKQFLGRLPKKPSKSGDKDPIGRPSPSVSHQPLGPRAGDRATHLSSHPPVISSSGLSYGSGMHVGQCIHEGTRGRVIRPLQHFRSLPSFQDVPNTEETGTWFNEEV

SEQ ID NO: 82501 - DNA, 871 bp, Zea mays
  misc_feature: Ceres CLONE 1568314
  misc_feature: Translation starting site: 113
ctccccgcggtggcggccgctctagaactagtggatcccccgggctgcaggaattcgtctcacccctagaaaaaaaagccgtcgaccagagcactcccccgtcgtcgccacgatgtcgtctgagcctccacccgcctcctctgccgccgccggagaggaactcgctgctgacctttccgccgctaccctcagcaagaagcagcagaagaaggacgcgaggaaggcggagaaggcagagcagcgccagcgtcagcagcagcagcagcagcagccggcggacgccgaggacccgttcgcggccaactacggcgaggtccccgtcgaggagatccagtcaaaggccatctccggccgctcgtgtgtcccatgtcggctacgtctacgactccgctgcgggccgctccgtgcttatccgcggagccgcgcaggccatccgtccggtcagcaagaagatgggtttcgtcgtgctgcgccagagtatgagcaccgttgcagtgcggtgctccgtccccagcgccgacgccggcgtcagcacgcagaagggggcgcttcccccaccgcccttcagaaaggagtccatccgtccaacgtttgaggggcgtccgtctcccctcccaaagggagccccctcaagggcccccacacaggcaggggggagatcccaaggggaaggaagatctatttggcatcaataggggcatttcccaacccgttccaattaaaccttggaaaagcccggccccgaagggagggctggatttttgaaaaagggcggaatttggctggaaaaaaaagcttggtctcccgttgggcccaaagaacccgcctgtggacctacgggggctatttgttcttagaaacaccccccaaa

SEQ ID NO: 82502 - DNA, 834 bp, Zea mays
  misc_feature: Ceres CLONE 1568315
  misc_feature: Encodes the peptide sequence at SEQ ID NO. 82503
  misc_feature (699)..(699): n is a, c, t, g, unknown, or other
  misc_feature (720)..(720): n is a, c, t, g, unknown, or other
  misc_feature (721)..(721): n is a, c, t, g, unknown, or other
  misc_feature (831)..(831): n is a, c, t, g, unknown, or other
tccccgcggtggcggccgctctagaactagtggatcccccgggctgcaggaattcgtctcacccctagaaaaagttatcgcagggggcattaagctgcctgcctccgctgccggccgtgctacctaatcgccgcgcttgttttcccaccgcccgatggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgaggttatggccacaaagactaagatctacttcgtcatggagctcgtccgcggcggcgagctcttctcccgcgtctccaagggccgactcagggaggacaccgcgcgccgctacttccagcagctcgtctccgccgtggggttctgccacgcccgcggcgtctttcaccgcgacctgaagcccgagaatctactcgtcgacgagcaggggaacctcanggtatcgggattttgggctcnntcgcgtcgccgaagcagtcccgtcccgacggcctgctcccacactttctgggcacgccgggctatggtggcccccgaagtgctcgggccgccgcgggtacgacggcgccnagg

SEQ ID NO: 82503 - protein, 225 aa, Zea mays
  misc_feature: Ceres CLONE 1568315
  misc_feature (45)..(222): Pfam Name: Pkinase Pfam Description: Protein kinase domain
  misc_feature: SWISSPROT Homolog: EC 2.7.11.1 Non-specific serine/threonine protein kinase
  misc_feature (182)..(182): Xaa is any aa, unknown, or other
  misc_feature (189)..(189): Xaa is any aa, unknown, or other
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLXVSGFWAXSRRRSSPVPTACSHTFWARRAMVAPEVLGPPRVRRR

SEQ ID NO: 82504 - DNA, 794 bp, Zea mays
  misc_feature: Ceres CLONE 1568316
  misc_feature: Encodes the peptide sequence at SEQ ID NO. 82505
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaacctcatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctgggctcaatgtgctgcgtatcatcaatgagccaaccgctgctgctattgcctatggtcttgacaagaagcaaccagcgtcggtgagaaagatgtcctcat

SEQ ID NO: 82505 - protein, 202 aa, Zea mays
  misc_feature: Ceres CLONE 1568316
  misc_feature (9)..(202): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNLINTVFDAKRLIGRRFSDASVQSDIKLWPFKVIPGPGEKPMIVVQHKGEEKQFAAEEISSMVLIKMREIAEAYLGSTIKNAVVTVPAYFNDSQRQATKDAGVIAGLNVLRIINEPTAAAIAYGLDKKQPASVRKMSS

SEQ ID NO: 82506 - DNA, 828 bp, Zea mays
  misc_feature: Ceres CLONE 1568320
  misc_feature: Encodes the peptide sequence at SEQ ID NO. 82507
ctccccgcggtggcggccgctctagaactagtggatcccccgggctgcaggaattcgtctcacccctagaaaaactccttcctttcagtcagccagccagccatggagacggcctccttcctttcagtggcgctggccctggcggccctcgtccccgtctcgctgctccttgtgaaccggctcctctacggcaagctgcccccggggccgcggcggcggcccgtggtgggcaacctgttcgacgtgcagcccgtgcggtgccggtgctaccaggagtgggcgcgccggtacgggcccatcatgacggtgtggctgggcacgtcgcccacggtggtggtatccacgtcggagctggccaaggaggtgctcaagacccacgaccagcagctcgccgaccgctgccgggaccgctccaccgagagcttcagccgcggcggccaggacctcatctgggccgactacggcccccactacatcaaggtgcgcaagctctgcaacctcgagctcttcacgcagcgccgcctcgaggcgctcaggcccatccgcgaggacgaggtcaccgcccatggtcgagtccgtctacaaggccgtccacgcggcctggcagtgcagggaaagcgttggtggtaaaagaccacctctcgatgggtgggcttcaaacaacataacgccggctgggcctctggaaaacgggttccttggacccggccgggccaaacttggaccaacaaggcgccaagtttcaaggggaatcgtccccaaacgggatttaagaacgggggggttccttcttccattgggccaaaaaaagaacgggggctggccctg

SEQ ID NO: 82507 - protein, 175 aa, Zea mays
  misc_feature: Ceres CLONE 1568320
  misc_feature: SWISSPROT Homolog: EC 1.14.13.68 4-hydroxyphenylacetaldehyde oxime monooxygenase
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAHGRVRLQGRPRGLAVQGKRWW

SEQ ID NO: 82508 - DNA, 839 bp, Zea mays
  misc_feature: Ceres CLONE 1568324
  misc_feature: Translation starting site: 157
  misc_feature: SWISSPROT Homolog: EC 2.3.1.15 Glycerol-3-phosphate O-acyltransferase
  misc_feature (503)..(503): n is a, c, t, g, unknown, or other
  misc_feature (657)..(657): n is a, c, t, g, unknown, or other
ggagctccccgcggtggcggccgctctagaactagtggatcccccgggctgcaggaattcgtctcacccctagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccagttctacgcgggcgacgtgcacccggagagctggagggtngtcagctccttcggcaggcgctacgtcgtcacggccagccccagggtcatggtcgagcccttcgccagggcctttctaggcgccgacaaggtcctcggggaccaagctggaggtcggcagggacggcaaggccacgggcttcatggccaggccnaggcgtgctcgtcggcgaccaccaaaaagaaggccgtcgtcaaggagctcggcgaccccctgcccacgtcggcattgggggataaggagaccactttcgacttctgtccatctggcaggaggcctacctggtgacctcaagaaattaagcccggggtgccaggaacaactgctgagcccgcc

SEQ ID NO: 82509 - DNA, 1015 bp, Zea mays
  misc_feature: Ceres CLONE 1568325
  misc_feature: Encodes the peptide sequence at SEQ ID NO. 82510
  misc_feature (343)..(343): n is a, c, t, g, unknown, or other
  misc_feature (347)..(347): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (378)..(378): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (391)..(391): n is a, c, t, g, unknown, or other
  misc_feature (412)..(412): n is a, c, t, g, unknown, or other
  misc_feature (552)..(552): n is a, c, t, g, unknown, or other
  misc_feature (553)..(553): n is a, c, t, g, unknown, or other
  misc_feature (802)..(802): n is a, c, t, g, unknown, or other
  misc_feature (838)..(838): n is a, c, t, g, unknown, or other
  misc_feature (891)..(891): n is a, c, t, g, unknown, or other
  misc_feature (970)..(970): n is a, c, t, g, unknown, or other
ctccccgcggtggcggccgctctagaactagtggatcccccgggctgcaggaattcgtctcacccctagaaaaacactcctcctgtcctcccttcctcgcttcccaatctccaaacctctcacttgcacgggacgggagcacgtacacgcggagccaaagcgatcggcgctgcggcggcaagacgtcgtcgtcggcgacgatgacgtggcacgaggacctggccactcacgtggggaacacgggcgttcgcctccccggcgccggaggtcacgcgccggcggcggcgaatgttgctgcggcggggccgggtggtacggggaggaggaagagggagggcgggangaangggtnnnnnnnnnnngggggggggggnnngnggagnnnnnnggngggagaacgccccccccggcnagggccggggggccggggggacccccccccgccgcagaagccccggccgggcggcccaaggacaggcgaagggggcgcgccggccggcccccgggaaagccgggcgggcgggcaaacggggggaaagcgccccccaggcnnccaagggaaccgaggaccccgccccgagaagaagccgccgaaccccggggggaagggggggggggcgccaaccggggcggccgccaaaggccggaaccaccggacccggcccccccgaagggaccagcgggggcgggggggagggggggaacgcgaaaacccccccgaggagaggccccgcccaaaaagaaaaacctaaaacgagcggcggcccccacccgaggggggagagagagaaaacccaaaccngccccgcggaagggagacggggcaccccggggccgnacaccaagggacacaggcgggaggcccccggccgagcgcggagacgaaggggncgggcaccgcgggaggaaacccccccacagcgcgcgggccgcgcacaacagaggagggcagcaacgggaaaccccccgnggaagaaagaggggcgaccccgccgcgcggagcagaaaaaagccg

SEQ ID NO: 82510 - protein, 183 aa, Zea mays
  misc_feature: Ceres CLONE 1568325
  misc_feature (48)..(48): Xaa is any aa, unknown, or other
  misc_feature (49)..(49): Xaa is any aa, unknown, or other
  misc_feature (51)..(51): Xaa is any aa, unknown, or other
  misc_feature (52)..(52): Xaa is any aa, unknown, or other
  misc_feature (53)..(53): Xaa is any aa, unknown, or other
  misc_feature (54)..(54): Xaa is any aa, unknown, or other
  misc_feature (59)..(59): Xaa is any aa, unknown, or other
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (63)..(63): Xaa is any aa, unknown, or other
  misc_feature (64)..(64): Xaa is any aa, unknown, or other
  misc_feature (71)..(71): Xaa is any aa, unknown, or other
  misc_feature (118)..(118): Xaa is any aa, unknown, or other
MTWHEDLATHVGNTGVRLPGAGGHAPAAANVAAAGPGGTGRRKREGGXXGXXXXGGGGXXXXXXGERPPRXGPGGRGDPPPPQKPRPGGPRTGEGGAPAGPRESRAGGQTGGKRPPGXQGNRGPRPEKKPPNPGGKGGGAPTGAAAKGRNHRTRPPRRDQRGRGGGGERENPPEERPRPKRKT

SEQ ID NO: 82511 - DNA, 1169 bp, Zea mays
  misc_feature: Ceres CLONE 1568326
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (862)..(862): n is a, c, t, g, unknown, or other
  misc_feature (1104)..(1104): n is a, c, t, g, unknown, or other
gagtgttttttttttgttttgaggggggtgtttgtgtttattttttttcatccgccgcagnnngggtnttttttaaaagctggaactccccgcggtggcggccgctctagaactagtggatcccccgggctgcaggaattcgtctcacccctagaaaaactcccacccacgaagtacggaaggctgccggaaggagctctcacctcacatccatctctgtcgcgcccgtcatcctcctcctcctcccctcctcaactgctatcggatttgcgctgcagtggagatcgacccgggctgggaatttctttcgttggtaaggaaccctaatttggtcggatgggattttcatcttcgacgaagcccgcgagattgatcgaccttagctgacgcgagggattggaaagcgaacgctcgggcgtagttaattttctaggaagattggggtttcagctcaaacccccatgctcgatgctgaggacgaccctggcgggagatgacgaggatcttcgtgcagcgcgggaaccgccggctcctcttccagcttccggccgcttcgggctccgcaatcaagcgcaacaagcccggcagcagcttgccccggggaggaagttgcccgtttgccaaccttccaggccaacaagctaaccaggaacctaattggggcttataaggaatggaatgtaaaccgtgaacgccatttttaatattggagggtggccaaacgtaagaaaaccaacccggctggagcgcaagaaaaaatttaagggtttattctttggaaagggaaccgggggatatgaaacacaccccaatttcttccaaagaaataaaggccttcctgaatatccttttcctcccaacnaaagtgtaaataacagtggccttggcccccatggggtgtaaagaaaaagaccctctcccctcaaaaggggaaagagacacttcctaaaaaggggtaaaaaattcaaaagccccccacacttttgcaagttgttgggtaagagagggaaaaacccccaatattgttgggcgctccccatataccccccccggtaatccacggatttggtataactctgggaaaaattttcctgtgtgccccgnttcctgggtaaaattatatttctactcccacaaaaatgtgggggtgggtggcgtagtcaatctcg

SEQ ID NO: 82512 - DNA, 809 bp, Zea mays
  misc_feature: Ceres CLONE 1568328
  misc_feature: Encodes the peptide sequence at SEQ ID NO. 82513
gagctccccgcggtggcggccgctctagaactagtggatcccccgggctgcaggaattcgtctcacccctagaaaaaactcgcgttgtctcttgtcgctgcctcgtcccgtccaatccttccaagcctctcttcttgctgcagctgccccaagaccgccccgcgccggctcaatccggcgggacgaggagacggcattgctcgcatcgcctgccctagcctgcgctgcccccccatgcgtgttgtgcgcatgaacagaggctaggctaccaacacatagcacgacagccatggatcccgagttcggcgtcggcacggcgccacaaaaggggcggcaggcgtggcggacgacgctgctgctggcgtaccagagcctcggggtggtgtacggcgacctcagcatctcgccgctgtacgtgtacaagagcaccttcgccgaggacatcacgcactcggagaccaaccaggagatcttcggcgcgctctccttcgtcttctggacgctcaccctcgtcccgctcctcaagtacgccaccatcgtcctgcgcgccgacgacagcggcgagggcggcacgttcgcgctctactccctcatctgccgccacgccaatgtcagcctcctccccaaccgccaggtcgccgacgaggagctctccacctacagggctggagcgcccgcgcgaggccagcggggagtcctgcctgctcagggcgtggctggagaagccacgagactgcacaccgggctgctcgtcatggtcatgatcggcacctgcatggtcattcggcgacggcgtcctcacgcccgcc

SEQ ID NO: 82513 - protein, 173 aa, Zea mays
  misc_feature: Ceres CLONE 1568328
MDPEFGVGTAPQKGRQAWRTTLLLAYQSLGVVYGDLSISPLYVYKSTFAEDITHSETNQEIFGALSFVFWTLTLVPLLKYATIVLRADDSGEGGTFALYSLICRHANVSLLPNRQVADEELSTYRAGAPARGQRGVLPAQGVAGEATRLHTGLLVMVMIGTCMVIRRRRPHAR

SEQ ID NO: 82514 - DNA, 836 bp, Zea mays
  misc_feature: Ceres CLONE 1568331
  misc_feature: Encodes the peptide sequence at SEQ ID NO. 82515
  misc_feature (637)..(637): n is a, c, t, g, unknown, or other
ctccccgcggtggcggccgctctagaactagtggatcccccgggctgcaggaattcgtctcacccctagaaaaatgccctgctcggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaagtgactaacaagcccgtttgctgtggcttcggcatatccaagccagagcacgtgaagcagattgcgcagtggggcgctgacggggtgatcatcggcagcgccatggtgaggcagctggggcaagcngcttctcccaagcaaggccttgagaggctggaggagtatgccaggggcatgaagaacgcgcctgcatgagtccctgacaaaagtaaacgtacggagacccttgataatatctatctatcattctcggagaaacgaccgaccaataaaataagcccagttggaagtgaagcttagctgtttataccccgcacgctcgccg

SEQ ID NO: 82515 - protein, 210 aa, Zea mays
  misc_feature: Ceres CLONE 1568331
  misc_feature (1)..(210): Pfam Name: Trp_syntA Pfam Description: Tryptophan synthase alpha chain
  misc_feature: SWISSPROT Homolog: EC 4.2.1.20 Tryptophan synthase
MPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVCCGFGISKPEHVKQIAQWGADGVIIGSAMVRQLGQAASPKQGLERLEEYARGMKNAPA

SEQ ID NO: 82516 - DNA, 873 bp, Zea mays
  misc_feature: Ceres CLONE 1568332
  misc_feature (231)..(231): n is a, c, t, g, unknown, or other
  misc_feature (232)..(232): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaaacacaccccacatcacaacagctccctctgcatctccgcctcgtcgccgtcgtctgcctgcacaaccttcttcttcctcatctctctctctcttcttccgctgccacccctccagcaccgagggaagggaagccccagatcttcgtccggctccggnnccgcgtctttctctaactcatcggatctgtatgggttttcggtagggaccaaaaaccccttaggaatggccaaaaaatgccttttcccctcaaaaaacttttttttgagggaatttggagggagaaaccccccttttttttttttttttggcccctcttttgatacttttaaacctaaaagaacccttttttcccccccctggggttttttccaaaaagggggggtgtacaagggggggccccaccaccctttttttaaaaaacaaccccccggggggaggggggggggggaatttttctcccccccccccccccccccctgttgggggggcttttttttttttttccccccccggaaagaaaaaaaaaaacccttttttttttgttttttccccccccccccccccctctttttttttttttccggcccggggggggggggggggaaaaaaaaaaggggtccctctctttctctcccacccccaaaaggggggggggaggttttttttttttctcccccccccccccccccgttgatagagtatttttcttccgcgcgcctttcccacncccggaggtaaggatgtgggtggtgccttttttttcttttttttataaaaaaaaagaaagagaaatgtttt

SEQ ID NO: 82517 - DNA, 856 bp, Zea mays
  misc_feature: Ceres CLONE 1568334
  misc_feature: Translation starting site: 213
  misc_feature: SWISSPROT Homolog: EC 3.6.3.25 Sulfate-transporting ATPase
  misc_feature (669)..(669): n is a, c, t, g, unknown, or other
ctcaccgcggtggcggccgctctagaactagtggatcccccgggctgcaggaattcgtctcacccctagaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagccccgggtcgctgaccgcgctcatggggccctcgggggtcggcaaagtcaccctgctcgaagccctcgccgggcgcctcggcgccaagcctttcctcttcgggaacgtgctcctcaacggccggcagggctaagctcttccttcggcgccncagaggcgtgggttgccaagcggtaccgtgacccaaggacggacaaccttgatcggggacccctgaaccgggcccccgagaacaatcgggctaacttcggggccttgcttgcgggttggcccggacaaaaaaatgccgccggggaaggaacaaacccgccgccctggttggaaagggccacccttcc

SEQ ID NO: 82518 - DNA, 771 bp, Zea mays
  misc_feature: Ceres CLONE 1568339
  misc_feature: Encodes the peptide sequence at SEQ ID NO. 82519
  misc_feature (647)..(647): n is a, c, t, g, unknown, or other
  misc_feature (667)..(667): n is a, c, t, g, unknown, or other
  misc_feature (670)..(670): n is a, c, t, g, unknown, or other
  misc_feature (771)..(771): n is a, c, t, g, unknown, or other
ctcaccgcggtggcggccgctctagaactagtggatcccccgggctgcaggaattcgtctcacccctagaaaaaagccagtccacagtccacactcgcggggtttttttccccttccccgtccgcgcccttcgaaactgcacaggccgtcaggcccacaacgcacgctcacatgcagcagtctacttctattttccattcaacgccggcgaacgcaaggccaaaagccccaaacctatatattccatgtactactgattcacaacgccggcgacgcccacccagccccgcagccgcagtccaggccagcaccacccgtcagcttgcggactccacgcaccctgcggcgacgaccgtacatgcagcacaacagttcagccgcacaacaaaccgaggtccgagggacatcgtcaattctagcgcgcggcgcggggatggttacgccggcggtgtcccgctaccggcttcgcccgcggttggtgcgtgtggcggtgtcaaaaatcccgctcgccacgaggcggacgaagcagcagcccgtggccgcgacggagccggcgattccgagcaaacttctgtgcccgatctcggtggagatgatgcaggaccccgtgacggcgccgacgggaatcacgtacgaccgggacagcntgaaggggtgggctgaaccncgnccactccacgtggccccgtcacccgcgcgcccgctgcgcgcggaagacctgaatcccgaaccacgccacgcgggcggaatgatcccaggaactggtgcgcn

SEQ ID NO: 82519 - protein, 112 aa, Zea mays
  misc_feature: Ceres CLONE 1568339
  misc_feature (41)..(103): Pfam Name: U-box Pfam Description: U-box domain
  misc_feature (72)..(72): Xaa is any aa, unknown, or other
MVTPAVSRYRLRPRLVRVAVSKIPLATRRTKQQPVAATEPAIPSKLLCPISVEMMQDPVTAPTGITYDRDSXKGWAEPRPLHVAPSPARPLRAEDLNPEPRHAGGMIPGTGA

SEQ ID NO: 82520 - DNA, 1264 bp, Zea mays
  misc_feature: Ceres CLONE 1568340
  misc_feature: Encodes the peptide sequence at SEQ ID NO. 82521
  misc_feature (33)..(33): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (839)..(839): n is a, c, t, g, unknown, or other
  misc_feature (912)..(912): n is a, c, t, g, unknown, or other
  misc_feature (1067)..(1067): n is a, c, t, g, unknown, or other
  misc_feature (1231)..(1231): n is a, c, t, g, unknown, or other
gggggggtgggtgggggggtatattaatacatnattaaataaatcttcaatacttgtgtnnnggggggatnnnnaccccctgggactccccgcggtggcggccgctctagaactagtggatcccccgggctgcaggaattcgtctcacccctagaaaaatcgccaactcggagaccttgagaggaaagccaccgcgcgctagggcctagggcagggcacgagcaaaggccctcccgcgggttccattggagcgcgagcgaacggcgccgacgcggcaacacacattcgctttatttgccatgacatcgccgtcctcgtcgtcgtcctggctgctgctgctcctctcgtgcctcgcgcttgccctgctcgcggcggacgccgaagtgcaccaccatgagttcgttgtccaagagacgccagtgaagaggctgcccaagacgcacaagggcgtgccggtgaacggtcagtacccggggccgacgctgggaggcaaggagggccaacccgctggggagtcaaccttcggcataggaggggggcagttgcagcgggctccatcccacagggaacgggggatccggccagaataaagaacccggggaggggagggaacaaggtcaggaatttgctgttgaacacttttgtccccccattcgtagacccccagatggggccggctatacccataataactagcagctttaaacgcacaggcggaagcgtggcaatcggcttgggtgtcatccatgcccgctcggggagtgaggagagagaagatgataatcgaaagagattaccaccgggtcgtactatagagcgggcgcgacgactaccacacntaaccggataagtggcgagacatctcaacatctatgacttacagattattctcacaaccacacacaccctggntcgtggcgctcaaacatttagtgtggatcgtccttccccctcttctctgtagcatgcctcaactaaaaactctggtactcagacacagcctagagagacgagcgccatggggggcgccccgcctttcactggagatctatgcgacaatacgtggntatgggtagaacatatctcatactgtcaccgggtgaggctgtgagaacaattacatatgtctcacgtcttaatcggtcgacatcgcacgctgatcggagtctccgcggccgtcgctggcgtatactcctcacacaagtggtggggaggggctgaggaggggagncgtgcgagcgtgagcgaacgtagcaagacgttt

SEQ ID NO: 82521 - protein, 96 aa, Zea mays
  misc_feature: Ceres CLONE 1568340
  misc_feature: SWISSPROT Homolog: EC 1.10.3.2 Laccase
MTSPSSSSSWLLLLLSCLALALLAADAEVHHHEFVVQETPVKRLPKTHKGVPVNGQYPGPTLGGKEGQPAGESTFGIGGGQLQRAPSHRERGIRPE

SEQ ID NO: 82522 - DNA, 917 bp, Zea mays
  misc_feature: Ceres CLONE 1568343
  misc_feature (917)..(917): n is a, c, t, g, unknown, or other
caccgcggtggcggccgctctagaactagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctcagcgatgtcgggggcgatcgggggcgccgaaggtcacgggcttccggggcgcagcgccgcacctccggcgtccgcggggtgctcggaaggcaatccgggtgggcgcaccccgccgggccgggccggggggggggttcccgcggaaaaaatcgccccctttcccgccccttggaaaaaaggggctctttttaattttacccaaacccgggtttaattttcccgggggaaaggggcttttccccccgggccccctttaaaaaaggagggtgggtttctcaaaggccccccaaaaattacaaagaaaggggggggtttccccccccaaaaaaaaattttttgggggggggccccccccaaaaaaatctctcccaattttttttccgggggggaaaaaaaaaaaaaacaccccccttttgcccccccccccgaaaaaaaaaacaacctctcggggggggggggaaaccctcccccccacccctctttttttttttttgggggggaggccccccccccccccagatgtgtttggtgtgttgtggagaaaaaaacccccccccccgaaaaaaaaaagagaaaataaaatattttttggggggggggggggggttttaaaaaaaaaaaaaaaaagagggtgtttgtcctccctccccccccaaacaaaaaaaaaaaagccccccccccccgcggggtggggggtgggttccacaacaaaaaaaaaaaatatagtcttctcccccccccccn

SEQ ID NO: 82523 - DNA, 817 bp, Zea mays
  misc_feature: Ceres CLONE 1568345
  misc_feature: Encodes the peptide sequence at SEQ ID NO. 82524
  misc_feature (497)..(497): n is a, c, t, g, unknown, or other
  misc_feature (551)..(551): n is a, c, t, g, unknown, or other
ctccccgcggtggcggccgctctagaactagtggatcccccgggctgcaggaattcgtctcacccctagaaaaattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcggggtgggcgtggcgcccgaggtgggcaggggtcgtcgtcngcgaccacaatgctcagcaggcggcgcagctccctccgccgcccgcgctgccgnggtgggtcctcgcacgaggcgcccgccgtcgtaccgagaactgtggtggctcctgcggcgcccgaagacgagcagctgggcgtgaccacccgtgacttgatgcacctctgggcggctcgtccaggagaagggacggtggcccgtcgtggatccacatgatgggaccgcaccttgccgaccatgaggtaccaagcctggcggaaaagacccaccgaatggtccacccacagtaccgcagtacccctattctttgaggatgcattcac

SEQ ID NO: 82524 - protein, 100 aa, Zea mays
  misc_feature: Ceres CLONE 1568345
  misc_feature (55)..(55): Xaa is any aa, unknown, or other
  misc_feature (73)..(73): Xaa is any aa, unknown, or other
MSALLDLLMGIFRQQTLGGAALELAALAAPLWLAALVGLLIGVGVAPEVGRGRRXRPQCSAGGAAPSAARAAXVGPRTRRPPSYRELWWLLRRPKTSSWA

SEQ ID NO: 82525 - DNA, 832 bp, Zea mays
  misc_feature: Ceres CLONE 1568346
  misc_feature: Translation starting site: 269
ggagctccccgcggtggcggccgctctagaactagtggatcccccgggctgcaggaattcgtctcacccctagaaaaagcacagtagtagaccgcggaatccgatctaaccctaaacccgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcgctggcgggggcagcggccggcggtgatatcgtccaccacgatgacgaggcacccaagatccctggatgctccaacgattttatcctggtaaaagtgcaaagctgggtcaatggcaaagagggtggcgagtttgttggcgtcggtgctcggtttggtccaaaatcgtctccaaggagaagcacgcaaaccgaactaaactcacgctggcagaccctatggactgctgctctcctcgaaaacatagggtcctggagatgttcttttagttcaaaggggaaaggtgcaattcacaaagaaagcaaagtttgctgaagctgctggtgcttctgctatagtaatcataaaacatgttcacgaatggtacaagatggtctgcgaaaagaatgaaaccgaccttgacataaatatacctgcagttctcctacaaaagatgcagggtctgctttacctacccttcttacaatggtaacacagtttctgtgcagctttactcttcagatcgacctgtagttgaccctgcaa

SEQ ID NO: 82526 - DNA, 834 bp, Zea mays
  misc_feature: Ceres CLONE 1568349
  misc_feature: Encodes the peptide sequence at SEQ ID NO. 82527
  misc_feature (384)..(384): n is a, c, t, g, unknown, or other
ctccccgcggtggcggccgctctagaactagtggatcccccgggctgcaggaattcgtctcacccctagaaaaaaaaaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgactacagctcggcgccggtgcgcgcgcagaccatcgacgagctgcactcgctgcagcggaagcggtcggcgcccagcacgcccaagtggtcggcgcccaccacgcccaccaagggcggtggcgagggggccttcaccgtcncgatctccgaggaggagcgccacacgcagcagatgcagtccatcagtgcggcgtttggcgtctctcacgcctgaaaccgggccgaaagtggtcaagggcgacccgggccgcaagggcaaggcccccccgcaggggccccccatcaaccccgaagggcgcaccagcagttccgggggccccgggcgcccccggcattggtcgtaaagaaaaagctccctcaaagttcactcctggggccgaaccaccctcctcgcgtggggggcttgacaaaacaggccctcaaagtaccaagaagggggcgctttcttaaaaaccccgcggggctccctgggggaaatttttgcaggggcgccaagaaccgggggggtgttcccggaggaaaaaaagcggtgcgttcaaggggatgaagtcttcccgctcacggggaccccgggggaggggtgagaaaag

SEQ ID NO: 82527 - protein, 95 aa, Zea mays
  misc_feature: Ceres CLONE 1568349
  misc_feature: SWISSPROT Homolog: EC 4.1.1.49 Phosphoenolpyruvate carboxykinase (ATP)
  misc_feature (72)..(72): Xaa is any aa, unknown, or other
MATPNGLARIETTGKKKQDNGVWYDYSSAPVRAQTIDELHSLQRKRSAPSTPKWSAPTTPTKGGGEGAFTVXISEEERHTQQMQSISAAFGVSHA

SEQ ID NO: 82528 - DNA, 830 bp, Zea mays
  misc_feature: Ceres CLONE 1568352
  misc_feature: Translation starting site: 166
  misc_feature: SWISSPROT Homolog: EC 1.1.1.39 Malate dehydrogenase (decarboxylating)
  misc_feature (602)..(602): n is a, c, t, g, unknown, or other
  misc_feature (603)..(603): n is a, c, t, g, unknown, or other
tccccgcggtggcggccgctctagaactagtggatcccccgggctgcaggaattcgtctcacccctagaaaaagtaaagggtagaacgtctccactctcccgtacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcgcagcagcagatcgacagattcatgcttgatctgaaacggctgcagagatatgcaagagatggcccgtctgatacttatccattggcaaaatggcgcatccttaacagattgcatgacagaaatgaaacgatgtactacaaggtactaatagataacattgaggagtatgcacctatcgtttacacaccaaccgttggacttgnnttgcaaactacagtggtctgtttcgacgccctaggggattgtactttagtgcagaagatcgtggggagatgatgtccatggtgtacaatgggcaggctgatcaggttgacatgatagtggtgactgatgggagcaggatattggggcctggtggatcttgggggtgcattggattgggctttgctattgaaaaaatgggatttatatggtgcgcgctggctgggaaa

SEQ ID NO: 82529 - DNA, 885 bp, Zea mays
  misc_feature: Ceres CLONE 1568354
  misc_feature: Encodes the peptide sequence at SEQ ID NO. 82530
ctccccgcggtggcggccgctctagaactagtggatccccgggctgcaggaattcgtctcacccctagaaaaatggcatgggccactactgctagagctagtgctagtagcagcgtggagaggcagagaagtagccaaagccaagtaggaggaggaggaggagcggcaggtagggcgcggggcgagagcttgacgcggcaaccaccgctgcactgcactgcactgcaccccctagctcctccgagctcagcagctcgctcgcggcaagtcgccatccatgtcaggaaagatttatctggtcggccgatcgagctcctctccttctccgaagcactgaagctccagcggctgccctgcctgacagccacttcgcacgaccaaattaaaaagcgcgggcgatcgagatggcgcacgaccccagcctgggcttcgcggactacttctcggcggcggcggctgctgctgcggcgggcgccacggcgatggacgacgacttcggggcgccggagctctttgggccgcatgcccgaccacatggagttccttaggcatgcggtggccgtgccggccatgccccccttgccgggggacaccaccatctaccaccctccattacggggcaccggcaagggccggggggccctcccccgacgactaactacgccggggggtgggggcctgatagtccggcggcctccgccggaacgacgccccccattgcgcctttccttggagcgaggcagctactcatgcttcctgtcttccaccaaggggcccccgttgttcacctgttctccctggttcctcggcctgggaactttgacaaacccaacttttgcaacagaaccgaaacacccaccccttcagccggggggggcggtcccc

SEQ ID NO: 82530 - protein, 47 aa, Zea mays
  misc_feature: Ceres CLONE 1568354
MAHDPSLGFADYFSAAAAAAAAGATAMDDDFGAPELFGPHARPHGVP

SEQ ID NO: 82531 - DNA, 808 bp, Zea mays
  misc_feature: Ceres CLONE 1568355
  misc_feature: Encodes the peptide sequence at SEQ ID NO. 82532
ctccccgcggtggcggccgctctagaactagtggatcccccgggctgcaggaattcgtctcacccctagaaaaattctccctgcaccgtttcgtcgtctcatttcagcagctactagaagtagtagctggctcgctcctgctgccggtttcttgccgtcttcttcttcaccgacgacggtcgcgcgttcctacaccaggtggtccgaattgttttactagggtgcaacggattcgtatccaggagacgtttgagatcgtccttcagcgcttatcatacatacatcaagcagatcaacaagggcttaattcacaagacaagagaggatgggtttcttctctctatttctggtggcgtctatgccgatcatccaggtcctgctcataggtgtcattggagcttacctggcctctggtttcagcaacgttctgacgacgagtgctcgaagggatatgaacaaggttgtttttactgtgttcaccccatctttgatgttcgccagcctcgcgaagacggtcacccttgcagacgtcatttcttggtggtttatgccagttaacatagcgatcacgttcatgatcggtggcactctgggctggatagcttgcaacatcttgaagccacgcagcactttagggggcttgatcatgggcttctgctcagcaggaaaactcggaaacctgctcctgatcattgtcccggctgtatgcgacgaagacggggacccgtttggggatgattccagcacttgccgctcacgcagtctcttctaactctcctttgccatgggctccggggggccctcttca

SEQ ID NO: 82532 - protein, 148 aa, Zea mays
  misc_feature: Ceres CLONE 1568355
MGFFSLFLVASMPIIQVLLIGVIGAYLASGFSNVLTTSARRDMNKVVFTVFTPSLMFASLAKTVTLADVISWWFMPVNIAITFMIGGTLGWIACNILKPRSTLGGLIMGFCSAGKLGNLLLIIVPAVCDEDGDPFGDDSSTCRSRSLF

SEQ ID NO: 82533 - DNA, 843 bp, Zea mays
  misc_feature: Ceres CLONE 1568356
ctccccgcggtggcggccgctctagaactagtggatcccccgggctgcaggaattcgtctcacccctagaaaaaggcggtggggaaccgaagaaacctttcccgaaatttcccctcccccgcgccgaacgaactctcgatccgatcccgatccctgcgaggagccgcctctgctcaccgatccggcccctgatccgctcgttgctcgtcgggatctctggatcgcggtctggacatgcttgctgcttcaagagaacagcgaggctttcgggaggcaccgctctgagcatcttgcatgtgtcgacatgaggggagctctatttggccatccgaatttccttcctgagatatgcctgactgacggcgatatcttaccagcatcctcttagctgccccacacatttgtcttgactctaatccatgtgtggttcgtcctgtacttctccgaaggggtggaaaagttggactattggatcaagagctggtactaggtgttcctctgaccaggtactgtgttgcctgcccattggtgacatggggtgccaaagaaatccctgtatgggatcatatcacgaaacctggggtccagtgacatcctggacatagttaaatggcaacgggtggaagcggggcgatccaaccctttactaaggggagggagccgtacattcgcttgagggggatttttcatgaactcccccatgtttctcccacttgccgaaaagagcttttgacccccccccttcttggagaagggaggaaaattgaagaatgagggggggtagaatcccccccctcccattttttgcccatggctcccccccctattgtttaagaaatgggt

SEQ ID NO: 82534 - DNA, 836 bp, Zea mays
  misc_feature: Ceres CLONE 1568360
  misc_feature: Encodes the peptide sequence at SEQ ID NO. 82535
  misc_feature (532)..(532): n is a, c, t, g, unknown, or other
  misc_feature (533)..(533): n is a, c, t, g, unknown, or other
  misc_feature (743)..(743): n is a, c, t, g, unknown, or other
ctccccgcggtggcggccgctctagaactagtggatcccccgggctgcaggaattcgtctcacccctagaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaagagagcacccctccacgttggtctccgcctcaggggaggcatgcaaatcctccgccaagacccctaccgggaaaagactttccacccccccgaggggggaggctttttggaacccctttgaaaaaaacgtcaaggggccaaaatctccggacaaaggggaggggattccctccgggaaacaaaaannggggtttttttttttgtctggggaaaaaaaccccccagggagagggggggcccccccttggggccaaaataaaaaaatttttaaaaaggggaaaacaccccccccccccgggggggggggggggcccaaaggggggggggatagaaaatattttccgggaaaaaaccccccttcggggggaaaaaaattccccccccttggggaggggantctccttggtaaacacctttaaaaaaagtgtttgggggcccaaaaccccccgggacaagggggggggggtccccccccggcgcaaaacaaagg

SEQ ID NO: 82535 - protein, 226 aa, Zea mays
  misc_feature: Ceres CLONE 1568360
  misc_feature (6)..(69): Pfam Name: ubiquitin Pfam Description: Ubiquitin family
  misc_feature (125)..(125): Xaa is any aa, unknown, or other
  misc_feature (126)..(126): Xaa is any aa, unknown, or other
  misc_feature (196)..(196): Xaa is any aa, unknown, or other
MQIFVKTLTGKTITLEVESSDTIDNVKAKIQDKEGIPPDQQRLIFAGKQLEDGRTLADYNIQKESTPPRWSPPQGRHANPPPRPLPGKDFPPPRGGRLFGTPLKKTSRGQNLRTKGRGFPPGNKXXGFFFCLGKKTPQGEGGPPLGAKIKKFLKRGKHPPPPGGGGGPKGGGIENIFREKTPLRGEKNSPPLGRGXSLVNTFKKSVWGPKTPRDKGGGVPPRRKTK

SEQ ID NO: 82536 - DNA, 763 bp, Zea mays
  misc_feature: Ceres CLONE 1568361
  misc_feature: Translation starting site: 217
  misc_feature: SWISSPROT Homolog: EC 2.7.11.22 Cyclin-dependent kinase
  misc_feature (527)..(527): n is a, c, t, g, unknown, or other
  misc_feature (580)..(580): n is a, c, t, g, unknown, or other
ccccgcggtggcggccgctctagaactagtggatcccccgggctgcaggaattcgtctcacccctagaaaaactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtgggcaagggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaagccctccgcggctgggcgccgcgccgcgccgacacgttcgagaagcttataangataggatcgggcacgtacagcaacgtgtacccggcgagggacaccgtctctnggcggatcgtcgctcttaaaaaggtccgcttcgataacctcgagccagaaagcgtcaagttttatgcccgggaaatactgatcctaaagagactcgaccacccaacatcatcaaattagagggcttggtcaccctccagatgtcatgcagcctttactttgtcttcgagtacatggagcatga

SEQ ID NO: 82537 - DNA, 785 bp, Zea mays
  misc_feature: Ceres CLONE 1568362
  misc_feature: Encodes the peptide sequence at SEQ ID NO. 82538
  misc_feature (608)..(608): n is a, c, t, g, unknown, or other
acccgcggtggcggccgctctagaactagtggatcccccgggctgcaggaattcgtctcacccctagaaaaaacccacagagaaagccagacaggaacaggcaactagtgtgtgctctctccagatctttctcgtagtttctcacacgacgacgacgagtccatgtccgccgcggtgatgacggcgccgccctgccacaggcagccgtcccctctcaaccccaactcgagggccacgcagtcgccgccgatcagcaacggcaaccccaacgcggtctccacgaccacgacaaggaggcacctcgccaacctcgaccgcctcctcgtcaagccgccaccgctcccgctcccgctcccgccgcagcctaggaaactgccagccgatgaggtaccaggcgacggggaggccacccccgacgaccgcagcggccacggcgggctcctcaacgcgctgaacctgtccacgtttctgcccttcacgcggaaggcagccgtggacgagatgtccccgagcagcctggcgtacatgcagcgcctcctcacgctctccccgggggtgtcgccgaagggctcatcgcgggcgagtggcggaggtaccacgcgaaggcnggtgggaagggcctcctcgacccgctcaacaaaacctggggccgggagctcctccgctacggggacttcgtggaggccgggtaaccggggtttcattccatgccctcggggggcgaaggaagcctccaggggtcaaaaggcacccccctgggtcccgggacccttggtaccccccga

SEQ ID NO: 82538 - protein, 207 aa, Zea mays
  misc_feature: Ceres CLONE 1568362
  misc_feature (149)..(149): Xaa is any aa, unknown, or other
MSAAVMTAPPCHRQPSPLNPNSRATQSPPISNGNPNAVSTTTTRRHLANLDRLLVKPPPLPLPLPPQPRKLPADEVPGDGEATPDDRSGHGGLLNALNLSTFLPFTRKAAVDEMSPSSLAYMQRLLTLSPGVSPKGSSRASGGGTTRRXVGRASSTRSTKPGAGSSSATGTSWRPGNRGFIPCPRGAKEASRGQKAPPWVPGPLVPP

SEQ ID NO: 82539 - DNA, 799 bp, Zea mays
  misc_feature: Ceres CLONE 1568367
  misc_feature: Encodes the peptide sequence at SEQ ID NO. 82540
  misc_feature (506)..(506): n is a, c, t, g, unknown, or other
  misc_feature (533)..(533): n is a, c, t, g, unknown, or other
  misc_feature (672)..(672): n is a, c, t, g, unknown, or other
acccgcggtggcggccgctctagaactagtggatcccccgggctgcaggaattcgtctcacccctagaaaaattgcattccatctccatagacaagtaatcccaatcccgtcctacctggatggttcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagtttgtggttagcaaatcccacaagcaggaagcagccgcgagcgagccatggccatggatcccgttctgaaggtgccctgggctcggcngcgttcgccgtgttctgggtgctggcngtgttcccggcggtgcgttcctgcccatcgggcgcacggcgggctccctgctgggcgccatgctgatggtgctgctgggcgtgatgagccccacgacgcttacgccgccgtggacctgcccatcctggggctgctgttngcaccatggtgggtaagctgtaccctgaagcgcgccaacttgttccggcactggggcccctcttttcctggcggaaccagggggggccggaacttcttgggcgcacctggcccgggtccgccctccc

SEQ ID NO: 82540 - protein, 111 aa, Zea mays
  misc_feature: Ceres CLONE 1568367
  misc_feature (14)..(14): Xaa is any aa, unknown, or other
  misc_feature (23)..(23): Xaa is any aa, unknown, or other
  misc_feature (69)..(69): Xaa is any aa, unknown, or other
MAMDPVLKVPWARXRSPCSGCWXCSRRCVPAHRAHGGLPAGRHADGAAGRDEPHDAYAAVDLPILGLLXAPWWVSCTLKRANLFRHWGPSFPGGTRGGRNFLGAPGPGPPS

SEQ ID NO: 82541 - DNA, 826 bp, Zea mays
  misc_feature: Ceres CLONE 1568368
  misc_feature: Encodes the peptide sequence at SEQ ID NO. 82542
  misc_feature (486)..(486): n is a, c, t, g, unknown, or other
  misc_feature (555)..(555): n is a, c, t, g, unknown, or other
  misc_feature (692)..(692): n is a, c, t, g, unknown, or other
ctccccgcggtggcggccgctctagaactagtggatcccccgggctgcaggaattcgtctcacccctagaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatncctccggaccagcagcggctcatttttgctgggcagcagctcgaggacgggcgcacgctggccgactancacattcagaaggagagcaccctccacttggtgttgcgtctcaggggcggcatgcagatattttgtgaagactctgactgggcagactatcacccttgaagtcgagtcttctgataccatcgacaatgtcaaggccnagatccaggacaaggagggcatccctcgcgaacagcagcggcttcatttttgcgggcagcagctcgaggacgggcgcacgctggccgactacacattcagaaggaaagccccctccactggggctgcgtctcag

SEQ ID NO: 82542 - protein, 167 aa, Zea mays
  misc_feature: Ceres CLONE 1568368
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (112)..(112): Xaa is any aa, unknown, or other
  misc_feature (135)..(135): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXPPDQQRLIFAGQQLEDGRTLADXHIQKESTLHLVLRLRGGMQIFCEDSDWADYHP

SEQ ID NO: 82543 - DNA, 834 bp, Zea mays
  misc_feature: Ceres CLONE 1568369
  misc_feature: Encodes the peptide sequence at SEQ ID NO. 82544
ctggagctccccgcggtggcggccgctctagaactagtggatcccccgggctgcaggaattcgtctcacccctagaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccccaacggcgtcaagttcggcgaggccgtctggttcaaggccggctcccaaatcttccacgagggcggggctggactacctcggcaaaccccagcctgatccaggcgcagaacatccctcgccatccgggccctgcaaggcctggctcagggggggccgcccagggctaccccatttgcccggggggccgctccggcaaagtcctccaacccgctgtacccgggggggagctttccaaccccttggggcctggcccaaaaaaccccaaggcctttcccgaaagtcaaggggaaaggaaccccaaaaacggcccccccccccccaggtttttccatgtttcggggtttcttcgggc

SEQ ID NO: 82544 - protein, 148 aa, Zea mays
  misc_feature: Ceres CLONE 1568369
  misc_feature (61)..(145): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSPNGVKFGEAVWFKAGSQIFHEGGAGLPRQTPA

SEQ ID NO: 82545 - DNA, 906 bp, Zea mays
  misc_feature: Ceres CLONE 1568370
  misc_feature: Encodes the peptide sequence at SEQ ID NO. 82546
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (78)..(78): n is a, c, t, g, unknown, or other
  misc_feature (534)..(534): n is a, c, t, g, unknown, or other
  misc_feature (612)..(612): n is a, c, t, g, unknown, or other
  misc_feature (709)..(709): n is a, c, t, g, unknown, or other
nnnnnnnnnnnnnnnnnnnnnnnnnnnnnnnnnnnnnnnnnnnnnnnnnnnnnnnnnnnnnnnccccccnnnnccaanggggagctccccccggtggcggccgctctagactagtggatcccccgggctgcaggaattcgtctcacccctagaaaaggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaagcggtggcaagggtgaagacntcggcgcaggacatcatcaaccctcagccactcatcgacaagaaggcgtggccgtacgtccagaacgaccctcgcctncggggccctctacctgcgctacgacctcaagaccgtcatcgcttccaagccccaaggaggagaagcagagcctcaaaggagctcaccgggcaagctncttcagcaccaatcgacggatcttgaccatgcccgcaaaaatcaagaaccacccccggaagcccgaagaaatactttcgcagccaaccaaagatgcggctccggcgaccgtcctcgccaaagctaggcctaagatggaaagcttaatagaatggggtaacccgattggccacgttaattttccggacctttgtgttt

SEQ ID NO: 82546 - protein, 183 aa, Zea mays
  misc_feature: Ceres CLONE 1568370
  misc_feature (9)..(182): Pfam Name: PsbQ Pfam Description: Oxygen evolving enhancer protein 3 (PsbQ)
  misc_feature (176)..(176): Xaa is any aa, unknown, or other
MASMTGLSQGVLPSRRAANRARTAAVVRASAEAQAQAQAGRRAVLGLVATGIVGGALSQAVHAETVKTIKIGAPPPPSGGLPGTLNSDQARDFDLPLKERFYLQPLPPAEAVARVKTSAQDIINPQPLIDKKAWPYVQNDPRLRGPLPALRPQDRHRFQAPRRRSRASKELTGQAXSAPIDGS

SEQ ID NO: 82547 - DNA, 910 bp, Zea mays
  misc_feature: Ceres CLONE 1568371
ctccccgcggtggcggccgctctagaactagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaattttagtagtagtaattgtaggtagcatctcttgtaaactgcgctcgcctttgcgtgtgcgtggtccttttgcgctttctcgtccctctttctctaatctctcctttattcctctctttcaccgggaatcccggcggctgggatgggatcccaatggcccccaaaaatggggggcctttttgcccccgacctttggaaggggggggaagtgcccccccatccgtttttgtaattcggggggggggattctggggggttggaaatttcccgtggccccttcccaattttttattttaaggggaccggttttggaaaccaaaaaaaatctattttgggggggcccttttaaacaaaaaaaaaacccttgggggggcccccttgtttttgggggcgcccttggggttccaccggggggggggaaaaggaaaacccccgggcgcccctcttaaaaactcttggggggggggggggttctccccccccacgagaaaaaaaccccccccgcgtggggggcattggtttaagaaaagctgtccccttttttaaaaagggagagaaaccgccccccaaaaaaaa

SEQ ID NO: 82548 - DNA, 768 bp, Zea mays
  misc_feature: Ceres CLONE 1568373
  misc_feature: Encodes the peptide sequence at SEQ ID NO. 82549
  misc_feature (541)..(541): n is a, c, t, g, unknown, or other
ctccccgcggtggcggccgctctagaactagtggatcccccgggctgcaggaattcgtctcacccctagaaaatttttcctccccgtcgcggcgtcgccggctcccacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcggcggtggaggcatgcccggcgatgacgggctggatgactttgggttggaggacgaggacgcggacccttcggctgaggcgaggaagaggaagggctcgtcgtcgctgaggggacctcncaagggggccgggccggggcagggaaaagaaggcttaaaaaaatgcggaggggaagggacaaacgggaagggggaagggaaccctgggaaagggtgaagggaaaaggggggggaaatcaggggggggaaagggggcctccggggggggtaaggggtttaaacccccgttttttttggggggaaaaaaagggaataaatcccgagggaagccccccgggggaaaaaca

SEQ ID NO: 82549 - protein, 141 aa, Zea mays
  misc_feature: Ceres CLONE 1568373
  misc_feature (110)..(110): Xaa is any aa, unknown, or other
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSAEARKRKGSSSLRGPXKGAGPGQGKEGLKKCGGEGTNGKGEGNPGKG

SEQ ID NO: 82550 - DNA, 849 bp, Zea mays
  misc_feature: Ceres CLONE 1568374
  misc_feature: Encodes the peptide sequence at SEQ ID NO. 82551
tggagctcaccgcggtggcggccgctctagaactagtggatcccccgggctgcaggaattcgtctcacccctagaaaaagtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatcccagggttcccaaccatcaagatcttcagggaccaggggaagaacattcaggaaatacagggccctaggggagctgatggcattgtggattactggaagaagcaggttggccctgcgtccaaggagatcaagtccacagaggatgcgacgggcccttatcgatgaccaagagatctacaatggtgggatcttcgctgaattcagcgggcacggaattacaaactttcatggaggtcgcaaaaaaactgagggcttgactccgacttttggccaccttttgcatgccaacccacctccccactgggggatgccacaatgggaaccggccatttgggtcaggttgctgaaacccattttgatgaaccttggttggtgaacacccaaggattttttg

SEQ ID NO: 82551 - protein, 162 aa, Zea mays
  misc_feature: Ceres CLONE 1568374
  misc_feature (35)..(143): Pfam Name: Thioredoxin Pfam Description: Thioredoxin
  misc_feature: SWISSPROT Homolog: EC 5.3.4.1 Protein disulfide-isomerase
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYEIPGFPTIKIFRDQGKNIQEIQGPRGADGIVDYWKKQVGPASKEIKSTEDATGPYR

SEQ ID NO: 82552 - DNA, 817 bp, Zea mays
  misc_feature: Ceres CLONE 1568375
  misc_feature: Encodes the peptide sequence at SEQ ID NO. 82553
  misc_feature (402)..(402): n is a, c, t, g, unknown, or other
ggagctccccgcggtggcggccgctctagaactagtggatcccccgggctgcaggaattcgtctcacccctagaaaaagaagggacgcacgggacagcgcgtcaggctctacgtccggggcaccatcctcggatacaagaggtccaagtcgaaccagtacgagaccacgtcgctcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtaccccancagcatctaaggttaggtttttgttggagtaaaagtggactctaaatggccatgcttagttcttctctctgagcttaaaatgccatgtgttggcaacttagattggtcatgtactgaacctgttgaagttctacaaaaatttgttgtcgaacggctgaacagttggcctaatggtatggtataaacagagcttatttcaaaaaaaaaagccgctcattcctccaatttgccccccggccgggtgggcttttttcccccacctaaaattctcgggaatccccccctttctgaaaacccccattcccaccttggggccgggggaaagctccccaaccggaaaaagcccccccgttccccggggccgttttccgtcacacctctctggtggccgttggccctggcggggcaaaaaaat

SEQ ID NO: 82553 - protein, 59 aa, Zea mays
  misc_feature: Ceres CLONE 1568375
  misc_feature (2)..(53): Pfam Name: Ribosomal_L35Ae Pfam Description: Ribosomal protein L35Ae
  misc_feature (57)..(57): Xaa is any aa, unknown, or other
MAYIYKAKTKSSETRYRCIWGKVTRPHGNSGVVRAKFKSNLPPESMGRKVRVFMYPXSI

SEQ ID NO: 82554 - DNA, 835 bp, Zea mays
  misc_feature: Ceres CLONE 1568376
  misc_feature: Translation starting site: 153
  misc_feature: SWISSPROT Homolog: EC 1.14.13.68 4-hydroxyphenylacetaldehyde oxime monooxygenase
  misc_feature (799)..(799): n is a, c, t, g, unknown, or other
acccgcggtggcggccgctctagaactagtggatcccccgggctgcaggaattcgtctcacccctagaaaaagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcgggaacccgtcgccgacatcatccgctacaactccacgggacgtggcctttcgcgccgtacggcgagtactggcgcacggcgcggaaggttgtcaacacgcacttgctcagcgccaagatggtctttctcaagcggcgggaacgggaaggaagaggtgccccctggtggtgggcccgaatccgcggacccttgccgaggcgtcccccggggaagggcgcttcaaaattaacgggaactgcttggggcggtatacccaggcgaacttcngggggcccccgcctgttgcttgggggaagtcccacc

SEQ ID NO: 82555 - DNA, 905 bp, Zea mays
  misc_feature: Ceres CLONE 1568378
  misc_feature: Encodes the peptide sequence at SEQ ID NO. 82556
aagctggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagaggaccctccacttggtgctgcgccctcgggggaggcatgcaaaatcttcgtggaagaccctgaacgggcaaaaactatcacccttcgagggggggagtcttcaaaaacccattcgacaaccgtcaagggcccagaaaccccaggaccaggggggggggctttccccccccgaaccaagaggggggccttaatttttttggctggggaaaaagaaacttgggagggaaggggggcgccacccttgggcgggaacttaacaaacatttcgcagaaaagggagaagacccccccccccccccccttgggggggcccgtcccccccc

SEQ ID NO: 82556 - protein, 203 aa, Zea mays
  misc_feature: Ceres CLONE 1568378
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKERTLHLVLRPRGRHAKSSWKTLNGQKLSPFEGGSLQKPIRQPSRAQKPQDQGGGLSPPEPRGGP

SEQ ID NO: 82557 - DNA, 913 bp, Zea mays
  misc_feature: Ceres CLONE 1568379
  misc_feature: Encodes the peptide sequence at SEQ ID NO. 82558
aaagctggagctccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttgcccggcagcacccctccgccgtggctcgacggcagccttcccggcgacttcggctttgatccctggggcctcggatctgacccggagagcctgcggtggaacgtgcagggcggagctggtgcactgccgggggggcgatgcctcggcgcgggcgggtatcttcaatcccgggaattcttggaccaagatacgggcgtcctcaacacggcccttttgggtaccaccgcccggggaagcaagcaggtactttacccgacacccacccaccccctttttcatcattcgaagggtcatcccccatccgggctggggcccaaagggggcccccccctttggggggtgaactccaattaaagaggccccggaaagcgcttaaaacagccgggtttccctgttttttccccaaagaaaaaaaagtctaaacgggggaacccaaacttttggggggaccccctggggggggcccgcttgggttttagacaccccctctcgggtgtgggggggcctccgggtggttcgcggggaaaaaaaaaacaaaggggggcccggcccccccctcggggaagaagctctat

SEQ ID NO: 82558 - protein, 186 aa, Zea mays
  misc_feature: Ceres CLONE 1568379
MALVSASSSSTTAVAALPRNGQQRASSSLFSSSSSSSFLVGKTLLRQAEAARPSFAVRAAADSDRPIWLPGSTPPPWLDGSLPGDFGFDPWGLGSDPESLRWNVQGGAGALPGGRCLGAGGYLQSREFLDQDTGVLNTALLGTTARGSKQVLYPTPTHPLFHHSKGHPPSGLGPKGGPPLWGVNSN

SEQ ID NO: 82559 - DNA, 913 bp, Zea mays
  misc_feature: Ceres CLONE 1568380
  misc_feature: Encodes the peptide sequence at SEQ ID NO. 82560
gagctccccgcggtggcggccgctctagaactagtggatcccccgggctgcaggaattcgtctcacccctagaaaaagcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccggtggaagggaaacccccccccggaggcaggctgcgcggtcggtgacggcgcgggtccccgaccggcgggacggaacgtcatcatccttcgggcgccggagtggctgggttctgccgctggggggtacacccttccggaaagggatggccccccggggtgcattgtcatccaggagggaatctgaacgaaaccctgaacggaattggtggggcgaacctgtttccaacctgggaaggtacctttgaaaattaaatggagtttaggcccccccaaggatggtgggggaaaaaaaattgatggccccaacgggggggcgttgggtttccccccttaattccaagagagggaagaaaaaccccgagggttggcttttatcctgaagaaaaagtccccatttccaaaggttggcggggaagaagcttttcccaaaggggggggtttttttaagggaggaggggtcaggagaagttggccttttttgcgcaagtggttccatttgacaaagggagagggtgttacctcaccttttt

SEQ ID NO: 82560 - protein, 58 aa, Zea mays
  misc_feature: Ceres CLONE 1568380
MAAMAAAGGVGLHLIGAATATLIAAVLVAAVLGRRRRARAQAPPVEGKPPPGGRLRGR

SEQ ID NO: 82561 - DNA, 811 bp, Zea mays
  misc_feature: Ceres CLONE 1568381
  misc_feature (560)..(560): n is a, c, t, g, unknown, or other
  misc_feature (575)..(575): n is a, c, t, g, unknown, or other
  misc_feature (578)..(578): n is a, c, t, g, unknown, or other
  misc_feature (579)..(579): n is a, c, t, g, unknown, or other
ggagctccccgcggtggcggccgctctagaactagtggatcccccgggctgcaggaattcgtctcacccctagaaaaagccccgagagccgcttcttctttctccgtgactcggagctgtctacctcaccctcactgcctctgcgtgcgtgcgtcactgccggtctgccgtgccgctgcgcccgctcccgcaataaataaactcacctctctctgttctccgttctcacctccctcctcatccatccagggacgcgccttgacttctcacgtcgtgtcgtgtgtgagcgcagcggtgctgctgatctgcgattcctccacgccacaccctacctgaccacccgacagggaatcctactccctcttgcgcgccgcggcggcggcggcggcatcttcggtctccgtgcgggtgtttccgttcggcgtttactggccgggcgagcgcggcattggaggagtcgggaggagggagacaggaggcgtgatcgatggggaactgcgtggcgagcgggggcgcgacaacggtcacggcggcaggagaagacgggagcggcggggaanaaaagttgaaaagcnccnncggaggagcagctcggctcggtccccgggccggatcttctccaacgacggccgcagccgcaccgccgccgtgttcacgcagccagggccggaagggggtcaatcaggaccccctgctcgtctgggaatgggttccgccggggagaagacttcctgccttttgtgggggggttctaagggggacgggcccgcatgggccacctggtgggccccccaaggttcccccaaccccc

SEQ ID NO: 82562 - DNA, 836 bp, Zea mays
  misc_feature: Ceres CLONE 1568382
  misc_feature (649)..(649): n is a, c, t, g, unknown, or other
  misc_feature (650)..(650): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (818)..(818): n is a, c, t, g, unknown, or other
ggagctccccgcggtggcggccgctctagaactagtggatcccccgggctgcaggaattcgtctcacccctagaaaaaacgggccacggcaccatgtccagactcccgaggggaccatcactgccgcctgcctttccttctccgacctgaaccgccgcctcgatttcacggccgccccactgccagtgtgcgcccccggaatggcgtcacggggaggagatccggtaaaccaactctagctgaagtgacgagtggcagcattgttcaaccgagctgcttctgcttgactgggattgcgatggatcctgaaaaacaaaaatgaattgaaccttgatgggacaaagacaaccaacttagttttacaaaattttccaaggaagggtcccccaagggagccccccgggaaaaatttcttaaaaaaggggcggggaccccccaaaaagggggaaacttttttttttggaaacccctaaaaaaacccggggaccccttgagagaacacggggggggggcccaaaaaaaaaaaaaaaaaaaaaggggaaaaaaaaaacttttaaatttgcccccgccaaaaaaagaggggggtggtttccgcctgaaaaaaagaaaagggctcccacataaaaaagattagtggtggtgaagttcnncgggcggannngattttgtgtgttgtggcggagcgaccctcatcagttggggaaaaaaaaaaaaaggttctcgtgttttctctcctcctccccccaaaaaaaaaaaaagaaaacgccgggggtataaaaaaaaaaaaaaaaagaagggggggggcgcaaaacaacttntgggggggggggaaaaaa

SEQ ID NO: 82563 - DNA, 778 bp, Zea mays
  misc_feature: Ceres CLONE 1568383
  misc_feature: Encodes the peptide sequence at SEQ ID NO. 82564
  misc_feature (550)..(550): n is a, c, t, g, unknown, or other
ctccccgcggtggcggccgctctagaactagtggatcccccgggctgcaggaattcgtctcacccctagaaaacccgtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtggtttgacaccaactaccactttattgtccctgaattgggcccaaacaccaagttctcctatgcttctcancaggctgttaacgaatataaggaggctaaggcgctcggtgttgataccgtgccagtactggttggaccagtctcgtacctgttgctctcaagcctgccaagggtgtgggagaagggattcccctctcttttccttttctagcagcatcctcccagtctacaaggaaggtcattgctgagttgaaggcagctggggcttcatgggattcagtttgatgaagcccactct

SEQ ID NO: 82564 - protein, 181 aa, Zea mays
  misc_feature: Ceres CLONE 1568383
  misc_feature (2)..(182): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (135)..(135): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASXQAVNEYKEAKALGVDTVPVLVGPVSYLLLSSLPRVWEKGFPSLFLF

SEQ ID NO: 82565 - DNA, 830 bp, Zea mays
  misc_feature: Ceres CLONE 1568384
  misc_feature: Encodes the peptide sequence at SEQ ID NO. 82566
  misc_feature (556)..(556): n is a, c, t, g, unknown, or other
ctccccgcggtggcggccgctctagaactagtggatcccccgggctgcaggaattcgtctcaccccctagaaaaaagctctatagagcccatcctctgcttcgcataacctagcggcaccagcagctaaccgtccagagaacagaacagagatgaccaccagcgtccccgtccctctggcctcacagtcgcaggcgccgcagcgcaagccacggacctacaccccgagcccatggggtgacttcttcctccaccacaccccatgcactccgtcacagctcttgtcgatgaaggagagggcaaaggtcaaggagcaacaggtgaggcagatcatacaggaaacaatggcctcctccaacctgcttcgcaagttggagcttgtggacacgctgcagcgtctcggggtggactaccgctacaacgaggagatcgaccagttgcttcgctctgtatacgacgacgacgacagggacggaggcggctccgacgatctctacctcacctcgctgcggttgtacttgctcaggaagcatgggtatacaacctcttcagatgtngtcgagaaattcaggaacgagcgcgggagcgtctcgagcgacgatgccggctgcttgctcatgctgtatgacgctgctcatacaagaactcacggggaggagattcctgaacacatcatccgctggaagcaaaagccgcctggaatcccctgctggaaggaaaaaaaacctggaacccagaccttggccaaaaaggggggaggggcccttttgggaaaacaccctccgtttccgggggggggtaaaaaccaagtggggaggccacagcgccctc

SEQ ID NO: 82566 - protein, 181 aa, Zea mays
  misc_feature: Ceres CLONE 1568384
  misc_feature (1)..(147): Pfam Name: Terpene_synth Pfam Description: Terpene synthase, N-terminal domain
  misc_feature: SWISSPROT Homolog: EC 4.2.3.13 (+)-delta-cadinene synthase
MKERAKVKEQQVRQIIQETMASSNLLRKLELVDTLQRLGVDYRYNEEIDQLLRSVYDDDDRDGGGSDDLYLTSLRLYLLRKHGYTTSSDVVEKFRNERGSVSSDDAGCLLMLYDAAHTRTHGEEIPEHIIRWKQKPPGIPCWKEKKPGTQTLAKKGGGALLGKHPPFPGGGKNQVGRPQRP

SEQ ID NO: 82567 - DNA, 824 bp, Zea mays
  misc_feature: Ceres CLONE 1568386
  misc_feature: Encodes the peptide sequence at SEQ ID NO. 82568
ggagctccccgcggtggcggccgctctagaactagtggatcccccgggctgcaggaattcgtctcacccctagaaaaaacacgcgcaagcggcggcaccagtccaccattctcctctcgatccgggatccaacaaatcggccgcctcatcgcgaccctctgtctccatccgctccggcgtgccacccacgcaggctaacgtctgggctcccctccttatcgccgggctccgcatcgccaatagtctgatggcgccgcagttgcagggctgcaactggatctcctcctggccgcggctccagcagatgtctccttggccgcctcgctcctccaaatcgccgcggtggagcttcctgcgtctcgcgacgcgccgacgcccctgcgcaggcgcggtccgcgccgtcgcgagcgcgggcgcggtgggaaccgagctcctggagatggaggagcaggccgaggacgtggacgagagggagaggctcaggcggacgcggatctcactggcgaacaagggtaacacgccatggaacaagggcaggaagcatagcccagagacgctgcagcgaatccgtgagaggaccaggatcgcaatgcaggaccccaaggttaagaaaaagttggtgaatctgggtcatgcacagagtgaggagacacgagtaaggatatcagtgggggtgaggcgaggttgggagtttgcgtctacaaagactaatggtccaagatggttgctttgtggaatggagggacatagtagctgatgcggctagaaagggctttgctggtggagtttcccctgaatggaattcatgataaatattgagtgaa

SEQ ID NO: 82568 - protein, 105 aa, Zea mays
  misc_feature: Ceres CLONE 1568386
MEEQAEDVDERERLRRTRISLANKGNTPWNKGRKHSPETLQRIRERTRIAMQDPKVKKKLVNLGHAQSEETRVRISVGVRRGWEFASTKTNGPRWLLCGMEGHSS

SEQ ID NO: 82569 - DNA, 893 bp, Zea mays
  misc_feature: Ceres CLONE 1568390
  misc_feature: Encodes the peptide sequence at SEQ ID NO. 82570
  misc_feature (422)..(422): n is a, c, t, g, unknown, or other
ctggagctccccgcggtggcggccgctctagaactagtggatcccccgggctgcaggaattcgtctcacccctagaaaagttgttgctgttgttgttgaagacgcgttgctcgctagggttcgtgatttctcgccgatcgattcgggaactggtaagctatggatctctcgcggcccgcatcgtcagacctctcgctcgggctgcactcgcatgcccacgcccacgctcgcgtgcacgcggcagccgcgccgctgcgcctgttcgacgacgcgaagccggagcgcctcgtggccggtgaggccgacgcggagagggacgacggggacgggggcgaccagcacttctccctcctcgggcactccctctgcgtcaagcgcccgcgccgcgccgtcaacggcggtgggggtggggggcggaaaanacgtcatcctgctcgtccacgtcccccggcgctgcgccccgccaagcggcaggcggcggggggaagataagcggcccggattctggagaccccgccgccccgcggtccgctcctgggggcaaccagtcgctgggcggaggcccgacccggatgtgcacctccctgaagggaacaagaacctggccccgccaggtgccggggcatccaagcttattagcgtccgaaaaacttcgttttgccgcggcggggcttgattgcgctcgggagcccccttcaccaaacaaatacttttgagggggggccccggggtgcctcccctcctacgggcggggaatccaccccttcgggtgccttgcaaggcggcttctgcccaaagagcgggccccctcccgggccctggggttctcagaccctggccgtggtgggggggcgtcaacagttggcgccccttacttcgggggacacttcgtg

SEQ ID NO: 82570 - protein, 110 aa, Zea mays
  misc_feature: Ceres CLONE 1568390
  misc_feature (88)..(88): Xaa is any aa, unknown, or other
MDLSRPASSDLSLGLHSHAHAHARVHAAAAPLRLFDDAKPERLVAGEADAERDDGDGGDQHFSLLGHSLCVKRPRRAVNGGGGGGRKXRHPARPRPPALRPAKRQAAGGR

SEQ ID NO: 82571 - DNA, 802 bp, Zea mays
  misc_feature: Ceres CLONE 1568391
  misc_feature: Encodes the peptide sequence at SEQ ID NO. 82572
ctccccgcggtggcggccgctctagaactagtggatcccccgggctgcaggaattcgtctcacccctagaaaaaaaccgagactccgcgtgcgaaccaagcagacccctgcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtctgccactacggcagcgtctgggcacagtccgagaacttccccgagttaaagcctgaggaggttgctgggatgataaaggacttcgatgaacctggaactcttgcaccaactggtctttttgttggaggtacgaagtacatcgtgatccaaggtgaacctggagttgtcatcccaggaaagaagggcactggaggcattactatcaagaaaactggcatgtccttgattatcggtatctatgatgagccaatgactccagagcaatgcaatatggtggtggaaaggctcggcgattacctgatcgaacagggcttctaacggggtgtttggtttgaggaatcactcatccaaaatgtgggtgtgcatcatggatccattcctcaaatttggtgggatgaccccattcctcatattagtactagcttactaacctgaggaatgaggtgaagatggatcaactcatttctgtcgcatacataacaaaaaagtgacgagcgagaagatgattgactagctctttccccaaccaaaagtccataagtttgtcttaaggcaattttggtca

SEQ ID NO: 82572 - protein, 131 aa, Zea mays
  misc_feature: Ceres CLONE 1568391
  misc_feature (2)..(126): Pfam Name: Profilin Pfam Description: Profilin
MSWQAYVDDHLLCDIEGQHLSAAAIVCHYGSVWAQSENFPELKPEEVAGMIKDFDEPGTLAPTGLFVGGTKYIVIQGEPGVVIPGKKGTGGITIKKTGMSLIIGIYDEPMTPEQCNMVVERLGDYLIEQGF

SEQ ID NO: 82573 - DNA, 832 bp, Zea mays
  misc_feature: Ceres CLONE 1568400
  misc_feature: Translation starting site: 128
  misc_feature (432)..(432): n is a, c, t, g, unknown, or other
  misc_feature (593)..(593): n is a, c, t, g, unknown, or other
tccccgcggtggcggccgctctagaactagtggatcccccgggctgcaggaattcgtctcacccctagaaaaacgcttcctcgttcccgcagccgccgcccaaaccctagcaaacccgtcctccgccatggccgacgaccactactcgtccaagcggaagtacgacgacccctcgccgccgccgcggcgcacggggttctcttctggcccgccgcctgcctcgccgcccgctggcggcgccccgtcgtacaacagcgttgcgccgccccccgatgagatccagctcgcgaagcagcgtgcgcaggagatcgcggcgcggatctttaacgccgcagaggccaagcgccctcgcgtcgacaacggcgacgatgacgtcggcggcttcggtggaggaagttccctgggtggcagcggtggtggtggtggtggccncatcgggggcgcaggacttggcttctcgtcctctgccggtggtgggcatggggcttctatcccaccgttatcttctcagagcagtgcaccacagtactcatatggtggacatcagggtacaagcaaaaagattgaaattccaaatgggaggggttggtgtnattattggaaaagctggggaaactattaggtatatcccactttcatcaggagcaaagatttcagttacgagagaccatgaagctgaccctggtgcactgacaaggcaaagtggagctttctgggcatcctgagcagattagcaaggctgaacagttgatcaaagaagttatagcagaggctgatgctgggtcatccggtgcttgtatctgggtgccggaaatacaatgcacacaggcgt

SEQ ID NO: 82574 - DNA, 821 bp, Zea mays
  misc_feature: Ceres CLONE 1568406
  misc_feature: Encodes the peptide sequence at SEQ ID NO. 82575
ctccaccggcggtggggcggccggctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgacccaggtaaccgcaccacgccctcgtacgtcgccttcaccgactccgagcgcctcatcggagatgcggcccagaaccaggtcgccatgaacccccatcacaccgtctttgatgccaagcgtctcatcgggcagagggtcagggatgcgtctggtcagagtggatatcaggttgggcccctccaaggtcatttttggggcctggggagaagcccattgatgttttccaccacaagggtgaagagaaaacatttttccaccttaaaagaactccccctagggggtcttaacaaaaatgggggaaaattctaaaaccttccctttgggacccccaataaaaaaggtgggggggccaaggcccccgccccttctttaagggcccccccagggggggggcccccaaaaggagggcggggggggaattttctcccccctataaagggtgcggggttatattaaaaaaaaaacaaaaaaggggggaggatttttcccccttttggggtttttaacaaaaaagggggccccccttggtgtgggggggaaaaaaaaaatctct

SEQ ID NO: 82575 - protein, 137 aa, Zea mays
  misc_feature: Ceres CLONE 1568406
MAGKGDGPAIGIDLGTTYSCVGVWQHDRVEIIANDPGNRTTPSYVAFTDSERLIGDAAQNQVAMNPHHTVFDAKRLIGQRVRDASGQSGYQVGPLQGHFWGLGRSPLMFSTTRVKRKHFSTLKELPLGGLNKNGGKF

SEQ ID NO: 82576 - DNA, 826 bp, Zea mays
  misc_feature: Ceres CLONE 1568407
  misc_feature: Encodes the peptide sequence at SEQ ID NO. 82577
ctccccgcggtggcggccgctctagaactagtggatcccccgggctgcaggaattcgtctcacccctagaaaaaatccctcccgcacctccgagccgccactcccaagacacagagcgtcagagcccgatcccgatccagcgaggcggcgaccctccctcctccccttgcttcgctcgtccagccctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaaccttggcaagacatgggagaaactgcagcttgcagcgagggttatcgttgccatcgagaacccgcaggacatcatcgtccagtccgcccgcccctatggccagcgtgctgtcctcaagttcgctcagtacactggcgctcatgccatcgctgggaggcacaccctggtaccttcactaaccagcttcaagactccctcaaggaggctgggctgctcatcccttacggacccaaggactggaccatcagccaatttaagggatctgcccgggggaaaatcccccccccttgcccttccggggaaaaggacccctccccagggcgggatgtgcgaaattcgggttccccagggaaaaaaaagaggggaaggaaaaacactttgggaagcccgggttcttgggcttttggggcccaaaaaggggcccccccccaatgagggggggcccctttccc

SEQ ID NO: 82577 - protein, 205 aa, Zea mays
  misc_feature: Ceres CLONE 1568407
  misc_feature (23)..(193): Pfam Name: Ribosomal_S2 Pfam Description: Ribosomal protein S2
MAAAAGGGAVRALSQKEQDIQMMLAADVHLGTKNCDFQMERYAFKRRTDGIYIINLGKTWEKLQLAARVIVAIENPQDIIVQSARPYGQRAVLKFAQYTGAHAIAGRHTLVPSLTSFKTPSRRLGCSSLTDPRTGPSANLRDLPGGKSPPLALPGKRTPPQGGMCEIRVPQGKKRGEGKTLWEARVLGLLGPKKGPPPNEGGPLS

SEQ ID NO: 82578 - DNA, 888 bp, Zea mays
  misc_feature: Ceres CLONE 1568409
  misc_feature: Encodes the peptide sequence at SEQ ID NO. 82579
tggagctccccgcggtggcggccgctctagaactagtggatcccccgggctgcaggaattcgtctcacccctagaaaagggtccaacaccagccgccgccatgtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaatgtgatgcccgccgtcatcgtccgccagcgcaagccgtggcgccgcaaagacggggtctacatgtacttccaagataatgctgggagtggatgtgaatcccagggtggaaatgaaagggttccgctatcacctggacctatcgggcaaggaggggggctgatctttgggcctaaggatggctagcccaaccaaaaccctttgtttgaaaaacttggtgggaaatatttccaaacctccatatggaaccaaccttattaccaatttcgccaaacgggcattggggcctttgtttttgttccccccaattttgggaataaacacaaaattttggtttaccccgggggggttcttttaaacaaagtttggcccccttaaaaaaaaaaaaaaaaaaaaaacaccccccccgatggcccaagaattccccctcgggggccccaaaaacaccatggaacctcccccccccccccccggggggaaaccccccccccttatagagcgcccctaaaaaagggggcgcgccccgtgtaaaataaaccggggtctctactcccagcggggagggt

SEQ ID NO: 82579 - protein, 135 aa, Zea mays
  misc_feature: Ceres CLONE 1568409
  misc_feature (19)..(122): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKKGKPDLRKNVMPAVIVRQRKPWRRKDGVYMYFQDNAGSGCESQGGNERVPLSPGPIGQGGGLIFGPKDG

SEQ ID NO: 82580 - DNA, 822 bp, Zea mays
  misc_feature: Ceres CLONE 1568411
tccccgcggtggcggccgctctagaactagtggatcccccgggctgcaggaattcgtctcacccctagaaaaagactccgacctgctcttgcatatagattgggcagagagtgagagagagagagcgcgcgcgcgcgctcaagggggggccaaaaggagtttttttttaatacagcttcttagcctgaatctctttgatccggagagcagccgccagcccaactaatccttgctgctagcgcgccggggctccgattgcgctccagatctgaggcacctgctcggtggattccaggaatccgagcaccaactcgacagggagagttctcagggtaaagggtgagctccttttccttctccctcctcatccgtccaccgttgccaaaactctgtccgtccgccgctggactggagtagtcgcgctcgcgctcgcgcctgtcttaagctctgattgctagctaatcctcggatgtttgcctctcggtctggttctgccgccgcctacactggaggacgacgcttgatgccacgggacgggacaacgagttggccgcaagtttgtttgacttgaaacgaaccacaacagcttaggggctgtttttttttcttctaacctcctttgattggatcggttgtttccgaaaggaaaagcttaaaacccctttgaaaatttggatttaaaaaccaaccaaccacccacctgggtgcctgaggacctcaaaaaaacccccggggggggggggggggaggggaataaaaaaaagggggggtgccctccccccccgttttatgaaatattttttcgccccctggggggggccc

SEQ ID NO: 82581 - DNA, 857 bp, Zea mays
  misc_feature: Ceres CLONE 1568412
  misc_feature: Encodes the peptide sequence at SEQ ID NO. 82582
  misc_feature (37)..(37): n is a, c, t, g, unknown, or other
ccgcggtggcggccgctctagaactagtggatccccncgggctgcaggaattcgtctcacccctagaaaaaaaaacggccaagggcggcccccatctcttccatcaccgcccccaaatttcaatttcccgcacgctcctcctccgctcctccatcctcaccttctcgccgaaaccaaccgccgcagccgccgccgccatggggggttcgcacagccgcgaggacctcgacctatccgactctgactccgaggacgccgagtccccccggggttccgaacactcctccgactacgggacgcctccccggactgcgtctcctccaagtaacccacggcgcagggcgggtacccccgccctccttaacgccttgagcgcccccctcgccagttccacctgaagttcaacggggccatttccccaaaacccgggggtcggggcccaccccccggggtaaacccccgggggggttaaaaggcgaaagaggggtaccccccactgggggggggccccctcccttccccccaaaggggaatgggtttcgaaaaagggtgtgccgccggccccaattttaaggggcccggggggcggggccccggccaaaggggggctaaccaggataaagagcgcccccccccccccggcggggaaagagggtcccccgggcagggggtcccaaaaatccggggccagggtttgggtccccaaattgtgactaaagggggcccccccccccaaggcccccgggggggaattccctcccccaaaaaggggagggaaggccctcaaagttgcgggaaaccccaaaggggaatgggggaaattttgggcgaaaaaacacaaacgtttatggtggggg

SEQ ID NO: 82582 - protein, 66 aa, Zea mays
  misc_feature: Ceres CLONE 1568412
MGGSHSREDLDLSDSDSEDAESPRGSEHSSDYGTPPRTASPPSNPRRRAGTPALLNALSAPLASST

SEQ ID NO: 82583 - DNA, 814 bp, Zea mays
  misc_feature: Ceres CLONE 1568414
  misc_feature: Encodes the peptide sequence at SEQ ID NO. 82584
ctccccgcggtggcggccgctctagaactagtggatcccccgggctgcaggaattcgtctcacccctagaaaaattacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggttttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgtttcacgtccctcgcgagctcccgcccgacagcttcggcccctacatcatctccatggcgacggcccccctcgacgtgctcgccgtggagctcctgcaacgcgaggtgcggggtgccccagccgcctgccctgggtgcgcttgttccaaaaggttggcccaacctgaattcgggggccccggttcctggggagacccccctttcccgggggaactggtaaactgggaccgggattaaaggggaaaacaccaggggtttg

SEQ ID NO: 82584 - protein, 60 aa, Zea mays
  misc_feature: Ceres CLONE 1568414
MATAPLDVLAVELLQREVRGAPAACPGCACSKRLAQPEFGGPGSWGDPPFPGELVNWDRD

SEQ ID NO: 82585 - DNA, 844 bp, Zea mays
  misc_feature: Ceres CLONE 1568419
ctccccgcggtggcggccgctctagaactagtggatcccccgggctgcaggaattcgtctcacccctagaaaaactttttccccttcacagccccgtactactatccccgctaccgctagccgccgcgctgctctctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgccctcccgtttcttcgttggggatctcgctcgcttcgcgccatgggcgccgtcgcgacgccaccggccccccgcgccccgcggcggccggcacccgcaacgggcacggggctgctgcttcggctccccgtaaccctcccccctggccggggaacaaaaccaaggaacctgctccaaaaattggcccctggaattcccaaccccaaggggggggggggggcaaaaaaaaccctgcttttttttttcccctttgcccgcaaaaaggaaagggggcgttggaaaaaaaccaaccccctctaaaatgggtgcccatccccccccaaaaaagaggttcttaacaccccgggggggctttcagggacttttttgtggaccccaaacccggtttttatatcacccccgggtattatttaatggggaggggccccaaaatttctgtgtgaggggaggggggaatttttttcccaaaaattcttaaatttccaaaggggggggggaagaggcccccaccgggggggggggaaaattttttgtggagg

SEQ ID NO: 82586 - DNA, 969 bp, Zea mays
  misc_feature: Ceres CLONE 1568420
  misc_feature: Encodes the peptide sequence at SEQ ID NO. 82587
  misc_feature (376)..(376): n is a, c, t, g, unknown, or other
ctccccgcggtggcggccgctctagaactagtggatcccccgggctgcaggaattcgtctcacccctagaaaaaagatccctcccgcagtctcgcgcgctctcccccacccacccaccccctatccatccatccatcccacctcctgctccacatcctcccctccgcccaccaacgcagcagcagccagcagccccgccacttcccccctcgccgcttgcgatggcggtcacgcgcgtcgccgtggccgccgacctctcggcggccccgatctcctcccgacgccaccgggttgccctaccctccgcctgacgccttctccccgcctcggccacctgctgcaacaaccgcgcgccgatgtctctgcaagccagcgncggccaaacctggccccccgacccggtgaaagaaggagactcctgaatccctcccctccgacaagatgctaggcaagggggggggaaaaacctgggtgatacatcgggctcagggaaccaacccgggttacccccggctgccattcctaaggccgccccggggggaaaacctgaaaagccctgaggggggttttgaaagggtgggccacgaaaaggggggggggtggccccccggggcgggggcaaactttgaatgaacccccctcaccccgaaggaggggggagaaaatttgcccctggggactttccccggggaagggggaaaaaacccgggggcccggatttccctcgtggggaaaaaaaaaagcgcccaaacacaaagcgggaaaaaccccggggggggccgcaaaaggcgttttgcccaaaaaagggaaagttgagaacttttggggaaatgttaaaaagagggcccccccctttgtgttattttcctaagcacccgccacccggagagggagaaaagggcaaaaaccctaaatatttggcaaacggggggggttaaaggaaaaaaagcccctcgctaatgcgccaaa

SEQ ID NO: 82587 - protein, 63 aa, Zea mays
  misc_feature: Ceres CLONE 1568420
MLGKGGGKTWVIHRAQGTNPGYPRLPFLRPPRGENLKSPEGGFERVGHEKGGGWPPGAGANFE

SEQ ID NO: 82588 - DNA, 816 bp, Zea mays
  misc_feature: Ceres CLONE 1568421
  misc_feature: Encodes the peptide sequence at SEQ ID NO. 82589
  misc_feature (477)..(477): n is a, c, t, g, unknown, or other
  misc_feature (509)..(509): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (519)..(519): n is a, c, t, g, unknown, or other
  misc_feature (530)..(530): n is a, c, t, g, unknown, or other
tggagctccccgcggtggcggccgctctagaactagtggatcccccgggctgcaggaattcgtctcacccctagaaaaatttttctcctctcctctcccctcccctcgctcgttcgtcgcgtcctcctcagatcaacaaaccgtgtcctgctgcctctggaaaccaccgggggatcgccccgccctttccttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaagcggaagtcatgcatcaggcccccgtgccggtgctggaggtgcagtaccaccggcgcgcgacgaccaagggggttgacgacgtcgtcgggatgtccgcgcccgcccccgncgaggttggggtgggtttgggggttaaggccnaanncnaagnccaaacccccngggcagggcccccgcaggggggcgggaaaaagcggagtccccccccgggggaacccaggggcactcgacacggggggtgggagcccaaacccccttccgggtgggtttacccaaaacctgggctctcggagggtaatgggggaaacagccgcgtcccactgggggatctcctcctcccccctatgggagataaaattttggtgtacccgcccagagcccgaacccctctttaatgggagggttttgaaaacgccctgcggaggtgccaccaccaaaacgctttcag

SEQ ID NO: 82589 - protein, 135 aa, Zea mays
  misc_feature: Ceres CLONE 1568421
  misc_feature (41)..(41): Xaa is any aa, unknown, or other
  misc_feature (52)..(52): Xaa is any aa, unknown, or other
  misc_feature (53)..(53): Xaa is any aa, unknown, or other
  misc_feature (54)..(54): Xaa is any aa, unknown, or other
  misc_feature (55)..(55): Xaa is any aa, unknown, or other
  misc_feature (59)..(59): Xaa is any aa, unknown, or other
MVAEAEVMHQAPVPVLEVQYHRRATTKGVDDVVGMSAPAPXEVGVGLGVKAXXXXQTPXAGPPQGGGKKRSPPPGEPRGTRHGGWEPKPPSGWVYPKPGLSEGNGGNSRVPLGDLLLPPMGDKILVYPPRARTPL

SEQ ID NO: 82590 - DNA, 864 bp, Zea mays
  misc_feature: Ceres CLONE 1568422
  misc_feature: Encodes the peptide sequence at SEQ ID NO. 82591
ctccccgcggtggcggccgctctagaactagtggatcccccgggctgcaggaattcgtctcacccctagaaaaagttcacggccctcgccaaatccccaaaatccaagcgcgtcgccgacggcattgcgtcgccattgcctccaaatccgtgtgcgactcgcgtgatcccagatcccgctcgccgtattccccgcagtgacctctgaccagagcattttccgcgcggaaaatgccgccgtttcggccggctcttggaagggcgcttcttctgtaggaccgcggcgcgaggctgcgatggcgttcgccgccagcgagggaaatctttccccggcgctgcccctggccactctgatcggccgcgagctccgcggcgacggtaccgagcgcccgcacgtgcgctacggccactctggcttcgccaagcgcggcgaggactactttcctcgtcaagcccgactgcctccgcgtccccggaaacccttcctcctcttttctccgtcttcgctgttatccaacgtccacaatggcgtggcgggcggcggggttcacaaagaaaaaattgctgggaacacttgattgagccggggccccaagggctcaatcccgaagaactggttaaaggggcctcccccccccccccttcccaggaatcccccaaaaaaaaatttgacttcccccccagggggggaaactcagggaacaaccggcaaacccttggtgggggggaggggggtcccgggcccttttcccgggggggggggaatttcaagggccctctcgggaaaacaggggggggggggcccctttttttttttggggatacccccccctaaagaaaataaaaaagagagcgcggcgccccc

SEQ ID NO: 82591 - protein, 93 aa, Zea mays
  misc_feature: Ceres CLONE 1568422
MAFAASEGNLSPALPLATLIGRELRGDGTERPHVRYGHSGFAKRGEDYFPRQARLPPRPRKPFLLFSPSSLLSNVHNGVAGGGVHKEKIAGNT

SEQ ID NO: 82592 - DNA, 716 bp, Zea mays
  misc_feature: Ceres CLONE 1568432
  misc_feature: Encodes the peptide sequence at SEQ ID NO. 82593
ctggagctccccgcggtggcggccgctctagaactagtggatcccccgggctgcaggaattcgtctcacccctagaaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcgggcggcgattgggacccgcgaacgctctccgacccccggtccacgggggaccacggcgggggcaggggtccctccccccaagccccgaaaaaggccctttttcaaaaaaagggcccggcgggttaaaaaaaatttcccccgggaaaaaaaaaggggggggggaaaaaaaacctttgggggggggggaaggaaaaaaaaaaaacccccgaaacccccccttttttttttttggggggggggaaaaaaaaaaaaaaaaaaggggggcccccccccccccctccccccctagagggggggggaaacccccccccccaagggagggggggggggggggcgccccccccccccccggggggaaaaaaaaaaaaaaaagggtcctcttaaaaaaaaaaaaacaagagacccggcccggggggggggg

SEQ ID NO: 82593 - protein, 47 aa, Zea mays
  misc_feature: Ceres CLONE 1568432
MTTSTAGGDWDPRTLSDPRSTGDHGGGRGPSPQAPKKALFQKKGPAG

SEQ ID NO: 82594 - DNA, 784 bp, Zea mays
  misc_feature: Ceres CLONE 1568436
acccgcggtggcggccgctctagaactagtggatcccccgggctgcaggaattcgtctcacccctagaaaaatctatcttctcttcctcccgagcgcccaggccctctccttcctctccagccgcggcatcacctgctccctatttcctgctcgcgctccttgcttcttccttcctcgtggcgattcctctgctcatctctacggccgaccgcacggctcccatggcgctgcgtccagctccctccggctgctcggcgcccagccgaactcgctccctgcccagctcgcggatcttctccctgctcaggatcctgttcgcggagttcccatggcacttggccgagcgatttttccggtctccctccctgcgcacggtcaccaccgtccgagctcgccccggccccttcgctcctcccatggcgagctcgccggggatgcccctgtcccagctcgctgcgccgtgctcggtcccgggctcatctgctgcacgcggccctcaaccaccatcttccaggcgtcttcttccctgcgcgcggcatgagctcgccggagtccctcccctgctcggcgcgctcccggccctggctctctgctgcgcgtcggcttgctgctttggctctgccctgtcgtcctgggcgcggtctcaccctgctgtttcagcgctgcggcttcccagctcgccgcggcctggtcccttctagctcggaatccccccatcacgggaaacgtcttatctaaacttgtttcgcccaagccaactaatcgtttctaatacccggcaaa

SEQ ID NO: 82595 - DNA, 868 bp, Zea mays
  misc_feature: Ceres CLONE 1568438
  misc_feature: Encodes the peptide sequence at SEQ ID NO. 82596
  misc_feature (868)..(868): n is a, c, t, g, unknown, or other
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagcccaacaggaggccgcccctgtgacgatcgaggacgtggacctcagctctcatcaggccgcggccgacaacggggagctcgccgcgcggtggcgggaggtccacggcagcaacaacggggaggggctgctggaccccatcgacggggtgctcctccaggagctcatccgcttacggcgagttcgcccaggccacctaagacggcttcgactacgaccgcttctccccctactgggggggcttggaagaccccggggaaaaccttttttccccaaggtggggcttcggcggggatcgggttacaaagggcaccctctacctttaggccacccgggaaaggacctccagggtccccaaacttggggatcaagaacgggcggcccaaacccacaaattttggggcggagacccgggccggtccctggggggaccggtggccgggggcaacccgacagaggaaaaacgggcctcccn

SEQ ID NO: 82596 - protein, 207 aa, Zea mays
  misc_feature: Ceres CLONE 1568438
MAATVSSCLSLVPTVHHRAGGFPSSVALTNTLQRRRRSRRYLVVASATRAQQEAAPVTIEDVDLSSHQAAADNGELAARWREVHGSNNGEGLLDPIDGVLLQELIRLRRVRPGHLRRLRLRPLLPLLGGLGRPRGKPFFPKVGLRRGSGYKGHPLPLGHPGKDLQGPQTWGSRTGGPNPQILGRRPGPVPGGTGGRGQPDRGKTGLP

SEQ ID NO: 82597 - DNA, 830 bp, Zea mays
  misc_feature: Ceres CLONE 1568445
  misc_feature: Encodes the peptide sequence at SEQ ID NO. 82598
  misc_feature (379)..(379): n is a, c, t, g, unknown, or other
ctccccgcggtggcggccgctctagaactagtggatcccccgggctgcaggaattcgtctcacccctagaaaaagagttgaaattgggatatataaaatctccaccacctccgaccctcctgtcccgctcctcttctatctgttcgtttacagcccccagctcatcaaagatcacatttttgggcactgctatataaacaaagttggcaggagtcgtagattagcaggccgcccgtctatatttttttttcatgttttgaaagtgaaggaggatttgggtgggcaacgtctacctctgccaaaaataatcagcgtccatatgcaagcgtcgtatctttggaataagtgaataccatgcagatggcaggcggcggattcntggaggacatgaacatgatgagggagcagagcctcctcgaggcgacgtgcggcgacctcttgcgacacatcgacgacctcctcgacttcacaacgaggactccgccgcccgcgtgctcctcctggacgcgccgcgccggggagcccgctgtcggcgcgcatcatcaacgtcggccgcgcgggaaatgcgtcgccccccctgtggccccgcgcaagaaaacgcttccaggtagggcttctttcgccgccgggggaaactatgttttcaaaccaaaggagtttttcgggggcaaaattgggtttgggggaaaaaatttaaatggaaaaggggccaaatgggagggggtttgaggggttctttaaaaaacccctccttccccaaaaaaaccgggtttccctgggcccaccggggggggggggcccggccccctttagagaaaatcccccccccg

SEQ ID NO: 82598 - protein, 124 aa, Zea mays
  misc_feature: Ceres CLONE 1568445
  misc_feature (9)..(9): Xaa is any aa, unknown, or other
MQMAGGGFXEDMNMMREQSLLEATCGDLLRHIDDLLDFTTRTPPPACSSWTRRAGEPAVGAHHQRRPRGKCVAPPVAPRKKTLPGRASFAAGGNYVFKPKEFFGGKIGFGGKNLNGKGAKWEGV

SEQ ID NO: 82599 - DNA, 871 bp, Zea mays
  misc_feature: Ceres CLONE 1568447
  misc_feature: Encodes the peptide sequence at SEQ ID NO. 82600
  misc_feature (697)..(697): n is a, c, t, g, unknown, or other
ccccgcggtggcggccgctctagaactagtggatcccccgggctgcaggaattcgtctcacccctagaaaaagcatttttctatccccgcgtggccgcgtgtagtcctagtctctcgccagcaccatcatcatcaatcacggcggcgaccccgccccgcctcgatcgcccacgctgcccgactggaaccggacgctgctgctgctgctgctgctagtaggctgacagcgacgacgagggggaggacgaggcgaggggagccatggctcagatcttgctccacggcacgctccatgccaccatcttcgaggccgagtcgctctccaacccgcaccgcgccaccggcggcgcccccaagttcatccgcaagcttgtggaagggattgaggataccgtgcgtatcggcaagggcaccaccaagatatacgccaccgttgatctggagaaggcccgcgtggggcgcacccggatggtctccaacgagcccgtgaaccctcgctggtacgagtccttccacatctactgcgcgcacatggccgccgacgtagtattcaccgtcaagatcgacaaccccctcggggcctcgctcatcgggaggggcttacctgcctgtcgaggacatccctgggcggagacgagatcgacaagtgggctgagatatgcgatgaaaaagcgcgagcctattgggggacagcaangatccacggtgaagccttcagtaccttccacgtccggcaaggaacgcaaacggggccaggggggggtccgggacccccaaagtaccccggtggttcctttaacacctttcttcttcccaaaaagggcgggggttgccaagggttactcctggaaccaaggaacgcctcaatgtt

SEQ ID NO: 82600 - protein, 203 aa, Zea mays
  misc_feature: Ceres CLONE 1568447
  misc_feature (10)..(114): Pfam Name: C2 Pfam Description: C2 domain
  misc_feature: SWISSPROT Homolog: EC 3.1.4.4 Phospholipase D
  misc_feature (146)..(146): Xaa is any aa, unknown, or other
MAQILLHGTLHATIFEAESLSNPHRATGGAPKFIRKLVEGIEDTVRIGKGTTKIYATVDLEKARVGRTRMVSNEPVNPRWYESFHIYCAHMAADVVFTVKIDNPLGASLIGRGLPACRGHPWAETRSTSGLRYAMKKREPIGGQQXSTVKPSVPSTSGKERKRGQGGVRDPQSTPVVPLTPFFFPKRAGVAKGYSWNQGTPQC

SEQ ID NO: 82601 - DNA, 855 bp, Zea mays
  misc_feature: Ceres CLONE 1568448
  misc_feature: Encodes the peptide sequence at SEQ ID NO. 82602
ctccccgcggtggcggccgctctagaactagtggatcccccgggctgcaggaattcgtctcacccctagaaaaagcccccctcccactgctgctacttctagaagcgctggtggcagggcaggcggtatcccggccgctggcgctggcgcgagagttggttggtggtggtgttcagcccccctccctcttcaggtttagggtggagcgatccgtgcaggccaacgcggggtgcgtgacccagaaagggaaaccgccgccttttttctcttctgccgccccgcttttccaatccctcctcaacctcatccgccccgcccgcaccatcaccaaaaaggtccccgccttcttcttcctcttctcctctgcccctgcttgtcgtttgctcgtgctcccccaccccctttctgattcagccagtgttccttccgcggcgcggcgcgtcgccatgggcaactgctggggcgccaagatcagctccgacagcccctcccgcggcgcctcctccccgtcagggacggcgtccaagttggcgagcaggaacggggcggctgcagccctgatcaggtgcagcaaccacgcgtcttcccccttcattgctggccgaccccccgccagcaaggacgagaatcctggaatccggccaaacctcagggacctttcggcttcaaccgagcttgagggaccgccctccaaggaacattcagggccaggaaaagtctgtccttggggccaagggccggggttccgaaaatccgttcttccaaaggggttgggggtcccactgaaataaaaccactccctccccccgcccttagggccccacagggacacgggggaaatggcggccaatttgc

SEQ ID NO: 82602 - protein, 114 aa, Zea mays
  misc_feature: Ceres CLONE 1568448
MGNCWGAKISSDSPSRGASSPSGTASKLASRNGAAAALIRCSNHASSPFIAGRPPASKDENPGIRPNLRDLSASTELEGPPSKEHSGPGKVCPWGQGPGFRKSVLPKGLGVPLK

SEQ ID NO: 82603 - DNA, 870 bp, Zea mays
  misc_feature: Ceres CLONE 1568449
  misc_feature: Encodes the peptide sequence at SEQ ID NO. 82604
ctcccatgcggtggcggccgctctagaactagtggatcccccgggctgcaggaattcgtctcacccctagaaaaaaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcatcgttttgaatttgatgtactaatggagtctaagggtggcaagaagtctagcagtagtcgttccatgatgtatgaagctccccttggctacagcattgaggacgttctacctgccggaagcgcgaagaagttccagtctgctgcttactccaactgcgcaaagaagccatcctgatatcccttttggcttcctcgttctagtagtttaggatttcttttctgacacttcgattcttaccgatccccctggcctgctgctttcctgacaatcgaccagttccccagtcttgctccctgcagtcctccctcctacatctcccggagttgggttcctgactcaacttgcaccattggcttgttcttttctgcctgcttggtgcctccccccgggcctcagcctttcggggtttggaggggctattgaggaagcccccttggagaattaccatttcctctggaggggaacctggtccttttgtggggaacccccgcatgggaaaaccgaggttttggcggtgggccccttctcccaagggtgcccacaagaatttggacctccg

SEQ ID NO: 82604 - protein, 50 aa, Zea mays
  misc_feature: Ceres CLONE 1568449
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVLPAGSAKKFQSAAYSNCAKKPS

SEQ ID NO: 82605 - DNA, 793 bp, Zea mays
  misc_feature: Ceres CLONE 1568452
  misc_feature: Encodes the peptide sequence at SEQ ID NO. 82606
  misc_feature (366)..(366): n is a, c, t, g, unknown, or other
  misc_feature (673)..(673): n is a, c, t, g, unknown, or other
ccccgcggtggcggccgctctagaactagtggatcccccgggctgcaggaattcgtctcacccctagaaaaagctccccccacctcacctcgtcaaccccctccttggatagggttagagttcccccggcacgagcgcgagccatggcctccttcacctgctcccaggtcggcgctgcggcagcgggcggagcctcgcccttcctcggctaccggcggcggagcggccccgggggcgccatcccgtcgagctccctcttcgtgggccggcggttggcggcggtgcggatgcgcgcgccctctcgcggggtccgcgggggctccgcgctgcgggtcacgtgcgagaaggtggtggggatcgacctangcaccaccaactccgcggtcgccaccatggagggcggcaagccgaccgtcgtcaccaacgccgagggcgcgcgcacaactgcctccgtagtggcgtacaccaagacaggggagcgcctggtggggcagatcgctaagcaccatgcggtcgtgtacccccgagacaccttcttctctgtcaagcgcttcatcggccgcaagatgtctgaggtcgacgactaagaccagcaggtctcgtacggcgttgtcaaagacgagtacggcaacgtcaaactcgactgccccgctattggcaaacagtttgctgncgaggagatctctgcgcacgttttgaaggaagttggtcgatgatgcatctaaggttcttaatgagaaaatacaaaagccggggttcagtaccagcatacttcaattgatcacaaagacca

SEQ ID NO: 82606 - protein, 147 aa, Zea mays
  misc_feature: Ceres CLONE 1568452
  misc_feature (75)..(75): Xaa is any aa, unknown, or other
MASFTCSQVGAAAAGGASPFLGYRRRSGPGGAIPSSSLFVGRRLAAVRMRAPSRGVRGGSALRVTCEKVVGIDLXTTNSAVATMEGGKPTVVTNAEGARTTASVVAYTKTGERLVGQIAKHHAVVYPRDTFFSVKRFIGRKMSEVDD

SEQ ID NO: 82607 - DNA, 816 bp, Zea mays
  misc_feature: Ceres CLONE 1568454
  misc_feature: Encodes the peptide sequence at SEQ ID NO. 82608
ctccccgcggtggcggccgctctagaactagtggatcccccgggctgcaggaattcgtctcacccctagaaaaaaccgtccctcaccgccggcctctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcaagcgaactccctccccttgatgttccactcccaggcattagcattccctcacctctaccagattttgtagagccatctaagacaaaagtcactactcttccaaatggcgtcaagatcgcctcggagacatcatcgagcccagcagcatctgtgggtctgtacattgactgtggttccatttacgaaacacctgcttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaaattctaattgacaaggtgaggaaaccagcattccctcgattggggaggtcaaagagccagctccagaaacataaaatctgaaaatagcctgaatgcgtctgctaatcccttaaagtactaccttctggaaggccccttcatttcgggttggaataattcccgggggcacccgggca

SEQ ID NO: 82608 - protein, 193 aa, Zea mays
  misc_feature: Ceres CLONE 1568454
  misc_feature (80)..(194): Pfam Name: Peptidase_M16 Pfam Description: Insulinase (Peptidase family M16)
  misc_feature: SWISSPROT Homolog: EC 3.4.24.64 Mitochondrial processing peptidase
MYRAAGSHLRSLKHHGASRLASTSVAKQSSGGLFSWLLGGKSSELPPLDVPLPGISIPSPLPDFVEPSKTKVTTLPNGVKIASETSSSPAASVGLYIDCGSIYETPASSGVSHLLERMAFKSTVNRTHLRLVREVEAIGGNVSASASREQMSYTYDALKSYTPEMVEILIDKVRKPAFPRLGRSKSQLQKHKI

SEQ ID NO: 82609 - DNA, 980 bp, Zea mays
  misc_feature: Ceres CLONE 1568455
  misc_feature (980)..(980): n is a, c, t, g, unknown, or other
acccgcggtggcggccgctctagaaatggtggatcccccgggctgcaggaattcgtctcacccctagaaaaaagctcacggcctcacccgtccacccacccactcgcctcgcctccatccacagcgaccacgcccatcttcgctctgtccgctcacccccacctctccgcccccgtctccgtccgcagccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgactgagcgcgctacatatcagctcatcaaccggcgggaacgctgtaccgtcggttggacgccctgagcgtgcagagcaattaaacaaaggcaggggctggggtaaatcacttattgaaaaacatctcccccttttacatggtaaccgtagaatacaagtatctggttagagacgtagttcaccgaaaacaaaagttgggtggtcaaactagggggaagattgcctgggtcccagtcgctttggcgtaggtaaaagggacatcgatcgatttaaaaactccccagataggcacgccggggaaggttgtggtaaccccgagccaattttgggggaaagaccccttcctttgttggggaattaatggggtaaccagggttccccggggcataaagggcgggaaattttgcggggggggggtccctctggtggggaaaaaaacgagttggcttaggaatggggggccggaaagccaccttcaaaactcctttatatgagcgctccgaatgggaggagaggggacccgcacagggtttgtggggcgaatgaggcggccctccccgggaataaatgtgttattcccacaaaccttggacgttttgtgtgaggaatacagggtggaaacaagggggcctcggatctggtgcctcn

SEQ ID NO: 82610 - DNA, 860 bp, Zea mays
  misc_feature: Ceres CLONE 1568456
  misc_feature: Translation starting site: 252
  misc_feature: SWISSPROT Homolog: EC 2.6.1.62 Adenosylmethionine--8-amino-7-oxononanoate transaminase
  misc_feature (396)..(396): n is a, c, t, g, unknown, or other
ctccccgcggtggcggccgctctagaactagtggatcccccgggctgcaggaattcgtctcacccctagaaaaatctccgcgaacctcgcgtcctcctcgcctgcctgcctacaagtctcccccctcccctcccatcccctccccgtgcctccctcgggcctcgcttctcgcgctcttcctctcttgcctccgcctgcctccaggctccaacaacccgggagggcgccgtccgcccccgcctccgggagcgatgatgatcgcgcgacgcctgctccgacccaatgcccccgcccaggcaagcagcttattgaagcatgtaactggcaccgcaagtttgcaaggctatgcggatagcttgttggatgcgacagtcagacattttggttcagcacccnctgcccagcctgaagaaaatgggttcaagggccacggcatgctggcgccttttacagctggctggcagagcaatgatttgcaccctctgatcattgagagatctgagggttcctatgtctatgacattaatgggaacaagtatctggactctcttgcaggattatggtgcacagcttttaggtggtagcgagccctcattagtcaaagcagctactgggcaattaaacaaactacccttctaccattccttctggaaccgtacaacaaaaccttcggtgggatctggcacaggagatcctttagcatgtttccctggaaggggagatgggggaaaagttttctttcccaaacaggggggtcccgaaagcaaaagggacttcctccggggccaaacctgggtaggggggttttttaaccaaattgggtttggggggagggcccaacaccaggaaaggaatttttt

SEQ ID NO: 82611 - DNA, 795 bp, Zea mays
  misc_feature: Ceres CLONE 1568458
  misc_feature: Encodes the peptide sequence at SEQ ID NO. 82612
  misc_feature (396)..(396): n is a, c, t, g, unknown, or other
ctccccgcggtggcggccgctctagaactagtggatcccccgggctgcaggaattcgtctcacccctagaaaaaacacaagtctgaacgcttgaacctgaacctccaaagcagcaaccccagcagctttagctcctcctcatcgcagccgcagcgccgtcccctactcttcctgcgaccaactgctgtctctccggcgacggcagaaccgtctctgcaggtgcagggagggacccgggagatgagtctggggctgctcaacacagagcgcaaccaccttctctccccgaagccgcagagccctcgggatgccgccgtgtcgtcgctgctgaggtcacccagggcgtcctgcggctcctgcagccagagccccaagccgaagcccaccaagacggcncacggcggcctggagcgctcgctcagcttcaagaactgggaggcggacgacagccggggcggcatcaacggagcgcgcccgggcgccctggcgctgcagcagcatgagagcccccggcgcgtggtctccgtgtccccgcaggcgcaggccatgatcgagtacatctcccctcgcccacgcgtggagctggaccaggcgggcaccacgctgcagaagatgtacaagggcctgcgcacgcgccgcagcctcgccgacggcgccatcatcgccgaagagctgtggtggagacggtcgactcggtgtacctcacatcaagtccatctccttcttcgaacaagaacagcagaagaccgccgcgtcccgctgggtcagggccggcaagaagatcgccaaggtcgg

SEQ ID NO: 82612 - protein, 185 aa, Zea mays
  misc_feature: Ceres CLONE 1568458
MSLGLLNTERNHLLSPKPQSPRDAAVSSLLRSPRASCGSCSQSPKPKPTKTAHGGLERSLSFKNWEADDSRGGINGARPGALALQQHESPRRVVSVSPQAQAMIEYISPRPRVELDQAGTTLQKMYKGLRTRRSLADGAIIAEELWWRRSTRCTSHQVHLLLRTRTAEDRRVPLGQGRQEDRQGR

SEQ ID NO: 82613 - DNA, 860 bp, Zea mays
  misc_feature: Ceres CLONE 1568460
  misc_feature: Encodes the peptide sequence at SEQ ID NO. 82614
acccgcggtggcggccgctctagaactagtggatcccccgggctgcaggaattcgtctcacccctagaaaaaacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaataccttcaagttgcacagattgcctgtcccaagccctggtcaggttttgggccttgttggaacaaacggggattggaaagtcgacagcttcttaaaagggttggctgggcaagctgaaaacgtaacttgggggcgcttcaaaaaccccacctggatgggcaggaaattccttacattactttcgtggggtctgaactttcaaaaactccttcccccgcatattgggaagaatacctgaaaggcgattcctcaaaaccctcagattgtttgaccacaattccaaaaaagctgtttcaaggggaaatggttggaccaagttaccttgaaacccaagggacctaaaggggaatatgaaaaaccctgaacccggggggggttgaatccttgaaatttaaaccccaagttttttgggaccggaaaatggtgtggaaaatctctttgtct

SEQ ID NO: 82614 - protein, 168 aa, Zea mays
  misc_feature: Ceres CLONE 1568460
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
  misc_feature: SWISSPROT Homolog: EC 1.2.7.7 3-methyl-2-oxobutanoate dehydrogenase (ferredoxin)
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPSPGQVLGLVGTNGDWKVDSFLKGLAGQAENVTWGRFKNPTWMGRKFLTLLSWGLNFQKLLPPHIGKNT

SEQ ID NO: 82615 - DNA, 866 bp, Zea mays
  misc_feature: Ceres CLONE 1568461
  misc_feature: SWISSPROT Homolog: EC 3.2.1.21 Beta-glucosidase
  misc_feature: SWISSPROT Homolog: EC 3.2.1.147 Thioglucosidase
  misc_feature (866)..(866): n is a, c, t, g, unknown, or other
ctggagctccccgcggtggcggccgctctagaactagtggatcccccgggctgcaggaattcgtctcacccctagaaaaaacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatccggaaaggatactggacgggagcaattcagacattggaagcgaattcgtaccatatgtacaaaaacgacgtcagattgctcaaggaaatgggcatggacgcatataggttctctatctcttggcccagaatactgccgaatgggaacaaaagaaggaggtatttaccccggaatggcatcaagtactacagaaacctcctcaaacttgtttgctagaaaaacggcattaaagccttttggtaacaattttcccacctggggatgggaccctccaagcccctagaaaaaaaagggtacgggggggcttccctgagaataaaaatccactaagaaggccttggtaaaaagaaattaaaccctaccttttggcctaaggggggtcgcttn

SEQ ID NO: 82616 - DNA, 797 bp, Zea mays
  misc_feature: Ceres CLONE 1568464
  misc_feature: Encodes the peptide sequence at SEQ ID NO. 82617
  misc_feature (498)..(498): n is a, c, t, g, unknown, or other
ctccccgcggtggcggccgctctagaactagtggatcccccgggctgcaggaattcgtctcacccctagaaaaaagctagtccatatgtttgcgtcgcggaccaccactccacaatacacaaagcggctgcggatgtgagtagtataaagaaagcgatgaggcgccaggccggtagccaaggatcgagtcgtttaattttctactaggagctagcagcgagcgggttatttgcaacgacggcatcgtcttggcgttggcgggcgtgtttggcaccatgggcgactactactacagccgccgctcgccgcacctcctcccggcggcggtgctggcgctgctcgccgtcgtcgtcgtcgtcgtcgcgagcagcagcctccggggtgcggcggcggccgcgggcgcgggccggaatgtgatcacgcacatcaagggcttcgaaggccctctgcccttcccactcgagacagggtacgtggaagtggacgaagagcacggcncgcggctcttctactacttcatcgagtcggagaagaacccggcggaggaccccgctcatcctctgggatcaccggtggcccccggatgctccgcgctctctggactcctcttcgagatcggacccctcaaggtcgatgttggcgggtacacggaagggttcccgcagctggtctacttcgaggatcatggaccaagtgagcaacgtgatcttccttgacccccagtggggacaggctctcctactcgcggaaggagcccgcctgaacgtgacctgacggagtcgggcggaacccccctg

SEQ ID NO: 82617 - protein, 146 aa, Zea mays
  misc_feature: Ceres CLONE 1568464
  misc_feature: SWISSPROT Homolog: EC 2.3.1.92 Sinapoylglucose--malate O-sinapoyltransferase
  misc_feature (75)..(75): Xaa is any aa, unknown, or other
MGDYYYSRRSPHLLPAAVLALLAVVVVVVASSSLRGAAAAAGAGRNVITHIKGFEGPLPFPLETGYVEVDEEHGXRLFYYFIESEKNPAEDPAHPLGSPVAPGCSALSGLLFEIGPLKVDVGGYTEGFPQLVYFEDHGPSEQRDLP

SEQ ID NO: 82618 - DNA, 878 bp, Zea mays
  misc_feature: Ceres CLONE 1568465
  misc_feature: Encodes the peptide sequence at SEQ ID NO. 82619
  misc_feature (498)..(498): n is a, c, t, g, unknown, or other
ctccccgcggtggcggccgctctagaactagtggatcccccgggctgcaggaattcgtctcacccctagaaaaaaccaccaactcgcgatccatcgatttgcagaacaccacccaacagccaaaccatcactcgatcggtagacatggataaggcctacatcgccgccctctccgccgccgccctcttcttgctccactacctcctgggccggcgggccggcggcgagggcaaggccaaggccaagggctcgcggcggcggctcccgccgagccctccggcgatcccgttcctgggccacctccacctcgtcaaggccccgttccacggggcgctggcccgcctcgcggcgcgcccacggcccggtgtctccatgcgcctggagacccggcgcgccctggtcgtgtcgtcgccggactgcgccagggagtgcttcacggagcacgacgtgaacttcgcgaacccggcgctgttcccgtcgatgcagctggcgtccttncaccgccccatgctcttcgtgtccagctaccgcccgtactggggcaacctggccccgtcgcccccgtgcagctccccttccgcccacgcgttcgggggcatggcccccccccaataaaacccaggggcccccccttggggcgaaagaaagaaaccgccccccccgggccgggggggggggggttccccgccgccccatttaaaaggggggggttttcaaatctctcccccggggggcccatgggaacccttcccccacacaaaaaccccccccgccccgggccccaacccccacctcagaatttgtcacccaggggccccccgaatttcaagaaaattgtgtaaaaaaaatccgtgggccataattagtgccgccgccca

SEQ ID NO: 82619 - protein, 156 aa, Zea mays
  misc_feature: Ceres CLONE 1568465
  misc_feature: SWISSPROT Homolog: EC 1.14.13.89 Isoflavone 2'-hydroxylase
  misc_feature (118)..(118): Xaa is any aa, unknown, or other
MDKAYIAALSAAALFLLHYLLGRRAGGEGKAKAKGSRRRLPPSPPAIPFLGHLHLVKAPFHGALARLAARPRPGVSMRLETRRALVVSSPDCARECFTEHDVNFANPALFPSMQLASXHRPMLFVSSYRPYWGNLAPSPPCSSPSAHAFGGMAPPQ

SEQ ID NO: 82620 - DNA, 943 bp, Zea mays
  misc_feature: Ceres CLONE 1568467
  misc_feature: Pfam Name: SKIP_SNW Pfam Description: SKIP/SNW domain
  misc_feature (943)..(943): n is a, c, t, g, unknown, or other
ctccccgcggtggcggccgctctagaactagtggatcccccgggctgcaggaattcgtctcacccctagaaaaaaaagggcggatccaagatccttgcgctcaccgtcgacgcacacggcagcgtcgccttcgacgccgtcgtcaagcagggggagaacgcaggcaagatcgtctactctaagcatagcgacctcgtgccgaagatagccactgccgattcccaggcgacgtcggacgacgacgaggagcagaagcagatcgaggagacaactgaacggaccaaggccgccttggagaaggttgtcaacgtccgcctctctgcagctcagcccaagaatgtgccgactcatgattctgagtccaagtgcatcaagtatgagccgtcacagcaatccgcggccttcaattcaggtgcaaaggagaggatcattaggatgtcagagatgggcggtggatcctcttgagcccccaaagttcaagcaacaagcgtgtgccccggggcgtctggggtcaccacccttgtaccagttgatgcacttcgcccgccacggccaggtttaaagtggaaaggaaccagccagggaattggaaagaacccccacccttgggttttttcaaaatgtggaaaaaaatcccaaaaggggggtacacctaattcccgcctttggataaaaaaaggttggccggccttgaatggggaaggggggtccctgccagggagggggtgccaaattccaatggattagactttgggcaaaagctttttcttgaaaaaccttttgttacccgtgggccaaaaaggggaaaaagggcataggggaagggcattgtccaaatatgccccccccaaagggttcaaagagggaacatctttttttcccttaaaaggggaaaaagggaaaagaaaaggggaccatgaagccttatgggggccttctgcan

SEQ ID NO: 82621 - DNA, 832 bp, Zea mays
  misc_feature: Ceres CLONE 1568468
  misc_feature: Translation starting site: 194
  misc_feature: SWISSPROT Homolog: EC 1.4.1.2 Glutamate dehydrogenase
  misc_feature (516)..(516): n is a, c, t, g, unknown, or other
ctccccgcggtggcggccgctctagaactagtggatcccccgggctgcaggaattcgtctcacccctagaaaaagtccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagctatggccttttcaaagtgatcccgggctccggcgacaagcccatgatcngggtgcagttcaggggcgaggagaaacaagtctcggccgaggagatcagctccatgatcctgaacagatgaaggagaccgccgaggcttacttcggcaccaccatcaagaacgctgtcgtcaccgtcccggctaattcaacgactcccaggcccggccaccaaggaagccggggttatctccggcctaaggtttggggcatcttaaggaacccaccgcgggggccttctataggggctcaaaaaaaatccaccccccccggcaaaaaaaccccccttttttaacccgggggggggggccttttggaccccccccca

SEQ ID NO: 82622 - DNA, 819 bp, Zea mays
  misc_feature: Ceres CLONE 1568470
  misc_feature: Encodes the peptide sequence at SEQ ID NO. 82623
  misc_feature (411)..(411): n is a, c, t, g, unknown, or other
ctccccgcggtggcggccgctctagaactagtggatcccccgggctgcaggaattcgtctcacccctagaaaaaaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcctcggcgacgaagacngaacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgacggtggtggtctcgtcgccgcgcgtcccccaaggcgtgctccgcacctacaaccacgtttttctactcccgccccgggctccctggtggtcaaaatcatcatgtacgggcccaccgaacttgtggtttcgcgcccctaagggggaccactttccgcaaggggccgggaaacctgggtaacccgggaaccttgcttaaagcccaaaaaaggtgcgggtcccaaccga

SEQ ID NO: 82623 - protein, 99 aa, Zea mays
  misc_feature: Ceres CLONE 1568470
  misc_feature: SWISSPROT Homolog: EC 1.14.13.68 4-hydroxyphenylacetaldehyde oxime monooxygenase
MKLPIIGHLHLMGDIPYVSLAALATRYGPDLMLLRLGAVPTVVVSSPRVPQGVLRTYNHVFLLPPRAPWWSKSSCTGPPNLWFRAPKGDHFPQGAGKPG

SEQ ID NO: 82624 - DNA, 1279 bp, Zea mays
  misc_feature: Ceres CLONE 1568471
  misc_feature: Encodes the peptide sequence at SEQ ID NO. 82625
  misc_feature (50)..(50): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (730)..(730): n is a, c, t, g, unknown, or other
  misc_feature (759)..(759): n is a, c, t, g, unknown, or other
  misc_feature (763)..(763): n is a, c, t, g, unknown, or other
  misc_feature (765)..(765): n is a, c, t, g, unknown, or other
  misc_feature (930)..(930): n is a, c, t, g, unknown, or other
  misc_feature (1017)..(1017): n is a, c, t, g, unknown, or other
  misc_feature (1097)..(1097): n is a, c, t, g, unknown, or other
ggtttggtgggggggcgactttccccccccccgtaagggaggttgggtgncccttgggtgaatnnnccaaactggagctccccgcggtggcggccgctctagaactagtggatcccccgggctgcaggaattcgtctcacccctagaaaaaaaaacatgttctctccggacgatggtgccaggtgctaaccagagccagcgagcaagtctcctgattggctggcagtatctaaccgcatgattacaacgcgtacggtcacctgcgactaataacgctgagtttaatgcggcccacatagctgctctccatctccggctcggacggacgacgtcgccatggttgctcaactgcatcacgcactatacgagctgctgcacgcagcatccgcagcgcaacgatctctgctgctcgcgatcgccttctgcctgcagctcgtgcttctcctgctgcgctacctctgcacgtcggcattcgcccccccaactaataacgaccgaaggggtgctcgccccccaacacggacaagctcccgaacccggtttggaaaacctcggctcattgaagggccctcttatgagaggagggatcgtgccccccctgaaggggggcacgtacccccgggttctaatacccccgcgaaccccgttggacaaccgaaattccgtcacccggtggcagggaccccgccgatgtgtcctcgaatacaacccaccttgtgggaccaacacntcttgcacccccgccaccatcccaaggcnagcncnccaccgccgcgtttcgcgccgccgcgcccgttatttcccccacaccacctcgtaatgggaaatggtcgtatacgccaatcgtttccccgacgataaaagagctggtttttggtcggagggtattaaaacaaaaaacggggcgaaagggggggcgccccccacttnaaaaattcgcggagaccgggtgtatttttcagcacaaccagctgggggggacagataaatttttctattctgagcacgttggggagngggttcctcgccgcgtttcccccgcatgtggggggaaattgtcgggggtgaatttgttttttcttcaccgcgtcccaganggggcgcacctacccccctgtgtaccaaagacgaggggggtataactgaacagagtgtcgatttttcgaacagaagtagtaaactctgttgctccgtcttctaattgagacaacgctgctcggtggagcgcggtcactaacacgcgggtcgtttaagtggctagtaaatttctccgccgagc

SEQ ID NO: 82625 - protein, 53 aa, Zea mays
  misc_feature: Ceres CLONE 1568471
  misc_feature (35)..(35): Xaa is any aa, unknown, or other
MVVYANRFPDDKRAGFWSEGIKTKNGAKGGAPPTXKIRGDRVYFSAQPAGGDR

SEQ ID NO: 82626 - DNA, 974 bp, Zea mays
  misc_feature: Ceres CLONE 1568472
  misc_feature: Translation starting site: 75
tccccgcggtggcggccgctctagaactagtggatcccccgggctgcaggaattcgtctcacccctagaaaaagatgcgaccgccctcgctgctctccctcaccctcgacgccgcgctcctccgcatcgccaatatcgccgacctctcccacctcccagaccacctcctcatcgatctcttccgtgtaggtacctcgccgcgccctccgccacctctcgaatctgtggcccgctgctgattgatcgtaccggtgccaaggctccgcgtgcttggattcggtttgggcacattttgcggcgtggatttagtagtttcggattgatcctggtggctggggctggggctgggtttgtccgctgttccagaggttacgctgcctgatccgttcttgttacgttctgtgccgcgtgcatggttgatagaacttgtggaattgtaggagggggcgaagggttctgatcaggtttctacctggatctcacgctttactaaaaagggtatcaaaagggggggaaggggacagccacttttggaataggtgggttcccctggctgggaagcccggcgctggggtgtgaggggggaagaatgggcgaagggccaaccccccaataaacgaaaaggggggggtaccgggggaaaaaaagcgggagcccagcaaatgggtttggcgaaaaagtgccggggggaaaaacccaaagagcggggcattggctctgtgggtgtgataggaccctttggttgggagggattctgtcggcgagaggcccgaaaagggccgttgggcgagggcggctgggggggcggggccaaagtgggatggtgtggtgagaggatcagccgattatgaaagaattgagggggagagagatggactgcgcgagtgtgtcggacggggggtggagaaggatggaagcgagggtggaacgctatggtaggggaggtgcgagcagcggtgcgcacagtgcgtggg

SEQ ID NO: 82627 - DNA, 807 bp, Zea mays
  misc_feature: Ceres CLONE 1568475
  misc_feature (260)..(260): n is a, c, t, g, unknown, or other
  misc_feature (547)..(547): n is a, c, t, g, unknown, or other
ctccccgcggtggcggccgctctagaactagtggatcccccgggctgcaggaattcgtctcacccctagaaaaagcggggtagcgattacaccttgacacctaaggccagagattggagagagaaagaagcagctgagtggagcaagaaagaagaggtcatggcggtgtagtctatcagctgagtgggaaagagtggagcaatggtggggggctgtgccagcggcgacggcgccgccgaagggacgctcgcgaggtggcnggagggcggcggccaagcggatcggcctctcatgcgcctccttcttctcctacgccgcctctccctccccgcctccttccaagatcatctcccactccgcactgaatgcgcctgatggagagcagcaaaagatagaggaacccaccagcaccagagtggctgacaagaatctatgtgcaatatgtttgggactcctcagcacgagcatcagcagcgatgtttgacagtgggtgaagcggcagcaatctacacagcgcactgctcccactcatttcaacttcctatgncatcgctccaacatccggaatgggaacgtcagctggccctatctgccgtggcacatggtctggagctaacacggggacccggaagggtcccaccattgctggccaaacagtcagaaccaattccttcccatcctgaaagaaaacattgggggtctccccctggtgaacccaaggggccccccatccgggtggctcgcttaaaacaatgaatgacccccggaaaagcctttcccccttgggtggaaaaattttgggatccc

SEQ ID NO: 82628 - DNA, 787 bp, Zea mays
  misc_feature: Ceres CLONE 1568477
  misc_feature: Encodes the peptide sequence at SEQ ID NO. 82629
  misc_feature (532)..(532): n is a, c, t, g, unknown, or other
  misc_feature (737)..(737): n is a, c, t, g, unknown, or other
  misc_feature (744)..(744): n is a, c, t, g, unknown, or other
ctggagctccccgcggtggcggccgctctagaactagtggatcccccgggctgcaggaattcgtctcacccctagaaaaagccagtgagagagaggattagaggagcgagaggaaaggggggagatcatgcttgcagagcgtgctccgtgatgcggtgagcgccgctaacctcggttgatttcttggtgggaggcgacaaacgcgtgcgtgagccgccgcttgcttgggaggtggtggtgagaccaggcgtgctccttcgcacttgtctctgtttgagttcgttgtcgtcaggtaaatatcacgagcaccatgctcgagttcttgtagctccgcagcttcctcgcttcttgcatcctttgcaacttgtctcctgttgttttcctctgatttccatggaggaaagatgctgggtgtgccagtgatgtgggcgtggagcaggcaacaattggctcgtcctggacattgatcgattctcccctattctcgtccaaggaattttattcgtttctcctagcaagtcgtgtatgcttngttcgtggaggtaggagctaggatgacgagcaggaaccctaccaaaacccctgtcggtcctgaacactctcctgctgctgcttgagtccctcgcgctgtgcgcgcccgcctccgcccagccgctccactcggagcccatggctacgcagtccccgccgccgccgctgccgccggggtccacgattcccccgggcgcagggcgggnggggccnaaagcttccgccgaattggcgctcggggtcttcttcgggctcc

SEQ ID NO: 82629 - protein, 39 aa, Zea mays
  misc_feature: Ceres CLONE 1568477
  misc_feature (23)..(23): Xaa is any aa, unknown, or other
MATQSPPPPLPPGSTIPPGAGRXGPKASAELALGVFFGL

SEQ ID NO: 82630 - DNA, 833 bp, Zea mays
  misc_feature: Ceres CLONE 1568478
  misc_feature: SWISSPROT Homolog: EC 4.1.3.1 Isocitrate lyase
  misc_feature (193)..(193): n is a, c, t, g, unknown, or other
ctccccgcggtggcggccgctctagaactagtggatcccccgggctgcaggaattcgtctcacccctagaaaaacgcttcgcacttgcaatagttcgtcatctccaagtgcgtgcgccggccgccccctatcccgccggccctgtgtgtgttccccgctaccagccatggcgtcgccgttctccgtgcttcgnctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcggggggagatggccaagaagctgtggcgcacgctctaggcgcaccaggccggcggcaccgcctcccgcaccttcggcgcgctcgaccccgtccaggtcaccatgatgggccagcacctggacaccatctacgtctcccggtgggcagtgctcgtccacgcacacctccaacatggagcccggcccggacctcgccgactacccctacgaaccgtgcccaacaaggtgtagcaccctctttttcggcagatttacaccaccgccaagcacgggaggcgcccatgtcgctgccccccgcccaacgcgcgcggggcccctaattcaacttcctcagcccattatcgcccaacgggaaccggggcttggggggggccaacggccaccggttaaggtctgaaagctctttcttcaaaacccgggggggggccgggggccaccccccgagggaaccagcccccccgtccaccaaaaaaatggggggcaccctggggg

SEQ ID NO: 82631 - DNA, 2744 bp, Zea mays
  misc_feature: Ceres CLONE 1568479
  misc_feature: Encodes the peptide sequence at SEQ ID NO. 82632
actccccttctcgccaaaggggaagccctgcccgtacttccgttgcggcgctacgagcttcgacgggcctcgatctccacctctgaagtgactacttgtgatctagatctgaagctgtagtggtcagcagcttagtgtgaatcgaagatgagcgtggtggggttcgacctcggcaatgagagctgtatcgtggcggttgcgcggcagcgtggcatcgacgtggttctcaacgaggagtccaagcgcgagacacccgccatcgtttgcttcggggacaagcagcggttcatcggcaccgccggcgccgcgtcctccaccatgaaccccaaaaactccatctctcagattaagcgcctgctcggccgcaagttctcagatcccgagctgcagcgcgatctcgcctccttcccattccgagtcacggagggccccgatggttttcccctggtccatgtacggtacctgggcgaggagcggacgttcacctccacccagctgcttgccatggtgctgtccaatttgaagggcattgctgagggtaacctgaatgccgcagttgttgattgttgcattggtatcccggtctacttcacagatctgcagcgcagggctgttcttgatgctgctactattgcgggtctccggccattgcgattgttccatgagacgacagccactgctctggcatatggtatttataagactgatctcccagagaatgaccagttgaatgttgcatttgtcgatatcggtcatgcaagcatgcaggttagtgttgtcggttacaggaagggacagctcaagatgttgtcccatacatacgaccggtctcttggtgggagggacttcgatgaggccctgtttaagcactttgcagctaaatttaaagaggaatataagattgatgtgtaccagaatgcgcgggcatgtattaggttgcgtgtggcatgtgagaaacttaagaaggtgctgagtgccaacccagaggccccactgaacattgagtgcttgatggatgaaaaggatgtgcggggttttatcaagagggaggagtttgaacagatcagtgcctctgtgctggaacgcgtgaaagggccactggagaaggccttggctgaagctgggttgactactgaaaatgtgcactttgttgaggttgtcggatctggttctcgtgttccggctataatcaagataattactgatttttttgggaaggaaccaagacgtaccatgaatgcaagcgagtgtgttgcgcgaggatgcgctcttcaatgtgctattctcagccccactttcaaagtgcgagaattccaggtcaatgatgggtttcctttctcaattgcattgtcatggaatggagactcccagaatgcaccccaacaaacccttgtattccaaaaggggaatgcaattcctagcactaaagctcttaccatctttaaatccagcacatttgaagttgatgttttgtatgtcgacccagataactcacaaattccacaaaaaataagcacttacacaattggccctttccaaacctccaacggagagaaggccaaactgaaagtgaaagtgcgtctcaacatccatgggaccgttacagttgattcggtgataatgctggaggaggatgtggaagttccagtctcatctgcaaatgaagctccaaacgatactatgaagatggacacagatgatgtgccaagtgatcctgctgctggatctgatgtgactatgcaggagcagcctcctgcagctggaaatggagcacaagataatgaggaaaagtctgtttcgatggaaactgatgcaaaggttgagccgtcaaaaaagaaagttaagaaaactactgttccggtccatgagttggtctatggggccttggctgcagctgacctgcagaaggctgtagagaaagagtatgagatggctcttcaagacagagtaatggaagaaacaaaggagaagaagaatgctgttgaagcttatgtgtatgacatgcgtaacaagctatatgacaagtacagtgattttgtcacacctgaggacaaggaaggtttgatcggtaaacttcaggaggttgaagactggctctatgaagatggcgaggatgagaccaagggagtttatattgctaaactagaagaacttaaaaaggttggtgatcctattgaggtgcgcttcaaagaatgggagattagaggttctgctgttagccaactgctatactgcataaaaagcttcagagaagctgcactgtctaaggaccagaagtttgaacacatagacatgtcagaaaagcaaaaggtcattagcgagtgttcggaagcagagacttggctaatggagaaaaggcagcagcaggatgctctgccaaagcatgctaatccggtcctccttgttgctgaccttaagaagaaagctgaaacacttgacaggttctgcaagccgatcatgacgaaaccgaagccagttcctaagccacagactccgcctccggcagaaacccaagctcctgagcctcagacaccggagcagcagcgatcaaatggcgaaagcacaaccagcgagggagctgcagaggagcctccagccgagcagatggagacagacaaacctgagggagccacagatccctcggcttagctttgcaggtgatggaacatttgtgtgattgaccttatacttggttgggggtgaactaagcaagatggttgttcgccaaaaaaaaaaaaaaaaaa

SEQ ID NO: 82632 - protein, 833 aa, Zea mays
  misc_feature: Ceres CLONE 1568479
  misc_feature (3)..(682): Pfam Name: HSP70 Pfam Description: Hsp70 protein
MSVVGFDLGNESCIVAVARQRGIDVVLNEESKRETPAIVCFGDKQRFIGTAGAASSTMNPKNSISQIKRLLGRKFSDPELQRDLASFPFRVTEGPDGFPLVHVRYLGEERTFTSTQLLAMVLSNLKGIAEGNLNAAVVDCCIGIPVYFTDLQRRAVLDAATIAGLRPLRLFHETTATALAYGIYKTDLPENDQLNVAFVDIGHASMQVSVVGYRKGQLKMLSHTYDRSLGGRDFDEALFKHFAAKFKEEYKIDVYQNARACIRLRVACEKLKKVLSANPEAPLNIECLMDEKDVRGFIKREEFEQISASVLERVKGPLEKALAEAGLTTENVHFVEVVGSGSRVPAIIKIITDFFGKEPRRTMNASECVARGCALQCAILSPTFKVREFQVNDGFPFSIALSWNGDSQNAPQQTLVFQKGNAIPSTKALTIFKSSTFEVDVLYVDPDNSQIPQKISTYTIGPFQTSNGEKAKLKVKVRLNIHGTVTVDSVIMLEEDVEVPVSSANEAPNDTMKMDTDDVPSDPAAGSDVTMQEQPPAAGNGAQDNEEKSVSMETDAKVEPSKKKVKKTTVPVHELVYGALAAADLQKAVEKEYEMALQDRVMEETKEKKNAVEAYVYDMRNKLYDKYSDFVTPEDKEGLIGKLQEVEDWLYEDGEDETKGVYIAKLEELKKVGDPIEVRFKEWEIRGSAVSQLLYCIKSFREAALSKDQKFEHIDMSEKQKVISECSEAETWLMEKRQQQDALPKHANPVLLVADLKKKAETLDRFCKPIMTKPKPVPKPQTPPPAETQAPEPQTPEQQRSNGESTTSEGAAEEPPAEQMETDKPEGATDPSA

SEQ ID NO: 82633 - DNA, 840 bp, Zea mays
  misc_feature: Ceres CLONE 1568483
  misc_feature: Encodes the peptide sequence at SEQ ID NO. 82634
  misc_feature (541)..(541): n is a, c, t, g, unknown, or other
  misc_feature (586)..(586): n is a, c, t, g, unknown, or other
ctccccgcggtggcggccgctctagaactagtggatcccccgggctgcaggaattcgtctcacccctagaaaaagcttcccctccccgctccactcttccccgcgccctgtcccgttggccgcgaatggttctcgcgcgagtcctcccgctgcccgccccgtcgtccgcgccccaccgccgcttactcctgccgactcaggcggcgccggccccgccgcgtgtgctcaccgtgcgggccgtcgcctgccgcgcagcgaacgccatggcggccgttgctctggacccgcccgcggtcgctccgagccccgcagaggtcgcagccgtgggcatcggggaggagctgccggaggggtacgatcagatgatgccgaccgcggagccgtcgcggaggcggcgcgccgggctgctgctgcatccgacttcgttgcggggcccgcacggcatcggcgacctcggggacgaggcgctcgctttcctgcattggctccgcgacgccggctgcacgctctggcaggttctaccactttgttctccaggtangacggctgggggaggatgggtctcccttatctggacaggatgccnactgttggcataccccttttgctatcccttgaggagcttgtaaaagatggctactgatgtcaaaatgacctccctgatcctgtggaaacgaataatgtggaaattgaacctggtgcaaatccggaagaaaccccttattgcaaaggcagccaaaaagcccccttccaagcccctgggaaggccaaaaacccaattgggctggcttcaaaaaaaaccccaatttttccgggtgtggccttaaaaaaagcagcccc

SEQ ID NO: 82634 - protein, 167 aa, Zea mays
  misc_feature: Ceres CLONE 1568483
  misc_feature: SWISSPROT Homolog: EC 2.4.1.25 4-alpha-glucanotransferase
  misc_feature (139)..(139): Xaa is any aa, unknown, or other
  misc_feature (154)..(154): Xaa is any aa, unknown, or other
MVLARVLPLPAPSSAPHRRLLLPTQAAPAPPRVLTVRAVACRAANAMAAVALDPPAVAPSPAEVAAVGIGEELPEGYDQMMPTAEPSRRRRAGLLLHPTSLRGPHGIGDLGDEALAFLHWLRDAGCTLWQVLPLCSPGXTAGGGWVSLIWTGCXLLAYPFCYPLRSL

SEQ ID NO: 82635 - DNA, 863 bp, Zea mays
  misc_feature: Ceres CLONE 1568484
  misc_feature: Encodes the peptide sequence at SEQ ID NO. 82636
ctccccgcggtggcggccgctctagaactagtggatcccccgggctgcaggaattcgtctcacccctagaaaaatgcaatctggtaaatttgacaacagttgaactaggtcgaaacaaatttagtgggcctattcctcctcagataggcagttgcaagtctcttcaaaggctggaccttacaaataattatttcacgtcagagttgcctcgagaaattggtaatttgtcaaaactcgttgtcttcaatatctcatctaatagactaggaggaaacataccactagagattttcaattgtacagtgttgcaacgccttgatctcagccagaatagctttgaaggttcgttgccaaatgaagttggtaggctgccacagctggagctgctatcttttgctgacaataggctaactggccagataccacccattccttggtgaactatcacatttaacagcactacagattggtggcaatcggttatctggtgaaataccaagggagctgggtctgctgtcgagcttgcagatccgccttaatttgagttacaacaacctctctggcgatattccatcagagcttggtaaccttgcactggtggaaaagtttatttctttaatacaacaagctggatggtgaaaatcccaccaacctttgctaatctgtccagtttgcttgaccttcaaactttccctacatttatctctctgggtgccctccccgccaatacccgcttttttgaaaaaaaagggccggggaacctggttttatttggaaaataaaagggatttattggggggggaaaaaacctgtgggtaaaattgggggaatcccagaaacaatcccttctaaggtttccccag

SEQ ID NO: 82636 - protein, 145 aa, Zea mays
  misc_feature: Ceres CLONE 1568484
  misc_feature: SWISSPROT Homolog: EC 2.7.11.1 Non-specific serine/threonine protein kinase
PRGGGRSRTSGSPGLQEFVSPLEKCNLVNLTTVELGRNKFSGPIPPQIGSCKSLQRLDLTNNYFTSELPREIGNLSKLVVFNISSNRLGGNIPLEIFNCTVLQRLDLSQNSFEGSLPNEVGRLPQLELLSFADNRLTGQIPPIPW

SEQ ID NO: 82637 - DNA, 829 bp, Zea mays
  misc_feature: Ceres CLONE 1568489
  misc_feature: Encodes the peptide sequence at SEQ ID NO. 82638
ggagctccccgcggtggcggccgctctagaactagtggatcccccgggctgcaggaattcgtctcacccctagaaaaaacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaagttcatttcatcccttagcacaagaatcctaagactggaaagtatgttgagcatcacctcaaattcccaccttctgtcccatacgacaagctctctcatgtctacacagctatcttgaagcccagacatgaggtcagaatttttgatcgatgggggaagaaaagaagagggcgaacttccctttctgctgaatgactttgagccagcacttatccatcccaagacatttcctgaccctgatgacaagaagccgggagactggga

SEQ ID NO: 82638 - protein, 148 aa, Zea mays
  misc_feature: Ceres CLONE 1568489
  misc_feature (24)..(149): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTNKVHFIP

SEQ ID NO: 82639 - DNA, 853 bp, Zea mays
  misc_feature: Ceres CLONE 1568492
  misc_feature: Translation starting site: 273
  misc_feature: SWISSPROT Homolog: EC 2.7.11.24 Mitogen-activated protein kinase
  misc_feature (611)..(611): n is a, c, t, g, unknown, or other
ctccccgcggtggcggccgctctagaactagtggatcccccgggctgcaggaattcgtctcacccctagaaaaagctccgcctttccctttcctcccccttcctcttcctatctccttgggggcgcggcgagatcgggcggaggagccctaccgcccccctcgccgcaggccgcagcccgcagcggaggcgggtgctcagctccgcggaaggttaaaggtgcggggctgcgtttggaaccggcggtgggcgcgggagatccggccagcggggatgcagcaggaccagcggaacaagacttctgcagaggccgacttcttcacagagtacggggatgcgaaccggtacaagatccaagaggtcatcggcaagggaagctacggggtcgtctgctctgccatcgatctccacactcggcagagggtggcgatcaagaagatacatggcatcttcgagcacgtctccgatgccgcgaggatcctccgcgagatcaagcttctgaggctcctgaggcaccctgacattgtcgagatcaagcacattatgctgcctccctcgagaaaggacttcaaggacatttacggtgttttttgagctcatggagtccgaccntcaccaagttataaaagccaacgatgacttgaccaaggagcattaccagttcttttctctatcagttacttcgggccctcaaatacattcataactgctaatgtttaacaaccctggacctcaagcccaagaaattttttagcaaactcctaactgccaactggaaaatatgtgaacttttggactaggccccgagtcgcatttcaatgataccccccacaacacgtctttctggaacggat

SEQ ID NO: 82640 - DNA, 901 bp, Zea mays
  misc_feature: Ceres CLONE 1568495
  misc_feature: Encodes the peptide sequence at SEQ ID NO. 82641
ctccccgcggtggcggccgctctagaactagtggatcccccgggctgcaggaattcgtctcacccctagaaaaaaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaacaagccgtgccgcgtgcgcgccgtcgcgtcgcccgcgcgcaccccccgcgccccgtcgtccaccggctcggtgaagaccccgatgacgatgacgggaaaaatcctggcgagggcgtcggagcgcgcggccctggagcccgggggagaacgtgtgggtggacatcgacgtgctcatgacgccaagacgtctgccgggcccgggaccatcgggaatcttcaaaaaggaattccggggaggattgcaaaggtctggggaacccaaaaaaggtcgttattaatcccccgaaacattaaattctttcccagggaaagaaggcgcccaaaccgcaaaggtgaaattcccctcgggggacttccttgttggggaaaaaaaaactcagggttcttttttttaaattcaagggcccccccccgattttcgggggttataacaaaatccaaaaggggggtcctccccacatttgcccttgtcttcaagagaggcccccccccccacacgggggagggtcccccgggggggcggagttttcccacacgcggaaagtggggggccccttttttgttttttttccccccggattttgtagaaaacccgggtggggg

SEQ ID NO: 82641 - protein, 235 aa, Zea mays
  misc_feature: Ceres CLONE 1568495
MASSISAAAKASAAFAQKKELAAPAPHRAGSSRRNKPCRVRAVASPARTPRAPSSTGSVKTPMTMTGKILARASERAALEPGGERVGGHRRAHDAKTSAGPGTIGNLQKGIPGRIAKVWGTQKRSLLIPRNIKFFPRERRRPNRKGEIPLGGLPCWGKKNSGFFFLNSRAPPRFSGVITKSKRGVLPTFALVFKRGPPPHTGEGPPGGRSFPTRGKWGAPFLFFFPPDFVENPGG

SEQ ID NO: 82642 - DNA, 802 bp, Zea mays
  misc_feature: Ceres CLONE 1568496
  misc_feature: Translation starting site: 186
  misc_feature (295)..(295): n is a, c, t, g, unknown, or other
  misc_feature (453)..(453): n is a, c, t, g, unknown, or other
ctggagctccccgcggtggcggccgctctagaactagtggatcccccgggctgcaggaattcgtctcaccccctagaaaaaaagggcccaaggcttctctatctagggattcatcttcctctcgtcttccctcttcctctccgaggatacaaggcgccgtcccaggtagaggtagggtcgctaccatgctggaggagctgctcatcttcacccggggcggcctcatcctgtggtcgtcctgccgggcgctcggcgccgcagccctcaagggctcccccatcgacgccctcatccngctcctgtctcctcgaggagcgatccgccgacgccagcttctcccaggacaattacgtcctctagtggaccttccacaacgacctcgtgcttgtcttcgtcgccgtataccagaagatactgcaactcctctacgtcgacgatctcctcgcccgcgtnccgcaagggagttcctcccagatctacgtacccaaagcgcacctccctacgaatgacttggggggacatctttccgccaagcttcacccgcgaaggggccaagggcgccccccccagggaaattggaaaaaagtcccaaggcaggcccccctctcggtccccggttcaacaaagcctgggttttttacccccaaaaataaaagccccggggtttcccaaaaggggccccccccgggggcgggggatttttcccccgggggggggggggggccgtggtttaaaaaaaagggggggggggggccctcttgggggggcccccaaaggagagaaaaaccccccgggggagggg

SEQ ID NO: 82643 - DNA, 877 bp, Zea mays
  misc_feature: Ceres CLONE 1568497
  misc_feature: Encodes the peptide sequence at SEQ ID NO. 82644
tggagctccccgcggtggcggccgctctagaactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacaggcgcacgctggccgactacaacattcagaaggagagcaccctccacttggtgttgcgtctcaggggcggcatgcagatatttgtgaagactctgactgggaagactatcaacccttgagggtcgaggccttctgataccatgcgacaatgtcaaggcccaagatccaggacaaggaggggcatcccctccgggaacagcaggcgggcttctttttttgtccgggaagcaagcttcgagggaaggggccgccacgcctgggctcgaacttaccaacattctcaaaaagggaaaggcaccccttcgcaccttggggggcctgggggtcctccagggg

SEQ ID NO: 82644 - protein, 167 aa, Zea mays
  misc_feature: Ceres CLONE 1568497
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDRRTLADYNIQKESTLHLVLRLRGGMQIFVKTLTGKTINP

SEQ ID NO: 82645 - DNA, 826 bp, Zea mays
  misc_feature: Ceres CLONE 1568498
  misc_feature: Encodes the peptide sequence at SEQ ID NO. 82646
ctccccgcggtggcggccgctctagaactagtggatcccccgggctgcaggaattcgtctcacccctagaaaaagttcttctctctccttcttcctcggtcctctcctctccgcatttcaggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccaccgtcgtcgggttcctcggttccgcgtttggcaccgtcggctgcgtcggcggaggcgggatcttcatgcccatgctcaacctcgtcgtcggcttcgacaccaaatccgccgccgcgctctccaaatgcatgatcatgggggcctcggcgtcatcagtttggtacaaccgtcaggtgtcgcacccgaccgaggaggcgcccgtcatcgactacaagctcgcgctgctgctgcagaccatgcttatgctctgcataaccatcggcgtagagctcagcgtcatcttcccatacaggctaatcactgtcctccatgatatcctcttcgtaagcacctcctcgagatccttctacacgggcatgctgatgtgggaggcaggagtcccggattctgatggacaccccccgggcgagagaagcaatc

SEQ ID NO: 82646 - protein, 220 aa, Zea mays
  misc_feature: Ceres CLONE 1568498
MVMEGRTGSLYGRLNKSSTRGFLAYTAAGAACAAVLACFVLSAADSPASAARNDGERLRLSSRSPRVWPDLAFNWRVVVATVVGFLGSAFGTVGCVGGGGIFMPMLNLVVGFDTKSAAALSKCMIMGASASSVWYNRQVSHPTEEAPVIDYKLALLLQTMLMLCITIGVELSVIFPYRLITVLHDILFVSTSSRSFYTGMLMWEAGVPDSDGHPPGERSN

SEQ ID NO: 82647 - DNA, 867 bp, Zea mays
  misc_feature: Ceres CLONE 1568503
  misc_feature: Encodes the peptide sequence at SEQ ID NO. 82648
ctccccgcggtggcggccgctctagaactagtggatcccccgggctgcaggaattcgtctcacccctagaaaaaaaaaaaaagcgcgcggacgagaggcgaagagagcagcccaaacacgactactgcattacacacacacacaggataggagtacgtgtctgcttctctctccccgctggcctcctcctccagtacttcagacagtgcaccgtgctgcggcctctttcatccctcaaggccggccgcccccagaaccagagtcggagtgaatccatggctcctccgcccctctcctcctggccatgggcaagcctcggccagtacaagtacgtgctgctggggcctctggtgtggaaggtgctgcaagaatggcgggagcaggcgggcctgccgctcggctcctggtggctgcacctgctgctgctgttcgcggcgcgcggcctcacctaccagttctggttcagctacggcaacatgctcttcttcacccgccgccgccgcgtcgtcgccgacggcgtcgacttccgccagatcgacgccgagtgggactgggacaactttctcgtgctgcaaacgctgattggggccacggtggtcaacagcccactgctccccgggcctgcggcagctctgcctggggggacccgcgcgggtggggccggcaccctgctggctgcatgtggggcttccttaaaagccgggtcttctaacctgggccccccggggcccctcccacagggcccccggttttttttgcccgattaccaaggccgcggaaaacaattccctgggggggggttaacccaaagccgcctgtaaaaaaccggggtttcccgggaaacccccccctggaagagttccccgt

SEQ ID NO: 82648 - protein, 181 aa, Zea mays
  misc_feature: Ceres CLONE 1568503
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWDNFLVLQTLIGATVVNSPLLPGPAAALPGGTRAGGAGTLLAACGASLKAGSSNLGPPGPLPQGPRFFLPDYQGRGKQFPGGGLTQSRL

SEQ ID NO: 82649 - DNA, 832 bp, Zea mays
  misc_feature: Ceres CLONE 1568504
  misc_feature: Translation starting site: 217
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaaattcgagttgtccgcttccagtcagtcgccgccgccgccgtcgccgctgaaaccgaaacttgaaaaaccagctcgccgggggtccggccgatttcccccaaatttccctgctgctgctgataggaggccgcggcgaccaccatgggcaactgctgcgccacgccgtcgacgacggaggagagcggcaagagccgccagaagaagccgaagcagaagacgaacccctacaacgtggcgtacaaccgcggggcggcgccggcgccggcgcgcccgggcctggtggtgctgcgggacccgacggggcgggacctcggcgcgcagtacgagctgggcggcgagctgggccgcggcgagttcggcgtcacgtacctgtgcacggagtccgccacgagggcgcgctacgcgtgcaagtccatctccaagcgcaagctgcgcacacccgtggacgtggaagacgtgcgccgggaggtggacatcatgcgtcacatgcctccgcaccccacatcgtcagcctccgccgcgcctacgaggacgaggacgccgtgcacctcgtcatggagctctgcgagggaagcgagctctccaacaagatcgtcgcccggggcactacaccgaaggtggcggcgcccgcgtcacgcgcaccattgtcaagttccccaaatgtggcccagggcatggcgtcttggaccgggaatcttaaccaaaaaaacttttttattccaaccaaaaagggaaatcccccctcgaaaaaaaacaa

SEQ ID NO: 82650 - DNA, 712 bp, Zea mays
  misc_feature: Ceres CLONE 1568505
  misc_feature: Encodes the peptide sequence at SEQ ID NO. 82651
ctccccgcggtggcggccgctctagaactagtggatcccccgggctgcaggaattcgtctcacccctagaaaaactagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtccttgttctaagattcactctcttcaactgcggaaagattatgaagaagcgaaagcaaagggaacagaaaattttgatagagaactcgaggatatgatagaaaggctcattggtggagtgtgacaggaaaaatcagaggggccctaaacggcttgcagatgatgatgcccatgctgctattgcgatatcgggtctctggagggtactctgaccggaagacatactgcaggctgtcaaaaccggataagggagaaatgggcagaaatttgattgcccttttggttttttttaaaggggggaaaacctttgggaccaaaaaaaaagcccccccaaaattttggggaaaaacccttaaacctaaaaaaacctttttttgggggggcccccccctggggggggggcgttttaaaaaaggggaaaaagttttttttttaataagggggggggggcccccccccaaagg

SEQ ID NO: 82651 - protein, 94 aa, Zea mays
  misc_feature: Ceres CLONE 1568505
  misc_feature (1)..(94): Pfam Name: LUC7 Pfam Description: LUC7 N_terminus
MDAFRKQLDVLMGANRNGDVEEVSRNYYDRDVCRLFLAGLCPHDLFQLTKMDLGPCSKIHSLQLRKDYEEAKAKGTENFDRELEDMIERLIGGV

SEQ ID NO: 82652 - DNA, 834 bp, Zea mays
  misc_feature: Ceres CLONE 1568506
  misc_feature: Encodes the peptide sequence at SEQ ID NO. 82653
ggagctccccgcggtggcggccgctctagaactagtggatcccccgggctgcaggaattcgtctcacccctagaaaaatccaatccaatccaaaccgtcccttgtcctctcttcctcgaaacgcagctatggggactcggccgcggggggtcgtcctcgcgccatgggcggtggtgctggtgctggtgctctcgcttcgtctggcaggcgcgtcgcatgtgatccacctcagcctggaggccgaggcggcgccgtcagtcccggcctccattgtcagccccctgctcaggacggggtaccatttccagccgccaatgaactggatcaacgaccctaacgctccgctgtactacaaaggatggtatcacctgttctaccagtacaaccccaagggcgcggcacggggcaacatcgtgtgggcgcactcggtgtcgcgcgacctgatcaactgggtggcgctggaagcagccatctaccccagcatcccgtccgacaagtacggctgctggtcgggctcggcgactatcctggatgacggcacgccggcgatcctgtacacagggatcgaccggccggacatcaactaccaggtgcaggtgctggcgctccccaaggacgcgtccgacccgctgctccgcgagtgggagaagccggaggagtacaacccggtggctacaccggcggtcggctgcatcaacgcgacgcagttccagcgaccgaactactgcgtggcggccaccggggggccgggcactggccggatgctggtgggcaaccttgccccgcgcttcccaggataggcccttgttgtaccgaagcccgggacttacaggt

SEQ ID NO: 82653 - protein, 223 aa, Zea mays
  misc_feature: Ceres CLONE 1568506
  misc_feature (58)..(223): Pfam Name: Glyco_hydro_32N Pfam Description: Glycosyl hydrolases family 32 N terminal
  misc_feature: SWISSPROT Homolog: EC 3.2.1.26 Beta-fructofuranosidase
MGTRPRGVVLAPWAVVLVLVLSLRLAGASHVIHLSLEAEAAPSVPASIVSPLLRTGYHFQPPMNWINDPNAPLYYKGWYHLFYQYNPKGAARGNIVWAHSVSRDLINWVALEAAIYPSIPSDKYGCWSGSATILDDGTPAILYTGIDRPDINYQVQVLALPKDASDPLLREWEKPEEYNPVATPAVGCINATQFQRPNYCVAATGGPGTGRMLVGNLAPRFPG

SEQ ID NO: 82654 - DNA, 737 bp, Zea mays
  misc_feature: Ceres CLONE 1568508
  misc_feature (334)..(334): n is a, c, t, g, unknown, or other
ctccccgcggtggcggccgctctagaactagtggatcccccgggctgcaggaattcgtctcacccctagaaaaatgatcgcgatggtacagggaaatcaagaggctatggtaattttggaaagcacagcaggataggatacaagaaaaggacttggattttcgtgaacgggagagtaggttggttcaaccagatgatcctttacgtgatggctttgagtcctttagctcatgcagatctgaaaagacaggcttaaccgtactcgttcaaaggtggccataccaaatcgtggcaggagtaagtttagacaatgggtaatgtatctaaaaaagatnaatggtgtcattctcccttttgagcggggattttccacaccctttgggttctggaaggaccaaaaatggggaaaacccaagaaccttaggggcgcgagtttcccctcccccgtggaatttttggccccccatttttcaaaaacaaccccatttgggggggacaccccgcaaaggggggggaaaaattctcccgcgcgcccttgccgaaaaaaaaccccccccccccttttttgtttcccccaaaaatttttccccccctggtgtttccccccctccccccaaaaaaaaaacccccggggggttttcttttttttttaaacccacctttgttgttggggggggccccccacccccccccggggggggggggggggggcttttttaaaaaaaaggggtgggggga

SEQ ID NO: 82655 - DNA, 858 bp, Zea mays
  misc_feature: Ceres CLONE 1568509
  misc_feature: Translation starting site: 158
  misc_feature: SWISSPROT Homolog: EC 1.1.1.34 Hydroxymethylglutaryl-CoA reductase (NADPH)
tccccgcggtggcggccgctctagaactagtggatcccccgggctgcaggaattcgtctcacccctagaaaaaccaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagggggagcgggtgcgtgtgcaggcgggtgatgcgctaccgctgccgatccggcacacgaacctcatcttctcggcgctgttcgccgcgtcgctggtgtacctgatgcgtcggtggcgtggggaagatccgcgcctccacgccgctccacgtggtctcccccgccgagatcttcgccatctgcggcctcgtcgcgtcgctcatctacctcctcagcttcttcgggatcgccttcgtgcagcccgtcttctccagcagcgacgacgacgaggacttcatcgtcgactcccgccacgcgcgggcgcgggcgccgccgacgcctgcgcagaccccgtgtgcgctgctggggagccccgccgccgcgacggagaaaatgcccgaggaggactaggagatcttggccgcggttgtggcagggatgatccccgccctacgtgctggaatctaagctgggaaaattgccgcccgggccccccgggattcaggaaggaaggcccttacccccggaatccccggaaagggatatgggacgggcctccccgctccaaacggggttggaaataaagccgtccaatccctggggaccaatagccttgcaaaacttgtcccggttccggggaacttgccaaacc

SEQ ID NO: 82656 - DNA, 869 bp, Zea mays
  misc_feature: Ceres CLONE 1568514
  misc_feature: Encodes the peptide sequence at SEQ ID NO. 82657
ctccccgcggtggcggccgctctataactagtggatcccccgggctgcatgaattcgtctcacccctagaaaaaacccttcccgttccccaattcgaaatccagtcgggtactaggatcagtattaccatgagtgcgtggatgcccgaaccatccaaggctcccactccccgcccgccaacgacgggtccctctagggttttgccgagatgtagctccggccgatcgagcgggagcagatgcgaaacggcatactacaagcagacggtggacgcctagtagatccgcctccgccgcgagggccatgatggtcgacatccggaggtccaagcgagaggaaagcctccagaagaagcgccgcgatgggttccccgacaccggctccgtgcctactatggtccactccaccgcactccatcataaggtcgatggcttgccagccatggtacaggccgttctctccaacgatcccactgtgcagcttgaggacagcactcagctcaggaagctgctctccataaagcgcactcccccaatgaataggtgatcaacacagaagtcctgcccctatgcatgtagtccttacacatgaggacaatcacaactccagttttgaggctgcatgggcgctcaccaagattggatgaaggacatcaaaaaaacctaaggcgggggtttaattagtggcgcctgggccccagctttgttaagctcctccaactccaaatagccaaggaatgtgcggggaaaaaggcttggatgggggcctttaaggaaaaaggttcccttgggagaccccccccaaagtggaccggtgatcctggggtgcctagggccaaggggtgggagcttatttccccctttttcaat

SEQ ID NO: 82657 - protein, 80 aa, Zea mays
  misc_feature: Ceres CLONE 1568514
  misc_feature (2)..(65): Pfam Name: IBB Pfam Description: Importin beta binding domain
MMVDIRRSKREESLQKKRRDGFPDTGSVPTMVHSTALHHKVDGLPAMVQAVLSNDPTVQLEDSTQLRKLLSIKRTPPMNR

SEQ ID NO: 82658 - DNA, 826 bp, Zea mays
  misc_feature: Ceres CLONE 1568516
  misc_feature: Encodes the peptide sequence at SEQ ID NO. 82659
  misc_feature (553)..(553): n is a, c, t, g, unknown, or other
  misc_feature (685)..(685): n is a, c, t, g, unknown, or other
  misc_feature (709)..(709): n is a, c, t, g, unknown, or other
ctccccgcggtggcggccgctctagaactagtggatcccccgggctgcaggaattcgtctcacccctagaaaaagaagcgaacttgagccagagagagaatctcgcaccgcagcaggaggggaccgagagagaagcgaactcgagaaagggattcaaggaggctgttgccgatggccatggcggcgcggctgctgcgagcaaccgaggtggcatctcgatttctatctgcttcccatggtttcgtccagcgagctgcatacacagctggtgggatagtcgatgttggccaaccaacaccccagtctcatccagagttattagctgatggagagatcacaccaggcatcacaaacgaggaatacatctctagaagaaaaaaacttttagaggtgctaccagagaagagcttggccattattgcttctgctgatcagcagatgatgactgatgtagtgccatatccattcagacagaatggtgattacctgtatattacaggttgtactctctcccctcctctcccatccggcatccccgcccactctctctctnccccttccccctccactcccctgcttttctctcactcgtcgcacgcaagcgcaaatgggtctaaaaagtccaactccaaacctagactagaggcccctcaccgaggcgacgacgcacgcatgcgaggggcanttcggcgccggccgcctcctcttngtccccggtcccgggcgggaacgggcctccccaaccctgcggccccgccggcggcccctcaacggttcaagcgggaacggggaaacccatccgtccggggcgtttggccctcctccc

SEQ ID NO: 82659 - protein, 216 aa, Zea mays
  misc_feature: Ceres CLONE 1568516
  misc_feature (57)..(161): Pfam Name: AMP_N Pfam Description: Aminopeptidase P, N-terminal domain
  misc_feature (126)..(126): Xaa is any aa, unknown, or other
  misc_feature (170)..(170): Xaa is any aa, unknown, or other
  misc_feature (178)..(178): Xaa is any aa, unknown, or other
MAARLLRATEVASRFLSASHGFVQRAAYTAGGIVDVGQPTPQSHPELLADGEITPGITNEEYISRRKKLLEVLPEKSLAIIASADQQMMTDVVPYPFRQNGDYLYITGCTLSPPLPSGIPAHSLSXPSPSTPLLFSHSSHASANGSKKSNSKPRLEAPHRGDDARMRGAXRRRPPPLXPRSRAGTGLPNPAAPPAAPQRFKRERGNPSVRGVWPSS

SEQ ID NO: 82660 - DNA, 822 bp, Zea mays
  misc_feature: Ceres CLONE 1568517
  misc_feature: Encodes the peptide sequence at SEQ ID NO. 82661
  misc_feature (554)..(554): n is a, c, t, g, unknown, or other
  misc_feature (663)..(663): n is a, c, t, g, unknown, or other
  misc_feature (799)..(799): n is a, c, t, g, unknown, or other
ctccccgcggtggcggccgctctagaactagtggatcccccgggctgcaggaattcgtctcacccctagaaaaagaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgtcccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccgatttanggaagggttcgaaaagcgggaaggatcttgttgtgactgtccagtctgcgatggggggaggagcagatctgcgcgctgaaggatgttggcccccaagtacttctttggnctttggagaccgaaccctactctatctcaacttaaaatcgaaaagaagtgtatcaccaaagggattgctacggagacattcccctggcttgagctggcttttgctataaccgtgcaaggggtttgctgggttgtcntaccctaccggacttatcattac

SEQ ID NO: 82661 - protein, 154 aa, Zea mays
  misc_feature: Ceres CLONE 1568517
  misc_feature (86)..(145): Pfam Name: eIF-5a Pfam Description: Eukaryotic initiation factor 5A hypusine, DNA-binding OB fold
  misc_feature (30)..(64): Pfam Name: KOW Pfam Description: KOW motif
  misc_feature (129)..(129): Xaa is any aa, unknown, or other
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVARFXEGFEKREGSCCDCPVCDGGRSRSAR

SEQ ID NO: 82662 - DNA, 1074 bp, Zea mays
  misc_feature: Ceres CLONE 1568518
  misc_feature: Encodes the peptide sequence at SEQ ID NO. 82663
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (51)..(51): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (341)..(341): n is a, c, t, g, unknown, or other
  misc_feature (494)..(494): n is a, c, t, g, unknown, or other
  misc_feature (843)..(843): n is a, c, t, g, unknown, or other
cacaaacaaaattatagaataatgggtgttgtcctttttttatanntnttncacccggttcttctcttnnnagtttggaactccccgcggtggcggccgctctagaatagtggatcccccgggctgcaggaattcgtctcacccctagaaaaaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccccggcctaagcccaaaagaaagagctggccgcncccgcgccacaccacgcgggctcgagccgtcggaccaagccgtgccgcgtgcgcgccgtcgcgtcgcccgtgcacaccccccgcgccacgtcgtccaacggctcggtgaagaccgcgatgacgatgactgagaaccacccagctagggcgtcngagcactcgggcgctggaacccggggaagaacgtgtgggggtggaacatcccacgtgctcatgaacgcaccaccttctggcggagccccgccaccttccggcatctttcaaaaaaaggattttcggggaaagtgattgccaagggtctggggaacccgcgaaagaaagggttctttcattcattccccccaaaacaaactttccttccttttttcccaagcccaaccataacggccggcccaaaccccgccaaaaggaaccggaaaaattccctccagggggaaaccattcctgtccctggggaagccctgaaaaaccttccaaggtaacccttccctggtgaagaaantcgaggggacccctcccgaccgaatttttaccagggggctaattcccctcaactttcccaaggggtgtgttgtgccccacaatttgaccacttgggcctccaggaaaagggcccacttgccccaacaccgggggaaggggttccctccgtggggaatccgaatttttcccaaacctgacaaatgctgggaaaccatttttgtctccattttgcaaaccgggaaattgcgaa

SEQ ID NO: 82663 - protein, 56 aa, Zea mays
  misc_feature: Ceres CLONE 1568518
MTMTENHPARASEHSGAGTRGRTCGGGTSHVLMNAPPSGGAPPPSGIFQKKDFRGK

SEQ ID NO: 82664 - DNA, 811 bp, Zea mays
  misc_feature: Ceres CLONE 1568519
  misc_feature: Encodes the peptide sequence at SEQ ID NO. 82665
ctccccgcggtggcggccgctctagaactagtggatcccccgggctgcaggaattcgtctcacccctagaaaaagaacgccatccgttccatttcttatcccctcctcctcccagtcccagccatcgcctcccgatggcgtccctcgtcacgctccccgccatcgccttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcgggagtgacgacgaggacgaagaagggccgtacgggagcgacgccgaaaaggggttccagggggacgaggaggagctcgccattgccaggctcggcctgcccgacgagctcgtcgccacgctcgagaagcgcgggattacgcacctgttccccatacagagggctgtgttgattcccgctcttgagggccgtgacctgattgctagagcaaagaccggaaaccggaagacacttgcctttggtattcccatgatcaaaaaataatggagcaagacgatggtcggagtacaaggcgaagtcgtactcctcggggttctggttctagcacctaccagaggagtagccaaacaagttgagaaggaaataagggaatcagcacccaagcttgggcacggggtgtgtttatgggcggtgtctcatataatgtccagcagaatggcctctcgccgtgggggttaatgttgtttgtgggcaccactggggcgcataat

SEQ ID NO: 82665 - protein, 149 aa, Zea mays
  misc_feature: Ceres CLONE 1568519
MASLVTLPAIAFSNPATASGAVRLRAAAFRCWALRRRGWAVAAAVASPNSVLSEHAFKRLQLGSDDEDEEGPYGSDAEKGFQGDEEELAIARLGLPDELVATLEKRGITHLFPIQRAVLIPALEGRDLIARAKTGNRKTLAFGIPMIKK

SEQ ID NO: 82666 - DNA, 833 bp, Zea mays
  misc_feature: Ceres CLONE 1568520
  misc_feature: Encodes the peptide sequence at SEQ ID NO. 82667
gcggtggcggccgctctagaactagtggatcccccgggctgcaggaattcgtctcacccctagaaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctaccacagggtgccgagactttgccggagatgttcgacctcctgggcgacgggctgctggttgcggacgccgcgtcgttgggcgcgcccagcggcacggttgccgccaccggtcttcggcaccccgggcgtttccggtccctccgtccctggggcacaatggcgcgccaaaaaggcgcgggctggctcgttgcccgttcccaggaactgcgccccgccgcgggattcagggaagggggaacggtgtggggtccattttaatcctcgagggacttttttccttgtccgttactccccctccaaatggtgacccaacccccctcccatgagttcagatggcccgaacccggaaacatgtgtgtggtgaggggggtcgcacggactttttggcgaccttgg

SEQ ID NO: 82667 - protein, 206 aa, Zea mays
  misc_feature: Ceres CLONE 1568520
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYHRVPRLCRRCSTSWATGCWLRTPRRWARPAARLPPPVFGTPGVSGPSVPGAQWRAKKARAGSLPVPRNCAPPRDSGKGERCGVHFNPRGTFFLVRYSPSKW

SEQ ID NO: 82668 - DNA, 898 bp, Zea mays
  misc_feature: Ceres CLONE 1568521
  misc_feature: Encodes the peptide sequence at SEQ ID NO. 82669
ccccgcggtggcggccgctctagaactagtggatcccccgggctgcaggaattcgtctcacccctagaaaaatcgtttcaccgctattcctcctgccccatctcctcccgatccatccgagcccaaaccctagtccagccagatctccaccgccgccggcgagagcacggcatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcgaccccggtgcgcgctcccgtgatgccgtacgatcgcatcgccgaagccgttaacgccaggctccggcggcttgagcacccagacccgcgcttcctccgctatgcaagccccgttccgtcccacgccgaccacacggccatcctttacggcgccggagacccgggtcaccacgctgcccaacggcctgcgcgtggccacggaagtcgtcccctcgccgcgcgcacggctacggtggggtgtgtggaatccaagcggggcagccggtaccaaaaacaggaggcgggccggtggtcggcgcatttttggtcgaagaccttgctggttcaaggggcacagggaaaagcgtagcgccccgcgcaagctgggagccaggagaattgagggaaatggggtggggcgcccttcaaacgcctttacaacgtgcggggggaaggcagaactacccttatttgcgcccaaagggggccttgtgaaaagggaccttggccccccggggccgaaggagaggggccttctcccgggaaattctcgtggaggaaacttcccaatttttcgcgaccaagtcccccccattattgaaagt

SEQ ID NO: 82669 - protein, 158 aa, Zea mays
  misc_feature: Ceres CLONE 1568521
MAFRRILSTAVRRRSAIAAAASGNAREASTAVAAAPGVLAPDATPVRAPVMPYDRIAEAVNARLRRLEHPDPRFLRYASPVPSHADHTAILYGAGDPGHHAAQRPARGHGSRPLAARTATVGCVESKRGSRYQKQEAGRWSAHFWSKTLLVQGAQGKA

SEQ ID NO: 82670 - DNA, 832 bp, Zea mays
  misc_feature: Ceres CLONE 1568522
  misc_feature: Encodes the peptide sequence at SEQ ID NO. 82671
ctggagctcaccgcggtggcggccgctctagaactagtggatcccccgggctgcaggaattcgtctcacccctagaaaaaaatctctctcttctcctcgcctcgccttggtgttcacgccgtcgctagcgcctgccgcggcgaagcttctgccctccccggcgccgggctcgggtcgtcgtcggccaggaagatggctggcggcttcagggtactgcatctggtcaggccttttcttgctttcttgccagaggtgcagagcgcggataggaagataccgttcagagaaaaagttatctacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagaagagatcgtgctctgctgaatggtgcacaaaagttgcttggtatcctgattgctattggggaagctgtggcatatgtcctgtctggaatgtatggcagtgtaagccaacttggaacagggaatgctatcctcattatacttcagcttttctttgctggcatcattgtcatctgtctggatgaacttctccagaaaggtatgggcttgggatctgggcattctctggtccatggctaccatatctgccagatatcatctggaagggatttagccccaccacatcaacaggggccggggggctgaatttgaaggg

SEQ ID NO: 82671 - protein, 209 aa, Zea mays
  misc_feature: Ceres CLONE 1568522
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVRRDRALLNGAQKLLGILIAIGEAVAYVLSGMYGSVSQLGTGNAILIILQLFFAGIIVICLDELLQKGMGLGSGHSLVHGYHICQISSGRDLAPPHQQGPGG

SEQ ID NO: 82672 - DNA, 878 bp, Zea mays
  misc_feature: Ceres CLONE 1568523
  misc_feature: Encodes the peptide sequence at SEQ ID NO. 82673
  misc_feature (715)..(715): n is a, c, t, g, unknown, or other
  misc_feature (826)..(826): n is a, c, t, g, unknown, or other
  misc_feature (828)..(828): n is a, c, t, g, unknown, or other
  misc_feature (833)..(833): n is a, c, t, g, unknown, or other
  misc_feature (848)..(848): n is a, c, t, g, unknown, or other
  misc_feature (878)..(878): n is a, c, t, g, unknown, or other
tccccgcggtggcggccgctctagaactagtggatcccccgggctgcaggaattcgtctcacccctagaaaaaatccatcacagaccaccacaccaacaacagactacggaggaccgccgccgcccacgcaaaaacccacccgatccccgcaaaaacccccgcacgcgatccacgccaattccagtcaccgcgatgcagggtctcgccccgcccacctctgtttccatacaccggcacctgccggcccggtccagggcccgggcctccaattccgtcaggttctcgccgcgcgccgtcagctccgtgccgcccgccgagtgcctccaagcgccgttccacaaggcccgtcgcccgacctgtccgggcgcccgtccagagaaagcccgcccgccattttgggggcccccccagacaactcccagggggggcccaaaggaaaagccgggacggggggggccaaaaaaaacaagctttaaaacttgggttcccagaccgccaccccccggggaggggtcccccggcccttcgaaaagcccggttttccaaaaggaaaaaggggggtttccggtgggggccccaaaaaaggttttctccttgtgggaaaaaagaggtgggggcgcccccccccccggggggggggtgggtgcctccttcaaataaggaggggggggggggaaaaaaaataaaaagggggcggggggggagtggggtgtntagaataaagaattgacggccggggtgaagggaagagatgagagaatattttatccagccagcccccctcctctggtgttaggggaaaaagagagagggacccacgccctntntcaanttgcggatctgtgtnttgttcataagagatcagtcgctgacgccn

SEQ ID NO: 82673 - protein, 155 aa, Zea mays
  misc_feature: Ceres CLONE 1568523
  misc_feature: SWISSPROT Homolog: EC 1.13.11.51 9-cis-epoxycarotenoid dioxygenase
MQGLAPPTSVSIHRHLPARSRARASNSVRFSPRAVSSVPPAECLQAPFHKARRPTCPGARPEKARPPFWGPPQTTPRGGPKEKPGRGGPKKTSFKTWVPRPPPPGEGSPGPSKSPVFQKEKGGFPVGAPKKVFSLWEKRGGGAPPPGGGVGASFK

SEQ ID NO: 82674 - DNA, 972 bp, Zea mays
  misc_feature: Ceres CLONE 1568527
  misc_feature: Encodes the peptide sequence at SEQ ID NO. 82675
ctccccgcggtggcggccgctctagaactagtggatcccccgggctgcaggaattcgtctcacccctagaaaaaaaacggctccgccgcgctcgaattccccccaccttccaccaggccagcaccatggccactaccgccctcctcctccgcactcaccaccatccctgcaagccgccggcgccgcgcgcgtccgtactctgccgcgccacggcggggatggctgggccggcgtcggccgcggcgctgcggtccctggccccgcccacgcggccggagctgctgtcgctcgacctgccccgctacgtacccagcgcccgcccgccccgtggacctcaccatggtaggcggcgggcccgcggggcctcgctgtggcgcaccccgttgcgggaggcgggcctgtccgggggagccattgacccgtcccccacggtcgtgaggaccaacaactacgggctgggggggggacgaagtttgaaagcccaatgggtctcctcccactgggcttgaaaacctggttgggccctgccccccaccctgtcttcgcccccaccaaacggcactgtgccccagatgggccgccgtatccgacaccccctaagggcccacagctgtacccgtccgaacgcgcaaggcggtcggaaagtgccgcctacaattagtatgctctcccccctcttttagatacagcaccaagaggggggggtacaacatgtgtgcgcacgatggggccaagaggacctccccgagggaccctcctccccctcaagcacaacttggatatcccaaccctaggtcacagaggaagaaaaagagagttcgtcgtgttctcagaaaaagagggtgaggggacagggagggtgtcggggaaattacttgggacagaaacaggtggaacagaatcattgtggggcgaagtaactcgggggtgaaacacgggaacccttcggggctccctttatggaaaagatta

SEQ ID NO: 82675 - protein, 127 aa, Zea mays
  misc_feature: Ceres CLONE 1568527
MATTALLLRTHHHPCKPPAPRASVLCRATAGMAGPASAAALRSLAPPTRPELLSLDLPRYVPSARPPRGPHHGRRRARGASLWRTPLREAGLSGGAIDPSPTVVRTNNYGLGGGRSLKAQWVSSHWA

SEQ ID NO: 82676 - DNA, 825 bp, Zea mays
  misc_feature: Ceres CLONE 1568528
  misc_feature: Encodes the peptide sequence at SEQ ID NO. 82677
  misc_feature (374)..(374): n is a, c, t, g, unknown, or other
  misc_feature (600)..(600): n is a, c, t, g, unknown, or other
  misc_feature (629)..(629): n is a, c, t, g, unknown, or other
  misc_feature (667)..(667): n is a, c, t, g, unknown, or other
  misc_feature (753)..(753): n is a, c, t, g, unknown, or other
ctccccgcggtggcggccgctctagaactagtggatcccccgggctgcaggaattcgtctcacccctagaaaaagaagccggcagagacacactgcacgcacacacagacagccatggcggtcgggggcgatgccaacggcggcggcggcggggtgcgtcagcgccagcgcgggtgttcgtgcaccaaggcggacttcttcccggaggagtcgttctcgagctggtcggcgtacgggcgggcgctgcgcagcacggggccccggctggccgaccgcctcacgtcgcggtcgctggagtcgacggagctgcacgaggtgcgcgcccgcagcggcgccgacatgaagcgggacctcacgtggtgggacctggtgtnggttcggcgtcggcgccgtcatcggcgccgggatcttcgtgctcactggccaggaggccagggaggacgtcggccccgccgtcgtcgtctcctacgtcgtctccggcgtctccgccatgctctccgtcttctgctacaccgaattcgccgtcgagatccccgtcgcaggtggatcgttcgcgtacttgcgggtggagctcggcgacttcatggcgttcgtggcggncgggcacatcctgctggagtactgcatcngcggcgcggccgtggcgcgcgcctggacgtcctacttncgcacgctgctgaaacacccagccagcgacttccgcatccacgcgtcgtcgctctccgccgactactcggagctggaccccatcgncgtcgtcgtcatcgcgctcgtctgcatcttccgcgtggccagcaccaaaggcacctcccgctttcactacct

SEQ ID NO: 82677 - protein, 111 aa, Zea mays
  misc_feature: Ceres CLONE 1568528
  misc_feature (37)..(37): Xaa is any aa, unknown, or other
  misc_feature (47)..(47): Xaa is any aa, unknown, or other
  misc_feature (59)..(59): Xaa is any aa, unknown, or other
  misc_feature (88)..(88): Xaa is any aa, unknown, or other
MLSVFCYTEFAVEIPVAGGSFAYLRVELGDFMAFVAXGHILLEYCIXGAAVARAWTSYXRTLLKHPASDFRIHASSLSADYSELDPIXVVVIALVCIFRVASTKGTSRFHY

SEQ ID NO: 82678 - DNA, 831 bp, Zea mays
  misc_feature: Ceres CLONE 1568532
  misc_feature: Encodes the peptide sequence at SEQ ID NO. 82679
ggagctccccgcggtggcggccgctctagaactagtggatcccccgggctgcaggaattcgtctcacccctagaaaaagcggccacgccttctccaccgttcgtccgtccattcccattctcatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagagggatgaaggatcaactgctggcagcatccaggcgcaaacaagggcacttggagggaaggaggggggtttcaagggccaaggggggggctgggaaaaaaacaaccccaggggggggggcccaccatcaaaaaaagcgggggggcccccaaaaaaaaacccttttgggtgggccccaaaaaaaaacccctttttttgggggagagaaaaaaataatgggggggggaaacccccctaaaaaaaaaaaaaaaaaaacaaacctctgccccccccccccccctacttttttttggcgggggggggggggggggagaaccccacaagaaaaaacaaaccctttcctgttttttttttccctccacgggcccgcccccccccgacaaaaacaaatgtaatagggtggggcgtttttccccccccacccccc

SEQ ID NO: 82679 - protein, 106 aa, Zea mays
  misc_feature: Ceres CLONE 1568532
  misc_feature: SWISSPROT Homolog: EC 2.7.7.27 Glucose-1-phosphate adenylyltransferase
MQFSSVLPLEGKACMSPVRRGSGGYGSERDEGSTAGSIQAQTRALGGKEGGFKGQGGGWEKNNPRGGGPPSKKAGGPPKKNPFGWAPKKNPFFWGREKNNGGGKPP

SEQ ID NO: 82680 - DNA, 892 bp, Zea mays
  misc_feature: Ceres CLONE 1568533
  misc_feature: Encodes the peptide sequence at SEQ ID NO. 82681
ctccccgcggtggcggccgctctagaactagtggatcccccgggctgcaggaattcgtctcacccctagaaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgctgaccatcgacgagctgcactcgctgcagcggaagcggtcggcgcccagctcgcccaagcggtcggcgcccaccacgcccatcaagggcggcgcccactcgcccttcgccgtcgcgatctccgaggaggagcgccacacgcagcagatgcagtccatcaggtgcgtcgttggcgtcctctgacgcgtgtaaccggggccgaaagtggtcaagggcgaccccggcggcgaagggagaggccgccgcgcagggcgcgccatcgactgccgagggcgcaccagcagctactccacccccgccgcccccgccatcgccgtcagcgacagcttccctcaaggttcactgcatgtgctcaacaacactctccccctgcttgaactgtacggaacaaggccatcaagtaccaagaagggggtcgttccatcacgtcccaccgggcgcagctggccgacgcttttcctggtggcccaggtaccgggcgggtcttcccaggggaacaaacccgttcggtctagggacgaagggccccccccgcaaggaacccgtttggtggggggcaagggtctccggcccaaactatcggaaatgggaacgaaaaaaaaacgttttccgggaaccaaaaggggggaag

SEQ ID NO: 82681 - protein, 93 aa, Zea mays
  misc_feature: Ceres CLONE 1568533
  misc_feature: SWISSPROT Homolog: EC 4.1.1.49 Phosphoenolpyruvate carboxykinase (ATP)
MATPNGLARIETTGKKKQDNGVWYDDSSAPVRALTIDELHSLQRKRSAPSSPKRSAPTTPIKGGAHSPFAVAISEEERHTQQMQSIRCVVGVL

SEQ ID NO: 82682 - DNA, 839 bp, Zea mays
  misc_feature: Ceres CLONE 1568534
  misc_feature: Encodes the peptide sequence at SEQ ID NO. 82683
ctggagctccccgcggtggcggccgctctagaactagtggatcccccgggctgcaggaattcgtctcacccctagaaaaatctcttcttccactgcctcccaaccacttcgtcctcgccggctcgcaactccttgatggcggccacggcgagtctcactaccactgctccctcccctccagctctcctcaaagcatcagctcctttgcttatctcctttcgccccgtctcccgccactgcaagaacctgtgcatcaagaccaaggccacagaaaatgatcagtctgctaaaaagcatcagaaggtgaagagcattctttgccaggactgcgaaggaaatggggcaatcacatgcaccaaatgtgaaggaaatggggtaaattctgttgactattttgaaggccgatttaaagctggatctttatgctggttgtgcagaggcaagcgtgaaatcctatgtgggaactgtaatggtgctggcttcttgggtggatttctgagcactttcgatgaaactgcgcaatagtcatcggtttaatttatgtttaagttacattgagggacccattatatatgtatcgtgttccagggacacataatcatattatataaaataataccgcatcgcctcgccgctgttccccgcaacctatcgacccaatctcgtccgacccgggcgcgtcgtcccctccagatctccgtcgccctctccagttagcaaaaactgttctgctgcagtctgacaaagtggagggcttaggagcttcggctccttttatgtctgaccaatccttgctttatttgggaattggtgggagagtactcctcgtgcaactagga

SEQ ID NO: 82683 - protein, 129 aa, Zea mays; identical to SEQ ID NO: 52207
  misc_feature: Ceres CLONE 1568534

SEQ ID NO: 82684 - DNA, 781 bp, Zea mays
  misc_feature: Ceres CLONE 1568535
  misc_feature: Encodes the peptide sequence at SEQ ID NO. 82685
ctccccgcggtggcggccgctctagaactagtggatcccccgggctgcaggaattcgtctcacccctagaaaaaaatcgccctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcacgtcccgctacgacttcgaccggttcggggtcatctttcagtcgtcgccgcgccagtccgatggcatgatcggtcgcggcacgctcaccaacaagatggcttccgccctcccgaaaggtaatggaccaatggctgagcctaagtggggttatttcattgggcagctgtgccaacgggggtgggatacaaccattacccccaccctggtggaccggggaagtgaaccgtttaggccccgggggaaatcccacctccctggggggcccccccaactggctaaaggacctgttgttacggggtttttttcaacccccaaaaaaaaatcaaacagggggaaggggtttccccctcccgggggggacaaaagggaaaactggtccccggtttata

SEQ ID NO: 82685 - protein, 172 aa, Zea mays
  misc_feature: Ceres CLONE 1568535
  misc_feature: SWISSPROT Homolog: EC 1.6.5.3 NADH dehydrogenase (ubiquinone)
MSKTAEFVVSKVDDLMNWARKGSIWPMTFGLACCAVEMMHAGTSRYDFDRFGVIFQSSPRQSDGMIGRGTLTNKMASALPKGNGPMAEPKWGYFIGQLCQRGWDTTITPTLVDRGSEPFRPRGKSHLPGGPPQLAKGPVVTGFFSTPKKKSNRGKGFPPPGGDKRENWSPVY

SEQ ID NO: 82686 - DNA, 787 bp, Zea mays
  misc_feature: Ceres CLONE 1568538
  misc_feature: Encodes the peptide sequence at SEQ ID NO. 82687
ctccccgcggtggcggccgctctagaactagtggatcccccgggctgcaggaattcgtctcacccctagaaaaaaacacaccatcaaattaatcgcgctccttctcccaccagctctccccctttttttcctgcccacatacaaatgcttgggcattagcgatcctcctcctcgttctccttccccttctccctcctctgggtctgggtgcgccctcccctgctccacttctccggcgctgacatgacgtccacggcgtactcgcggtcgtccaagctgccgggcggcgagcggcggctgcccccgcgcctcatgcgggggttcgcgtccaagatcgagcccaagaagctgggcgtcggcctcatcgccggctgctgcctcgcgctcctcacctacgtctccctcgccaagctcttcgcaatctactcccctgtcttcgctagctcggccaacacgtccgcgctgatgatgcagaacgcgccgccgacctcgtccaagccgtccgtgccggagacggagaccatcccgccgcatgagacgataggcggcggcggcgacagctcggatcccgtcgatctgcgtgagggcgcgacgggctccgaggagcccgggctgccggaagctgccctcacgaggaatgacatggccggcgggcgtcgacgagccccggcttgcccccaggaaagacgacggctaagatgcggcggccgagccccccccccaagccatctgaggattgcaaggggcaatggcagttggtggccgggcaagaattttggcaaaaata

SEQ ID NO: 82687 - protein, 181 aa, Zea mays
  misc_feature: Ceres CLONE 1568538
MTSTAYSRSSKLPGGERRLPPRLMRGFASKIEPKKLGVGLIAGCCLALLTYVSLAKLFAIYSPVFASSANTSALMMQNAPPTSSKPSVPETETIPPHETIGGGGDSSDPVDLREGATGSEEPGLPEAALTRNDMAGGRRRAPACPQERRRLRCGGRAPPPSHLRIARGNGSWWPGKNFGKN

SEQ ID NO: 82688 - DNA, 907 bp, Zea mays
  misc_feature: Ceres CLONE 1568539
  misc_feature: Encodes the peptide sequence at SEQ ID NO. 82689
ggagctccccgcggtggcggccgctctagaactagtggatcccccgggctgcaggaattcgtctcacccctagaaaaaaaccctcgcttacctcccgtcacgtcgcgtccgaacggcgacgctgcgccgtgatggacgccttcttcggcaagggcggcggcggcggcggcttccgcggcgcctagtgcaagacgctgctgaagctgtcgatcccgcggataaagctgctgcggaaccggcgggagctgcagctgcgccagatgcgccgggacatcgccaagcttctcgaggccggccaggaggccaccgcgcggatcagggtggagcacatcatccgggaggagaacatgatggccgcgcaggagatcctcgagctcttctgcgagctcatcgctgtgcgcctgcccatcatcgagacccaaagggcgtattatcttgaagtataaagcagggatcctgaatcctgctcgtgaatacaaatgggctatagttgataaaattgattaactgttttgtgactaaaaattctgcaagagatgcagataagtctgacctgaattgtgtttcccttgttttgttggctttcagggagtggtcctattgatctcaaagaagcaatatccaggtttcttgtttcgctgcctccaagaatgtgcagaattctacctgaaactggaaacaaggttccaaatggaagtttggcacctaaaatttggggaaagggaattttgtcccctgcccccttcacgaagttgaatgccctggaaatggggggggtgcaaatccggccaaaaaaatttgaaacctaccgtttcttaattgccggcccccctctcctgtggtccaatgggaaaaaggtgtgaaaaacctggcgtggaaggaaaaattaccctagaagaggaaacat

SEQ ID NO: 82689 - protein, 61 aa, Zea mays
  misc_feature: Ceres CLONE 1568539
  misc_feature (1)..(60): Pfam Name: DUF292 Pfam Description: Eukaryotic protein of unknown function, DUF292
MRRDIAKLLEAGQEATARIRVEHIIREENMMAAQEILELFCELIAVRLPIIETQRAYYLEV

SEQ ID NO: 82690 - DNA, 842 bp, Zea mays
  misc_feature: Ceres CLONE 1568540
  misc_feature: Encodes the peptide sequence at SEQ ID NO. 82691
  misc_feature (566)..(566): n is a, c, t, g, unknown, or other
  misc_feature (770)..(770): n is a, c, t, g, unknown, or other
  misc_feature (776)..(776): n is a, c, t, g, unknown, or other
  misc_feature (777)..(777): n is a, c, t, g, unknown, or other
  misc_feature (842)..(842): n is a, c, t, g, unknown, or other
ctggagctcaccgcggtggcggccgctctagaactagtggatcccccgggctgcaggaattcgtctcacccctagaaaaaaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatggcggtgatggccgaagtagtctcgaccaccggcgcggcgctccggagcccggcctcgcagccgctgccggccgcggtgaagaacgcagacgctgagaagctccagttcatcgaggagatgacctccaacgtggacgccgtgcaggagcgcgtgctgggggagatcctcgcccgcaacgccggcaccgagtacctcgccaagtacggcctcgccgccgctactacggaccgcgccaccttccgcgccaaggtgccgatggcgacgtacgaggacctgcagccgtacatccgccgcattgccgacggcgaccgctcgcccatcctgtcgggggncaccggtctcgagttcctcaccagctccggcacgtccgccggcgagcgcaagctcatgcccaccatcgaggacgagctccaccgccgccagctgctgtacagcctccagatgcccgtaatgaacctgtacgtgcccgggatggaacaagggaaggctctccatttccctcttcgtgaagtcggagacgaagaacgcgggccggnctcccnngcgagccccgtcctgacgagctactacaagagcaaccacttcaagaacggcccggttccacgccn

SEQ ID NO: 82691 - protein, 203 aa, Zea mays
  misc_feature: Ceres CLONE 1568540
  misc_feature (33)..(203): Pfam Name: GH3 Pfam Description: GH3 auxin-responsive promoter
  misc_feature (112)..(112): Xaa is any aa, unknown, or other
  misc_feature (180)..(180): Xaa is any aa, unknown, or other
  misc_feature (182)..(182): Xaa is any aa, unknown, or other
MAVMAEVVSTTGAALRSPASQPLPAAVKNADAEKLQFIEEMTSNVDAVQERVLGEILARNAGTEYLAKYGLAAATTDRATFRAKVPMATYEDLQPYIRRIADGDRSPILSGXTGLEFLTSSGTSAGERKLMPTIEDELHRRQLLYSLQMPVMNLYVPGMEQGKALHFPLREVGDEERGPXSXASPVLTSYYKSNHFKNGPVPR

SEQ ID NO: 82692 - DNA, 815 bp, Zea mays
  misc_feature: Ceres CLONE 1568541
  misc_feature: Encodes the peptide sequence at SEQ ID NO. 82693
  misc_feature (395)..(395): n is a, c, t, g, unknown, or other
  misc_feature (404)..(404): n is a, c, t, g, unknown, or other
ctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcagctgcggctgcngcggcagcngccaacggaaaagcgtgctgccacgccgccaaggggcccgggtacgccacgccgctggaagccatggagaagggccccatggagaagctcgtctacgtcacctgcgtctacaacggcactgggaattacgagccggaataccttgcgacgtgggatttggatcccagctctcctcatactcccaggtgatccacagctccggtcaccccacattcgggggacgagctgcatcactctgggctgaactcctgcagctcctggcacgggtgacccatcgggcaagcgccgcttcccgaatctgcccttccttgctgtcaagccttgtgtatgttttcaaccaagcgacgaaccaaggggggcatcccttgcaaagggggggtgaatcctgaggaatttgctgaaatacggggg

SEQ ID NO: 82693 - protein, 81 aa, Zea mays
  misc_feature: Ceres CLONE 1568541
MAGAAAVETAAAAAAAAAAANGKACCHAAKGPGYATPLEAMEKGPMEKLVYVTCVYNGTGNYEPEYLATWDLDPSSPHTPR

SEQ ID NO: 82694 - DNA, 828 bp, Zea mays
  misc_feature: Ceres CLONE 1568542
  misc_feature: Encodes the peptide sequence at SEQ ID NO. 82695
  misc_feature (670)..(670): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaaaagcccggacacatggccagcttcggcgtcgacacccgcccggccgccgcggcctccggcggcggcgtgggcgtggcggggacgagggagggcgcgctctcgtttctctcccgcgggctgcgggaggaccttcgtctcatccgcgcgcgggccggggagctcgagaccttcctcagcgcgccggtgccggaacccgagctgttcgcgcgcctccgtcgcgcctactcctcctcggcgtcctcttcgcggacgcggctcgacctgtccgccatcgggaaggcgttcgaggccgacgcgtggaggggcgccaggactgccaggtggaggtgggaggcggagacggaggcggaggagtgggagccagtcaggatggtcatagcgcacctcagcgagctcgagcggaggaggctggcccagtcgcccagcgacatgctgcacaagctcaagctcagcttgaaatcactgacctttgcgcctgaagcgtctgaggatgttctgccactggatttaggggaacttcttgcttatttgtaaaggcatctgtaccactattcgaccaacttggtataaaaagagatgtatggtgacagtttggnggagtctctgtgcagcaagcgcaaggacccccctgcatatagttttttgtcagccactggatcatcttcatcgaaaaatgacattgttggggatgaactcgacctaagatagctagcgcccttacgagtaccggacacccttttgaaggtggattttn

SEQ ID NO: 82695 - protein, 173 aa, Zea mays
  misc_feature: Ceres CLONE 1568542
MASFGVDTRPAAAASGGGVGVAGTREGALSFLSRGLREDLRLIRARAGELETFLSAPVPEPELFARLRRAYSSSASSSRTRLDLSAIGKAFEADAWRGARTARWRWEAETEAEEWEPVRMVIAHLSELERRRLAQSPSDMLHKLKLSLKSLTFAPEASEDVLPLDLGELLAYL

SEQ ID NO: 82696 - DNA, 817 bp, Zea mays
  misc_feature: Ceres CLONE 1568543
  misc_feature: Encodes the peptide sequence at SEQ ID NO. 82697
ctccccgcggtggcggccgctctagaactagtggatcccccgggctgcaggaattcgtctcacccctagaaaaagcacaccactgtactcgcctgtagctcgccggagatccatgcctttgtgagctcgagtggagagaaaaaaaaaaggagcagcgaagagcgaacgaccgagatgctggagaagctgtgggacgacgtggtggccgggcctcgcccggagacgggcctcgagaagctccgcaaggccaccaccgcccgcccgctcgtcgtcgtcgacaaagaaataactacatgcatcttctcatctgctggattgagtacatagaacacttgtgcaacacattcggcgagaacacgggtcatctttatattctactttctttaagtataccagtgtgagtaccagtgtggtccgtagttattcattatcacccccacgggatgttgtacccattgacacttaaataaagggtattttcatgcttgggccaaaaaaaatctcccatcccatccagccatcctccgctttcccttcccctcgccgccccccaccccccagatcggcaaatccgcccgcacctaccccgcgcgcgtcgcgcgtcccggatggccatcgtctcctccgcccgactcgtggttccgtagcatgggcccactccccctcttccctttccaaatccggcccctcctctccaacggggcgaagaaggtgggtctcccccatggcgccgcccgcagcagctgcggcttgaccgcgccgttgcaggtccctgcggggggaagcggcagcaactcgtcctcctcgttcggggccc

SEQ ID NO: 82697 - protein, 50 aa, Zea mays
  misc_feature: Ceres CLONE 1568543
MLEKLWDDVVAGPRPETGLEKLRKATTARPLVVVDKEITTCIFSSAGLST

SEQ ID NO: 82698 - DNA, 870 bp, Zea mays
  misc_feature: Ceres CLONE 1568544
  misc_feature: Encodes the peptide sequence at SEQ ID NO. 82699
ggccgctttcgaactagtggatcccccgggctgcttgaattcgtctcacccctagaaaaaactctcagatccgcgtcctcggctcctcctcctcctcccttccttcgttccttccagatctccctcccagtcgagagtcgagatccaccgcctccgcgccccctcaccggagcagcgcgaggaagcggggggccagaggccagccatgggcaaggaaggggccagcgacggcggcatgtcggagtcggtgatccgcaaggtcctggtctcgtacatgtacgtggcggtgtggatcttcctctccttctccgtgatcgtctacaacaagtacatcctcgaccccaagatgtacaactggcccttccccatctccctcaccatggtgcacatggggcttctgctcctccctcgccgtggcgctcgtccgcgtcctccgcgtcgtcgaactcccgtcctcgcccgccatgacgtcgcagctcttcgtctcctccgtgctccccatcggggcggctctactccttctcgctctggttctccaaactccgcctacatctacctcctccgttctccttcatcccaaatggctcaggggggttattggcccgttgcccgtctactcccatggggggtcctcttccaagaaaagggagactttcaaggccctccggccaggctcaaacaggggtctcaattttcggttcgggggttgagcatttcgccggctctgcgggagaggggcccgcttttgaaaaccccgggggggttggccccgggtaaaattacccccgcccgaaggacctttttgggggtcaaagcgagccctcgggccttatattaacgaaaaaccggccgagtatctccccaaggggg

SEQ ID NO: 82699 - protein, 210 aa, Zea mays
  misc_feature: Ceres CLONE 1568544
MGKEGASDGGMSESVIRKVLVSYMYVAVWIFLSFSVIVYNKYILDPKMYNWPFPISLTMVHMGLLLLPRRGARPRPPRRRTPVLARHDVAALRLLRAPHRGGSTPSRSGSPNSAYIYLLRSPSSQMAQGGYWPVARLLPWGVLFQEKGDFQGPPARLKQGSQFSVRGLSISPALRERGPLLKTPGGLAPGKITPARRTFLGVKASPRALY

SEQ ID NO: 82700 - DNA, 847 bp, Zea mays
  misc_feature: Ceres CLONE 1568545
  misc_feature: Encodes the peptide sequence at SEQ ID NO. 82701
  misc_feature (266)..(266): n is a, c, t, g, unknown, or other
agctccccgcggtggcggccgctctagaactagtggatcccccgggctgcaggaattcgtctcacccctagaaaaacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgaaagcccccacgtgcggtacggcncgacggagatcgagtcggagtaccggtacgacacgacggagctggtgcacgaggccaaggacggcgcctcccggctgggtcgtccgccccaagtccgtcaagtacaacttccggaccagcaccgcggtccccaagctcggggtcatgcttgtgggggttggggaggcaacaacgggtccacgctgacggctggggtcattgccaaaggggaggggatctcatgggcgacaaaggacaaagtgcagcaagccaactactacggctccctcacccaggcttcaacatcagaagtagcagctacaaccgggaggagaattatgcgcccgttcaagacctccctacccatggtgtacccagacccaccttgtggtttggaggctgggacatcagcagcatgaaacttggcagatgccatgaccaggggccaggggcggggaattggacctgcagaaaccgctcaagcccttccgggaagcccagggggcccccttccggggggtcctttgatcccggacttcattcgccgcctaaccggggctctcggtgccaaaaattgtccctcagggcacccaagaaataaa

SEQ ID NO: 82701 - protein, 148 aa, Zea mays
  misc_feature: Ceres CLONE 1568545
  misc_feature: SWISSPROT Homolog: EC 5.5.1.4 Inositol-3-phosphate synthase
  misc_feature (17)..(17): Xaa is any aa, unknown, or other
MFIESFRVESPHVRYGXTEIESEYRYDTTELVHEAKDGASRLGRPPQVRQVQLPDQHRGPQARGHACGGWGGNNGSTLTAGVIAKGEGISWATKDKVQQANYYGSLTQASTSEVAATTGRRIMRPFKTSLPMVYPDPPCGLEAGTSAA

SEQ ID NO: 82702 - DNA, 829 bp, Zea mays
  misc_feature: Ceres CLONE 1568546
  misc_feature: Translation starting site: 139
  misc_feature: SWISSPROT Homolog: EC 1.1.1.95 Phosphoglycerate dehydrogenase
  misc_feature (807)..(807): n is a, c, t, g, unknown, or other
ctccccgcggtggcggccgctctagaactagtggatcccccgggctgcaggaattcgtctcacccctagaaaaagcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggtgcgccggatctcgccgtccgcgccggacggcgcgctgcggcccaagccggcggtgctggtcgccgagaagctgagcgaggccgggctggccgtgctgcggcagttcgcggacgtggagtgcgcctacggcatgtcccccgcggagctcctcgccaaggcggcgcagttcgacgcgctcatcgtgcgcagcggcaccaatgtgacgcgggaggtgctggaggccgggcatggccggctgctggtggtgggccgcgcgggcgtcgggatcgacaacgtcgacctccaggccgccaccgaggtcggggtgcctcgtcgtcaacgcgcccaccggcaacactatcgccgcggccgagcacggcatcgcgctgctcgccctcatggcgcgcaacgtctcgcaggcggacgcggcgctcaaggccgggtaatggcaaagaacaagtacgtgggggtttctctgggtgggaaagaccctggncgtcatgggcctcgggaaagga

SEQ ID NO: 82703 - DNA, 815 bp, Zea mays
  misc_feature: Ceres CLONE 1568547
  misc_feature: Translation starting site: 245
  misc_feature (722)..(722): n is a, c, t, g, unknown, or other
ctccccgcggtggcggccgctctagaactagtggatcccccgggctgcaggaattcgtctcacccctagaaaaactgcgcagggagccagggacgcggacgcggcggcaccggcaagcggcaagcaattgtctcatctgctccactccatctccatttaacgcactctccactccttcgcggcgggggtttaggcgcacggcggcaggccaattaacgccgctgcggcgagcaccgggggggaaatgggcggcgacggcacgagggcgctggaccagacgccgacgtgggccgtggccgccgtctgcgctgtcatcgtcgcggcgtccatactcctcgagggcttcctccaccacctcggtcagttgctcaacaagaagcggaagaaggcgctgtttgacgctctggagaaggttaaatcggagctgatgactctggggttcatatcgctgctgctgaccgtgacgggaaggtacatcgcgcgcatctgcatcccggagggagccgcaaacaccatgctgccctgccgcctgtccggtcactcggtggcggaagagcccaagggccatggccgacggcacctatctgaagatcaaccaaccttttttcctgccgcaaaggcatggtgtcgcttgtttcagccgacggcatgcatcagctgcacattttcgtgttcttcttgaccgtcttacatggttaccttcagtttcttcacaatgtccnttgggtagagcaaagactcgtatatggaagggggtgggaaaaggaaaacttgctccccctcagtatttttattttaaatgaccccttcaaagt

SEQ ID NO: 82704 - DNA, 831 bp, Zea mays
  misc_feature: Ceres CLONE 1568548
  misc_feature: Encodes the peptide sequence at SEQ ID NO. 82705
ctccccgcggtggcggccgctctagaactagtggatcccccgggctgcaggaattcgtctcacccctagaaaaaaaaaaatctccttctgggcgcaccaggaaaaaaattgatacattcctcggcagctgcgcgagtcctctgttgataccccggcgacccaaagcccccgtccgagcagcagcagcagccgccgcctaaaagtaacaggattggggatttttttttttgcttcgtgttctccttctcctgctgtaggcgttgattcgggtgatgagagatgggcttcttggcgtgcttgtgccgatgccctcaggacggggacgacgacgagaaggagggggagcagttcagaatcaaccaccaggtcgcctcagtggactacccaaaatcttctgaaagcagcccattgaaggctgagagagtggttcatatggacggagcgcagctaattggtagacatgatgaagcaacaatcttcacgttgcgtcagcttgctgaggctaccaataatttcaggcaggactctcttttggggcgatgtggattcggttgcgtctacaaggcaactcttagtaatggacaggttgttgcagtcaaacaacttgatctaaatggggcttcaagggaacagagatttcctcgtggaggtctcatgctcaaccctctgcatcaccataatctagtcaatctgcatgggtactgtgttgatggccatcaacgcttgctcgtttatgagtatttgcctttgggatcactaaagatcatctacatgatcttgttcctgatcaacacctctagattggaaaaccgggatgagaatgctgctggg

SEQ ID NO: 82705 - protein, 184 aa, Zea mays
  misc_feature: Ceres CLONE 1568548
  misc_feature: SWISSPROT Homolog: EC 2.7.11.1 Non-specific serine/threonine protein kinase
MGFLACLCRCPQDGDDDEKEGEQFRINHQVASVDYPKSSESSPLKAERVVHMDGAQLIGRHDEATIFTLRQLAEATNNFRQDSLLGRCGFGCVYKATLSNGQVVAVKQLDLNGASREQRFPRGGLMLNPLHHHNLVNLHGYCVDGHQRLLVYEYLPLGSLKIIYMILFLINTSRLENRDENAAG

SEQ ID NO: 82706 - DNA, 841 bp, Zea mays
  misc_feature: Ceres CLONE 1568550
  misc_feature: Encodes the peptide sequence at SEQ ID NO. 82707
ctccccgcggtggcggccgctctagaactagtggatcccccgggctgcaggaattcgtctcacccctagaaaaaacagccgccgcgcccacaaatcacgcgactcccgcttccatgtcctcgcgtcctccattgcagccgcatacatagcgtcgccccttccatcgatggcagccagccgcgcccgcaaatcacgcgactcccccttccatggcgtcgcccccttccatccatggcaggtccgcgcccctacgccccaaatcacgcggatggaaggtatgcgcctcctctccctattgctcagtgtaggcagtccccaaatccgcgcgtccgcgccacctcctactctgcgctccccgttccatgtcacgcgcacctgctcccgcaccggagaacccaccgcaagccgaactcgtcctgagatggcggtggcgctgtgcttcccaggggtcgcgagggagtctctctctggacgcgcccgtcgccgcctcccagctcaggaaggagcggcgcccggcccccgcgagcgtgaacccgggccacaatgcttgaagcggaagaggggcctggcgggtcgctgccagacggggtccaccgcaacgccctttcctcagacggaggagccccccccggctgcggcggggggaaagaatgcccaaggcggggttcaaccttcgtcatgaaatttcgggcggctcgtcgcctcgcgtcaacccaagggaaatgcgggaggtgggccggccctcatcctttaacttccctccaacaaaaatgcctggtccccggtccttctccccccaggggggaaaaaccccaaattaaccttcctccttaggaaacta

SEQ ID NO: 82707 - protein, 56 aa, Zea mays
  misc_feature: Ceres CLONE 1568550
MPKAGFNLRHEISGGSSPRVNPREMREVGRPSSFNFPPTKMPGPRSFSPQGGKTPN

SEQ ID NO: 82708 - DNA, 846 bp, Zea mays
  misc_feature: Ceres CLONE 1568551
ctccccgcggtggcggccgctctagaactagtggatcccccgggctgcaggaattcgtctcacccctagaaaaagtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacccgaaaccgacacaggtgggtaggtagagaatacctaggggcgcgagacaactctctctaaggaactcggcaaaatagccccgtaacttcgggagaaggggtgcccaccttttcccctctccacctcccgcaagcaaactcacggtcacggcaccgcccccgcacccactggcctctagcttcttcctccccgcttttctggcaggaaaggctgaggcgatgatgcccataggccatccagtttgatccatgccatcctgaacctctatacatactgccccagcccggggactcgcgaatctctactttctctaccgccgctgtgcctgggctaacccctctcctctgcttctgctttcggctttttgccccaaccaggcctgctggaaaagtttttggcctttgggtttagggggccctccttttgggatttcctctttaccggttcccccccccacttttttggctccg

SEQ ID NO: 82709 - DNA, 830 bp, Zea mays
  misc_feature: Ceres CLONE 1568556
  misc_feature: Encodes the peptide sequence at SEQ ID NO. 82710
  misc_feature (678)..(678): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtggagggaaaggtgaaaagaacccccagtgggtagtgaaatagaacgtgaaaccgtgctgagctccaagcagtggggaggggaaagtgatctctgaccgcgtgcttgttgaagaatgagccggcgactcatangcagtggcttgggttaaggaatgggacccccacggagccgtagcgtaagcgagtcttcatagggcgattgtcactgcttatggacccggaactggggtgatctatccatgacccagatgaagcntggatgaaactaagcagaggtcgaaacc

SEQ ID NO: 82710 - protein, 85 aa, Zea mays
  misc_feature: Ceres CLONE 1568556
PRGGGRSRTSGSPGLQEFVSPLEKKRKGLRWIPRHPETRKGVASDEMLRGVENKHRSGDSQIGQPFELPAESMSRQETTWRTETS

SEQ ID NO: 82711 - DNA, 830 bp, Zea mays
  misc_feature: Ceres CLONE 1568558
  misc_feature: Translation starting site: 271
  misc_feature: SWISSPROT Homolog: EC 5.2.1.8 Peptidylprolyl isomerase
ctccccgcggtggcggccgctctagaactagtggatcccccgggctgcaggaattcgtctcacccctagaaaaatctcgtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcgactacagcaatcccttggatgctgcgagagcattggaagtgctgaactttgctgctcttaacaacaagcctatccggggtgatgtattcaaaccgtgatccaagcagccgcaggagtggatctgcttacattttcataaaaaatcttgaccaggacatagaacataaaacccttcatgagacttttttctcatttggtacccatctctcatgttaaggtagcgtggatgaagcaagcaaatcaaaaggctttggttttggtcagtatgacaagaagaagctgcgcagacgctttaaaaaggcttacgggatgcttataa

SEQ ID NO: 82712 - DNA, 833 bp, Zea mays
  misc_feature: Ceres CLONE 1568561
  misc_feature: Translation starting site: 168
  misc_feature: SWISSPROT Homolog: EC 4.1.3.1 Isocitrate lyase
  misc_feature: SWISSPROT Homolog: EC 4.1.3.30 Methylisocitrate lyase
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
ctccccgcggtggcggccgctctagaactagtggatcccccgggctgcaggaattcgtctcacccctagaaaaaacgcttcgcacttgcaatagttcgtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccagggcgggcggcaccgnnnctccgcactttcggggcgctcgaccccgtccaggtcaccatgatggccaagcacctggacaccatctacgtctccgggtggaagtggtcgtccacgcacacctccaacaaagaagccgggcccggacctcgccgaataccccttacaaaaccgtgcccaaaaaggtggaagacccttttctttggggaaaaatttccacaaccccaaagccgcggggagggccccattttccttgcccccccccaaggggggcgggggccccttaatttaaattccttaaagcccttatttccccaaaggggaaacggggtttttgggggggccccggcccccccgaaaatcctttaaaactcttttttgagaacaccggggggccccggggccaccccctcgaagaaaaccccccctcctccccaaaaaggagggg

SEQ ID NO: 82713 - DNA, 932 bp, Zea mays
  misc_feature: Ceres CLONE 1568562
tccccgcggtggcggccgctctagaactagtggatcccccgggctgcaggaattcgtctcacccctagaaaaaatacacagcgccacccgcctggtcctctagtaaaagaaatctaattccccccttccgatctctctcctgctagagaaaataggctgcagcctcctcctcattctgtgaaacgtgatgctgctgagtctggagatctcttgactcacgatgcgagcaccagagttcgtcgagtgcctctggttgctgcacagagatctcggcattcttcggatgttaagaacttgatgctctactcgagatcaagggtggcaacaacatatcgaggaatactcgttcgtccctgatgtacaaatctcaccttggctacagagtcataggatatgcgcccttgcaggcggacatcaacaaaggctcgtctgctctttcaaaaattgcgcaaggaatccttcattgatgtcggtgaactccatcccgcgtcctagttggctaaaaaagcccccggcgtttttcattttgtgaaaattcctgaaaccatacggggttaagatgctttaccagatgtcccagttagatttccaaataaccccctttccgggcatttcctcccccatggggtggtcaaataaaccggggacccctaaaacccatgggtacgcccccccccaaggttgtgtggctgattgccaccctccccccgtgttcccctgttgaaatggggtttcggagggaactaaaaaagagggggacttgaaatattggcccttctcccggagggaacgattgttttgcggttgaaccccccggggtaaaagggggacctggattgtggggatctggccttgtcccaaaaaatcgaaccccttgttttcttttaccttaaaatccgaagccccccccttttgggcgctataagcccacc

SEQ ID NO: 82714 - DNA, 1034 bp, Zea mays
  misc_feature: Ceres CLONE 1568563
tccccgcggtggcggccgctctagaactagtggatcccccgggctgcaggaattcgtctcacccctagaaaaactttgggcaagcaagacccggacgacgcgctgtccagggtccgaggaggaggaggggagcatggccgacgaggtgctggtataaagacgacggcaaggcatcctcgtcgttcggggacagattccggcagcaatgcccccgcctggaggacacgtgggagagaccagaccctttgtggggggacagcgggtgttgcattcttcccgctggcggggcgccaggaagtgaaggggggtttcctgcccggccacgaacccccacgatttgacccccccctctgcccgcccctgtgttcctcccctgtgagggtgggaacccaccccccctaacatccgccccagggggtgggggggtttctttaagaacaaaaaaactttccaggttccaggaaaccctttcccccccatccttttcccaaggggaggcaaccctttttttttccctcctcccggggcaaaataacaacattagggtgccccctcccccccccttggtgggtttcacctctcttgttttccatgacaaattccctccccctgggtttccaccccgaaaaagaaaaattgtgtttcccgggttgtcgcccctccccgggggggccacgtttaaggggggccttttgcgggtgtttcccccctattgtatcctcccccagacaatcccttgtgggtgttttaaaccattctctcggcgggtggggggacaccacccctctcgccaccacgggtgtgatgaaaaccccccctcggtgggtgttatatccaccccttcttataagttcgccacgagcatttggttgttcgtttagaaaaaatcttagtggaaccgccgtgtcaaccccccgcttctgtgtggggtggaactcacactcttacgctgtaaacacgtttttggtgtaggttccctcccctcctcacgatgggtagctcctgtacctcctcccccatcctcttcagcgggg

SEQ ID NO: 82715 - DNA, 846 bp, Zea mays
  misc_feature: Ceres CLONE 1568566
  misc_feature: Encodes the peptide sequence at SEQ ID NO. 82716
ctccccgcggtggcggccgctctagaactagtggatcccccgggctgcaggaattcgtctcacccctagaaaaaaaggagaagcgtacagtccctgctatacagctctcgtcggggtcttctcccccttcggcccttcccccctccctgcgcgccatggaggcccaggagatcgccgctgcagcgcgccacttctgcgccatggttcgaatcgtcggtccggaccccaaggccgtgaagatgcgccgccacgcctttcattttcaccattcggggtcgaccacgctctcggcgtcggctctgctcctgccgcggggcgctttagcggagccgccgctacttctcgaccatatctgctcggcccacgggcacgcggcatgagacgtcgcgctcacggctgcttccctcgtcgagccgttcctggtcgcggagcagcgcaataactccggcgaagagcttcagccgaggttggttccggagacgcgtcttgatgtgtttgttgagtatgaattcggggaatgctcaagatgggaagtctggacctccgcggtggcttccagatcgactgcttgccatggttgatgtcccaacagctgctgtttctgctttatccttactgagacatgaccatacattcatcagaaggccaaacttgcgatgtaggctggtcatttggctgatgctgatccagaaccagttggaaatgacagcagatctttccctccagtcgtacaggaaataatcattctttgggagacaggaaactcattggatggttggccaaggctgccacaagaattgctattcttaggaattccaaccctccaatttaaatggatgcaagacg

SEQ ID NO: 82716 - protein, 74 aa, Zea mays
  misc_feature: Ceres CLONE 1568566
MEAQEIAAAARHFCAMVRIVGPDPKAVKMRRHAFHFHHSGSTTLSASALLLPRGALAEPPLLLDHICSAHGHAA

SEQ ID NO: 82717 - DNA, 898 bp, Zea mays
  misc_feature: Ceres CLONE 1568569
  misc_feature: Encodes the peptide sequence at SEQ ID NO. 82718
  misc_feature (529)..(529): n is a, c, t, g, unknown, or other
ctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggggatccacgggcggtgggcgatgctggggtgcgctgggctgcatcacccccggaggtgcctgganaagtgggtgccccctggacttcaagggaccccgtggggggtttaaagaccggcggcgcaaatctttctcggaagggcgggctgggactaccctggggcaacccccaaacctggtggcaccgcccaagaacaatccctgggccggtgcccgggcttcccagggtattccctcatgggggcccccggccgagggggcttcccgaaataatcgggacttccaaaggggtgtccggcgaaagggaaaaaaacccccttacccccggggcgggccaggtaaatttctaaaccccggtggggggccttcccccaaaaaaaccccccgggtccccctttgtcccaaagatcttaaggggtcaaggggggaatttaa

SEQ ID NO: 82718 - protein, 139 aa, Zea mays
  misc_feature: Ceres CLONE 1568569
  misc_feature (69)..(139): Pfam Name: Chloroa_b-bind Pfam Description: Chlorophyll A-B binding protein
  misc_feature (125)..(125): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEGIHGRWAMLGCAGLHHPRRCLXKWVPPGLQGTPWGV

SEQ ID NO: 82719 - DNA, 809 bp, Zea mays
  misc_feature: Ceres CLONE 1568571
  misc_feature (310)..(310): n is a, c, t, g, unknown, or other
  misc_feature (322)..(322): n is a, c, t, g, unknown, or other
tggagctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttcntatggagtccangggtggcaaggcgaagtctagcagtagtcgttcttccctgatgtacgaagctccccttgggctacagcatcgagggatatccgccctgcaggcggcatcaagaaagttctcccgctgctttactcgaaactgcccgagggaagccatcccggatattttctggtcgtcattccccattcctagtagccgtagaaaaccaccctgcctttttcccttttggaacccccccaaattcccttccggggtaacttggcttttcccgtgggcccaaaaagatttccaagaacccctttttcccgggttttccctccccggggggtgggtgtggtaattccgggggctttgaaaaaacaaggggcccaccccctgtgaaagtttgtcttttttgttgtcccccccccccccccgttttcccttggggaaataaggggggcccacggggggttttttttaaaaaaacccccctcctggaagacaaccactttcc

SEQ ID NO: 82720 - DNA, 791 bp, Zea mays
  misc_feature: Ceres CLONE 1568573
  misc_feature: Translation starting site: 300
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaagtggcttcctctcttcccctcctcccttggccccgtctcgtctcctccccctcaccttcctctccaccttcctccctcccacccctccgcgcctcgccccaccgcgccaaccaaccaacacggcgtcccagcctgcctatataccgctccccccgcgcccccacacgcgcaaatccatatgctcagctcccgcctcctcccatccccggaccccggaccccggccatgggcgcttgcttctcctccgcctctgccgcccccgccggcgccgccgtcgacaagcgccgcccgtccaaggagggcgacggcaagaagaggcaccacgccgccggggcatcgccggatgccgcggcgcccgtgcgcgtggagttcggctacgagagggacttccaggcgcgctacgaggtcggccgcctgctcggccacggccagttcggctacaccttcgccgccaccgaccgcggctctggggaccgcgttgccgtcaagcgcatcgaaaggccaagatgacccgccctgttgctgtggaggatgtgaaaagagaagtgaagattctgaaagcacttaaaggacatcagaataatgttcacttgtacaatgcatttgaggatgattcacacgtgtacattgaagggggagctatgtgacggcggtgaactattagatcagatgttggcgaaaaagatagccgctataacgagaaagatgctgcacggg

SEQ ID NO: 82721 - DNA, 857 bp, Zea mays
  misc_feature: Ceres CLONE 1568574
  misc_feature: Translation starting site: 114
ctccccgcggtggcggccgctctagaactagtggatcccccgggctgcaggaattcgtctcacccctagaaaaaaaaatcccaaatcccttgtgaacctcctaaacctaagcgatggcggtggcggcatcgccgtatttcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatgccccccgtcaactacaccgtctcgggcgtccccatccgcctgctcgcgctctccgtctccgatcccgacgtcccgctcggccccggcgtcgacgagtcctacacgctctccgtgccacccaattccaagctccgctgacatctctgccgccactccctggggcatcatccgggggtctcgagaccttctcccagctcgcctggagcagcggcgccgccaacacgagcggcccagccgatcgcccccaggaaaaataaaatcttcgaacacccccctattacccccccgcggggaacccccctcgacaacggaggggaaattataacccggggccgtgaaatccctccgaaaacattcgggggccatgggccctcaaaacaaggccaaaaggttattcccacggggggaaattaccccgaactccccggtccccttccccaaattggttcctccccccgtggg

SEQ ID NO: 82722 - DNA, 852 bp, Zea mays
  misc_feature: Ceres CLONE 1568575
  misc_feature: Encodes the peptide sequence at SEQ ID NO. 82723
  misc_feature (852)..(852): n is a, c, t, g, unknown, or other
ctccccgcggtggcggccgctctagaactagtggatcccccgggctgcaggaattcgtctcacccctagaaaaagcacactcagaccagaccgccgccgccgcgccggtgatcgagtctcgtcggcgctaccttcacgccacaagacaataagcatcgacagccaggttcggctccaccaaacgtccttgctgcaaaaacatcatcttttatacagtcattgtgcgcactggcccctttccactggcaagaagaccctgaagtcatcgatgtgcggtattgcccttgtcctcgccagtgaccgccttgtcatcgttccctgtgccactgcaactactgccgcattggagacccagcactcctgcaagaggaagggcgtgccagatgagctgaaggaggccctgcgccggcggggccctgatagcctaggctacagaagtcgctgccttcttgctgatggcacggttgttgttggtgatggttgcaatgatggagtagagggtaaaatcggtgtgagtgactctagtgtttgctgattttgtcttcatcggagcaacactgcatcttaggggagccaaactggtttcgcaaccgctggtggcccccaggggaagtgtcttttctgtataatggtgagataattggaaggaaatccaggttgccggatgaataaaaatgaccccccaagcccctttttaactctcctgggaaaaccgggtgggttccaagggaatttgcccagggccctctttgggaaaaaaaaaaaaaaaaaggggggcacatggtggttgtgttggttcaatctccgggggagggggagtgtgggaccctaaaaacacaaaatttttttttn

SEQ ID NO: 82723 - protein, 88 aa, Zea mays
  misc_feature: Ceres CLONE 1568575
MCGIALVLASDRLVIVPCATATTAALETQHSCKRKGVPDELKEALRRRGPDSLGYRSRCLLADGTVVVGDGCNDGVEGKIGVSDSSVC

SEQ ID NO: 82724 - DNA, 820 bp, Zea mays
  misc_feature: Ceres CLONE 1568577
  misc_feature: Encodes the peptide sequence at SEQ ID NO. 82725
  misc_feature (642)..(642): n is a, c, t, g, unknown, or other
  misc_feature (820)..(820): n is a, c, t, g, unknown, or other
ctccccgcggtggcggccgctctagaactagtggatcccccgggctgcaggaattcgtctcacccctagaaaaaatagcctacacacacggtcgctccctttctctcgcctcctgtcccccccgcgtgcgcgcagcgctctctctctccctcactctcttttgaggagtgaggacgactggggcgaacgtcgccgccgccgctctacatcaggtgcccaggtcgttgttcggcccttcgccagctctttttcgggcacttcgccggcgacgaacacccaccagttgctggtgcaaggctttcaaaagattaacagtctcacttgatgcaaaagcaacacaatcacactaaaggtttggattagacatttcagagcatgggttcgcggtttccatcccaccagctaagcaatggcttgtatgtctcgggccgacctgagcaacctaaagagaagtccccagtcatttgctcctcggctatgccgtacactggtggggacataaagaaatctggggagcttgggaagatgtttgatctccatagaaaatctggtccattgggtaatcaaacttcaaggaatacttccctttgggtggtgctgcctccaactctgggaccagttttctaatgctggtcggtcgcntcaaactactcctggttctattttcggcctgcaattccctaaccactgggaagatccttctaaggacaaaaacttaattcctggaacttctccattaaagcatgggggaacccaccaaagagggtcatcttggccccccaattcctggggggaggaaacccccgaatggggcccgtcn

SEQ ID NO: 82725 - protein, 83 aa, Zea mays
  misc_feature: Ceres CLONE 1568577
MGSRFPSHQLSNGLYVSGRPEQPKEKSPVICSSAMPYTGGDIKKSGELGKMFDLHRKSGPLGNQTSRNTSLWVVLPPTLGPVF

SEQ ID NO: 82726 - DNA, 1040 bp, Zea mays
  misc_feature: Ceres CLONE 1568580
  misc_feature: Encodes the peptide sequence at SEQ ID NO. 82727
  misc_feature (35)..(35): n is a, c, t, g, unknown, or other
  misc_feature (59)..(59): n is a, c, t, g, unknown, or other
  misc_feature (90)..(90): n is a, c, t, g, unknown, or other
  misc_feature (115)..(115): n is a, c, t, g, unknown, or other
tccccgcggtggcggccgctctagactagtggatncccagggctgcaggaactcgtctncaccatcagtattgtcgctgcgccattagancctgtttaggagaggggggttgccntccaaatcgaaccaggctctgaacatccgtaaagcttcccccctctccattccaaacaggccctcctgcctccgttcctgggctagctgtcaggacggctcagctccagctttgcggccctccagctctccccagttcaagttcaatattggcgagcatgggagtttgccctcttccgtcgtcagcatcatcaatcgcctcgcgatcccggcggacctggttcgggccactccctccaataacaaaggttgcacccttgctttccggttagttattggcccactcagaactgcatccacctgttctgggccccggggtatgaggaaataaaaagagagacacagtgaagggcgggaggggaatacaaggggcccacgggcaaactggtggtcccccaaaggaatatagcccggttcggtaggcgagaagaggatagtaaaaccccaacaccctgtgaataaatgggggtaaaatccaagagataatattgtccacccgcccgctaatcctccgccgtatgcccgccagggtgagggagacgaggtgacacaatgtaaggcggaaaatgagggcgtggacggaggatacgggcgggttgggtggggaatgtgcatagatgtcgtgttctggccaggtgtaaccagaatatttatcggctgatcgtaataccgggccggaaaaaataaacggattgtgagggaagagacgagtatgagattgtgttggcatacattatgactctcttcatgcgcgccacgacgtagtgttcagtggtgttctctctatgtatcccgcccggaggtgtgtaggcgggcggagcgcaggtgtcaagaatatatgacgcgcgtgagtagatggaataggggttaggcgcggctacggtgaggcggtgctgggtgaatcactaatcgttatctttcgtttg

SEQ ID NO: 82727 - protein, 37 aa, Zea mays
  misc_feature: Ceres CLONE 1568580
MGVCPLPSSASSIASRSRRTWFGPLPPITKVAPLLSG

SEQ ID NO: 82728 - DNA, 781 bp, Zea mays
  misc_feature: Ceres CLONE 1568581
ctccccgcggtggcggccgctctgaactgtggatcccccggctgcaggattcgtctcacccctagaaacctcccctcctccccatcgcgtcctctccgctacacctcgccgatcggatcgcgacgagacgccgcgcgatccgacctaggctgacgccaacgaccactctcgccgccggcgggtcatgggcgtaacggggaccgcgttacccccctttcgagggaacccgaaaaaaggggggaggccagttccgggtttttttcccccaagggggtccttgtggagacctgggggggggtttttttccccaaaaaggggaaaaaggggggggggggggggtccccccccccccctgtggtttttttgaaaaaaaaattttttgttctcccccccccgcttattgggggggggggggggggggttttttatttataacaaaacaaccccaccgcccacggatatttgaggaggggggggggggggggggggggaaaaaaaaaaaaaatatattgtttgtgttgtctccccgcacccccgctggcggagttatttttaattttatttaaggggtgggacgggggggggggggcgagagaattatgtatttattatctctttaagtggcaacgagtgtaccttcaaaaaacaattgaatgaactcaacaaaccagaataggagaggtgggtggtggattttttttccgcggtggggggggggggggggggaaaaaaagaaaaataaaatcaaccccgtcgctttggttgtttgggggggagtgga

SEQ ID NO: 82729 - DNA, 793 bp, Zea mays
  misc_feature: Ceres CLONE 1568583
  misc_feature: Encodes the peptide sequence at SEQ ID NO. 82730
ctggagctccccgcggtggcggccgctctagaactagtggatcccccgggctgcaggaattcgtctcacccctagaaaaaacccgcgcccgcgcccacgcccacggccgcaccaaccaccagccccgatttcctcctaatcaatcacaccccccaaaccaaaacccaaacagcacttctcctgcaatcgccgacgtcgccggaggcttcgccagccgaagcagcgccgaaggttgttttgcccctccctcgtccggccaagcagcccaggcgagcatgccttcgattgcgccaccgtcttcctccgtcgctgccctcacccgtcaaccggtgcaattcttcaaagggtgcagtgtatccaaggagacaaagggaccggtccgcagtttcttcactgcaaattcaaagagcaccaaagtgaaatcagcgggcttgaaagtagcatcatccttccaaaatgatggtggttatccagctggcggtgtctcttggaaagaacaacactctattggcaaaaagccaaacctttctggccagaacatccgggtgcttaccccgaaccccaatggattcccggattcccccaaaatcctcccggaaagggggaagggttataaaacggtttccaaaaaagaaccccgaaccgaaactggatttggaaagccccaaaaaagggtcccaccccatggggggaaacccttggggggctccccccggggaaaccttggaaatttttttgaaaagaaaaccccgggggaaaaataaagggagaacccttaaaagggggccgcccc

SEQ ID NO: 82730 - protein, 162 aa, Zea mays
  misc_feature: Ceres CLONE 1568583
MPSIAPPSSSVAALTRQPVQFFKGCSVSKETKGPVRSFFTANSKSTKVKSAGLKVASSFQNDGGYPAGGVSWKEQHSIGKKPNLSGQNIRVLTPNPNGFPDSPKILPERGKGYKTVSKKEPRTETGFGKPQKRVPPHGGKPLGGSPRGNLGNFFEKKTPGEK

SEQ ID NO: 82731 - DNA, 866 bp, Zea mays
  misc_feature: Ceres CLONE 1568586
  misc_feature: Encodes the peptide sequence at SEQ ID NO. 82732
  misc_feature (765)..(765): n is a, c, t, g, unknown, or other
  misc_feature (766)..(766): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
ctccccgcggtggcggccgctctagaactagtggatcccccgggctgcaggaattcgtctcacccctagaaaaaatcaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctccatcgccaccaccgccgtcgcccaccagcacgccgtgccctccgccgccgtccagctccggcggcaagtgccccaagaacgcgctgaaactgggcgtgtgcgccaacgtgctgggcctcgtcaaggtgtccatcggcaaggtgcccacggactcgtgctgcccactgctggacgggctcgccgacctggaggccgccgtctgcctctgcaccgcgctcaagggccacgtgctcggcgtcaaactcgacgtccccgtcaagctcaccgtgctccccaactactggggggagagcggtccctcagggcttcctggtgccccaatataaaaaccaaggggctaggtccggcccttagcttccggtgcccaggcaaatttgggaaatccttccctctttccctcaaggtcaccccctgggttgtccaaaccccccccccggaaggttttccttggggaatgcccctccccctccaaagcaaaatnnaaaggaaaatataaaaannnnnnnnntttcaggggcgcccaaaaaggagacaaagaaccgcgccgcggcccttaaaaacgcggaaaaaaaaaaacccccc

SEQ ID NO: 82732 - protein, 146 aa, Zea mays
  misc_feature: Ceres CLONE 1568586
  misc_feature (62)..(139): Pfam Name: Tryp_alpha_amyl Pfam Description: Protease inhibitor/seed storage/LTP family
MASVTRFPAVALVLLLAASAFLASEVAACGGCPKPTPPPSPPPPSPTSTPCPPPPSSSGGKCPKNALKLGVCANVLGLVKVSIGKVPTDSCCPLLDGLADLEAAVCLCTALKGHVLGVKLDVPVKLTVLPNYWGESGPSGLPGAPI

SEQ ID NO: 82733 - DNA, 992 bp, Zea mays
  misc_feature: Ceres CLONE 1568587
  misc_feature: Encodes the peptide sequence at SEQ ID NO. 82734
  misc_feature (871)..(871): n is a, c, t, g, unknown, or other
ctccccgcggtggcggccgctctagaactagtggatcccccgggctgcaggaattcgtctcacccctagaaaaaataacgacagcccatacgcttaatgcttgctctaactagatagctgctcccggaccatatccactacagaagtagggtatcgtctgtcatcagcaatggcctctcgtgacgaggttctcggcagtggccctcgtgctgctgctcgtcgcctgcgtcttcgtgggcagccaggtgaaggcgagcgggagctaaccaatagctactcctcctctatcgtcacggccatggtcaaccactcagcacgcagagctctccgccgctgtggagctctggcggcaagtgccccaaaaaagcgctgaaactgggcgtgtgcgccagcgtgctgggcctcgttaaggtgtcattcggtaaggtgcgcaccgagtctggctgacaactgctgggacaggctcgccagacctggagggtcgccgacctggcctgctgcaccggtgcttcaaggggaaaaggtggctacgtcgttcaacctacgaacgccccacgttaaagctcgaccctggcttccctcaaactaccttaaaaagaaaataatttttccccctcaagggggttgtccttaatagcgccctataagattctaagtaggccattgggaggtaagaatttctttccacagaaggatatacccgttggccaagggcgaagtttttttgcggaaccggctttcattaggttttggcggcgcgatgtttccacaaaacgggtatttttttatataccccttcccccacggaatggcttattccctggggggacaccgccattttttcttaccctggttggacaaaatagaaacnacacaaaattctcggagagaagtgaaacccattccgggggtgatcacctaggaatgtgcgacaaaatcacctcgggtaggtgcgccatcaataataaatccctgaggaagatagggcggcc

SEQ ID NO: 82734 - protein, 67 aa, Zea mays
  misc_feature: Ceres CLONE 1568587
MASRDEVLGSGPRAAARRLRLRGQPGEGERELTNSYSSSIVTAMVNHSARRALRRCGALAASAPKKR

SEQ ID NO: 82735 - DNA, 808 bp, Zea mays
  misc_feature: Ceres CLONE 1568589
  misc_feature: Encodes the peptide sequence at SEQ ID NO. 82736
  misc_feature (559)..(559): n is a, c, t, g, unknown, or other
ctccccgcggtggcggccgctctagaactagtggatcccccgggctgcaggaattcgtctcacccctagaaaaaaccaccctcacacttcgccctcctcccggcgaggtcgcctctgcttccgactgcgcccgaccccagtctcgcctgcgtccaccggcatggcctcacccacggtcgcctccccgacccgggcgagccccgccgacatccccaccgccgcaccctcgtcggccccccggccgcggcgcctcgcgtcggcgccgcccgcagtctacgcgtctgcgtcctcctccccggcctccgcctactccggggaccagctctccgcccccgacgcctcgagcccgctgctcgcgagcaggagcgaggagtacaggcttctgttccggctgccgcccgacgaggttctcgtgcaagattttaactgcgctctccaagaaaatatccttcttcaggggcatatgtatttatttcttcaccatatatgcttctactctaacatatttggatatgagactaagagaacactacctttgcaagaggtaacagatgttcgntaagcaaagacggctgccattttttctaatgccattgaaattgttgctggtagtagaaagcacttctttggatctttcttgtcacgtgatgaagcctatcaaattataggagatggctggggaacacatgttagtaatgccagattgctccttggacgtcaggagacaaagtcagctagtagcaggtgaagaaaagggttatggttttatgggaggagcaaagaaccctaaacaagatgaagattcatc

SEQ ID NO: 82736 - protein, 133 aa, Zea mays
  misc_feature: Ceres CLONE 1568589
  misc_feature (70)..(134): Pfam Name: GRAM Pfam Description: GRAM domain
  misc_feature: SWISSPROT Homolog: EC 2.4.1.173 Sterol 3-beta-glucosyltransferase
MASPTVASPTRASPADIPTAAPSSAPRPRRLASAPPAVYASASSSPASAYSGDQLSAPDASSPLLASRSEEYRLLFRLPPDEVLVQDFNCALQENILLQGHMYLFLHHICFYSNIFGYETKRTLPLQEVTDVR

SEQ ID NO: 82737 - DNA, 803 bp, Zea mays
  misc_feature: Ceres CLONE 1568591
ggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccagggagctcatccgctacggcgagttcgcccaggccacctacgacagcttcgactacgaccgcttctccccctactgcggcagctgcaagtacccgggcgaagaccttccttcacgacgtcggcctcggcggcatcggctacgaggtcaaccggctacctctacgccacctggaaacgacctcaaagttcccaaactgcggcatcaagacggccgccaacgcccaagattgtgaagcgagttcgggcc

SEQ ID NO: 82738 - DNA, 945 bp, Zea mays
  misc_feature: Ceres CLONE 1568593
  misc_feature: Encodes the peptide sequence at SEQ ID NO. 82739
ctggagctccccgcggtggcggccgctctagaactagtggatcccccgggctgcaggaattcgtctcacccctagaaaaaaagaagagcacgcccactcctctccggctcctcttcttctccaccacaccacaggcaccggcaccggcaccgcctcctccctccctcctgccaccgcgcggcaccccagccacagcacagcaatggcgggcaacggcgccatcgtggagagcgacccgctgaactggggcgcggctgcggcagagctggcggggagccacctggacgaggtgaagcgcatggtggcgcacgcccggcagccggtggtgaagatcgagggctccacgctccgcgtcggccaggtggccgccgtcgcgtccgccaaggacgcgtccgggcgtcgccgtctagctccacgaggagggccggccccccgcgtcaaagccagcaggcgagtgggatccttcgactgcatcgcccacggggtggcgacattctacaggcgtcaacaacccggctttcggggggaaccttcccaaccggccgaaacaaaaggaaggggccccgcgccttgcaaggtaaaaaccgggtcaaaggaattaccaaacgcccggaaatctttcagggcaccccggcagggaattgggccaccacccccttgcccgttggggaagggtcacccccggggcgggggaaaattcctggggggccccaataataaaacccgccctcttgtgggagaggttataaacccggggattttcgcgtttttgaaaaaaaacccccggaggggcccattcctccaaaagtgtggtgccaaaaaaaacgagggggtgtaaaaacccccgggtacctttctccccctctccggggggggaaacaattaaacacaacttttgcgggggggaaaaacactgtgtttcccccccactctcgcaataaaaag

SEQ ID NO: 82739 - protein, 211 aa, Zea mays
  misc_feature: Ceres CLONE 1568593
  misc_feature: SWISSPROT Homolog: EC 4.3.1.5 Phenylalanine ammonia-lyase
MAGNGAIVESDPLNWGAAAAELAGSHLDEVKRMVAHARQPVVKIEGSTLRVGQVAAVASAKDASGRRRLAPRGGPAPRVKASRRVGSFDCIAHGVATFYRRQQPGFRGEPSQPAETKGRGPAPCKVKTGSKELPNARKSFRAPRQGIGPPPPCPLGKGHPRGGGKFLGGPNNKTRPLVGEVINPGIFAFLKKNPRRGPFLQKCGAKKNEGV

SEQ ID NO: 82740 - DNA, 828 bp, Zea mays
  misc_feature: Ceres CLONE 1568596
  misc_feature: Encodes the peptide sequence at SEQ ID NO. 82741
  misc_feature (805)..(805): n is a, c, t, g, unknown, or other
ctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcacaacttccccgtcttcttcatccgcgacggcatcaagtcccccgacgtgatccacgcgttcaagcccaaccccgcgtcgcacgtgcaggagtactgggcggttgttcgacttcctgtcacacctccccgaagagctgcacactttcttcttctccttcgaagacgtgggcgtggcgtccgactacggcaccatggaaggttccggcgtgaaccgtaacactttcctaacgccgccggggaaggcccantacctcaaagtccatgggaagcc

SEQ ID NO: 82741 - protein, 153 aa, Zea mays
  misc_feature: Ceres CLONE 1568596
  misc_feature (18)..(153): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGTTSPSSSSATASSPPT

SEQ ID NO: 82742 - DNA, 741 bp, Zea mays
  misc_feature: Ceres CLONE 1568597
  misc_feature: Encodes the peptide sequence at SEQ ID NO. 82743
  misc_feature (411)..(411): n is a, c, t, g, unknown, or other
  misc_feature (435)..(435): n is a, c, t, g, unknown, or other
  misc_feature (507)..(507): n is a, c, t, g, unknown, or other
ctccccgcggtggcggccgctctagaactagtggatcccccgggctgcaggaattcgtctcacccctagaaaaaaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaagcngcgcggttcgtgctggtgacgcangcgcacctgttcaagccgacctacccgcgaagcaaggagcgcatgatcgggccgtcggctctcttcttccancagggcgactacccactccgcctcggcaagctcgtccaggggcgggctcgggccccaaagcgctgcgcgcgctcctttcctgaagtggaaggcgccctggcggccacctctccgcttcctgggaacccgggccacgtaaaaaacacgtttccacccccttgaaaaccccttccttttgacagggggcattttggaaaaatttttcccggggcgggttggaaaaaaagggccaag

SEQ ID NO: 82743 - protein, 181 aa, Zea mays
  misc_feature: Ceres CLONE 1568597
  misc_feature: SWISSPROT Homolog: EC 1.14.13.93 (+)-abscisic acid 8'-hydroxylase
  misc_feature (104)..(104): Xaa is any aa, unknown, or other
  misc_feature (128)..(128): Xaa is any aa, unknown, or other
MAFFLALVCILVLLAIASYVQYTRWQKGKGRFGGHGRSAPLKLPPGSMGWPYLGETLQLYSQDPSVFFASKQKRYGEIFKTHLLGCPCVMLASPEAARFVLVTXAHLFKPTYPRSKERMIGPSALFFXQGDYPLRLGKLVQGRARAPKRCARSFPEVEGALAATSPLPGNPGHVKNTFPPP

SEQ ID NO: 82744 - DNA, 825 bp, Zea mays
  misc_feature: Ceres CLONE 1568598
  misc_feature: Encodes the peptide sequence at SEQ ID NO. 82745
ctccccgcggtggcggccgctctagaactagtggatcccccgggctgcaggaattcgtctcacccctagaaaaagcgcgaaggcaaagcgtccaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaagggccgaggaggcggcggggctggagaggtcgccggtatccgcgccggcgcccgggccccgcgccggcgcgcttgccgtggtggacgggaggaccgggaagcggcacgaggtcaaggtctccgaagactgcaccgtgcgcgccaccgacttcaagaagattaccactggaaaggacgacaagggtcttaagatttatgatcctggttaccttaacactgcccctgttcgctcgtccatctgctacatcgatggagatgagggaatccttcgctataggggttatccaatcgaagaattggctgaaagcagctcgtttgttgaggtggcctacctttttatgtatggggaacttgcctactcagagtcaattggcaggctgggaatttgctatttctcagaattctgctgttccccaggactggtggatatcatacattccatgccccatgatgctcaccccatgggtggttcttgccagtgcaatgagcacccttttctgtctttcatccaagaagcaaaccctgctccacaaagccaagatctttataaatccacaaccggggaggggaaaaacca

SEQ ID NO: 82745 - protein, 213 aa, Zea mays
  misc_feature: Ceres CLONE 1568598
  misc_feature: SWISSPROT Homolog: EC 2.3.3.1 Citrate (Si)-synthase
MDRADPARGRLAVLSSHLRGARAEEAAGLERSPVSAPAPGPRAGALAVVDGRTGKRHEVKVSEDCTVRATDFKKITTGKDDKGLKIYDPGYLNTAPVRSSICYIDGDEGILRYRGYPIEELAESSSFVEVAYLFMYGELAYSESIGRLGICYFSEFCCSPGLVDIIHSMPHDAHPMGGSCQCNEHPFLSFIQEANPAPQSQDLYKSTTGEGKN

SEQ ID NO: 82746 - DNA, 807 bp, Zea mays
  misc_feature: Ceres CLONE 1568601
  misc_feature: Translation starting site: 146
ctccccgcggtggcggccgctctagaactagtggatcccccgggctgcaggaattcgtctcacccctagaaaaaaagagaacacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggacctcgctgcgccgaccaccaaggccagcgccggcggcttcaaggcggccaccgagggcggcggctgcgactgcaacacctgcaactgcggcaccagctgcggctgctcctgctgcagctgcaactgagacgagcccgcccggcccggcgatggcgcacgagagtcgagaggacgacgactacgaggcgtataaatataatagcagcgtctaaataagatcctgtcaactgcacccgccattatcgatccatggtcgctcctggggttcaagttcatctgtgtaacgagctcgcggtcatgtccgtctcgtgccggaattaatatttatatgcatgtagttgcgttacaacgcaatgctggtgcgcatcaacaccctcctccagggctactccggcatccgcttcgaattccggggaaagggtcagtatgcacctcaccggaattgaacaggccctgcaaagacttttcttgggtatccacctccgaagtggggagaggagaaaaaccgcctgccaaaataaactgccctccccataaaaaataaaa

SEQ ID NO: 82747 - DNA, 915 bp, Zea mays
  misc_feature: Ceres CLONE 1568604
ctccccgcggtggcggccgctctagatctagtggatcccctcgggctgaaggaattcctctcagccctagaaaaacctgccctcctccccatagggtgctctccgatacgcctcgccgatcggatcgcgacgagaccgccgctcgtatccgacctaggctgacgccaacgaccgctctcgccgccggcggtaatggtccttccgcaaccgcgatacaaccctcatggactccgaggacgagagcgagtaccgctatctccgcctcgtctctggacctgaggttatgtgctcatgaaatggggagggctgacctgtgtgaacttgaccgcgccgggcttctgtacctcgtgacgcagattatccgccttgagggcctgcccgctaccctcgcagtatgtgtacgcaacagggggactgatggtccaacgaccctcgtcttgacccacacagatcgtcatatcagctgaatctgagaccccgtaatccctgtacaagacttagtgatgggcacccactgcccttctaataaccattggaaattccagtccgggagatggtgtttctcccatggcgggtgcttgcagttccctgcccttcggacaaggaggctttggggtggaactttcctccgaaaacacacttggatgttggaacatggtccaccccacggggaaagatctatttcgcctacctggtgaatggaggaaaacacttgattcgcgccccccataatggatccttggccgggggttctccaagggggacacaaacaaggcttttgttgggtaccggggtggggccagtaaaaaacccttgggagaacccgggccccgaagggaatttgaaaatttatcaggcggcataataagaaagagtcttcccccaatggccttaaaaaaaatattccctgtggtc

SEQ ID NO: 82748 - DNA, 836 bp, Zea mays
  misc_feature: Ceres CLONE 1568606
  misc_feature: Encodes the peptide sequence at SEQ ID NO. 82749
ctccccgcggtggcggccgctctagaactagtggatcccccgggctgcaggaattcgtctcacccctagaaaaagtcactcgggctcttctttgttctcgtcgtcgtggtcaccatagagcgcgtctgcaagcgctcccaccccaaaaccccgcggacgcaccgacgcgcgagccataatgcgccgccaaagcctcgccaccgtactgctgctcctggtggccgccgcggccctggccgcccccgccgctgggcactttgagtcctcctgccccttctacgaccacggcggccacggcgaaccacacgaacgccacgaccatggccacagctgcggcggcggcgcggaccatgagcaccaccatcaccatcaccacggccatggacacggcgagatccagcggctgctcccggaagagatggcggaggaggcggatctcgagctcgagtccttcggttacgaagaccatgaccacggccaccaccaccaccaccaccatcaccacagccacggcgacatggagacatcgcccatgggcgtgtggctgagcgcgatggggtgctcgctgctggtcagtatggcgtcccttgtctgcctcgtcctcttgccggtcatcttctttaaggggaaaccgtctaaggccatagtggattcgcttgcagtgtttggggcaggagctatgcttggagattcattttctcatcagctgcaacatgcttttggggggagggcattcccactcccaggaacatgaaggggcatggatcaagcgcaggctcaggagcatggccttgcccccttcactggaagaatcttatgtggggggttgtgccttt

SEQ ID NO: 82749 - protein, 111 aa, Zea mays
  misc_feature: Ceres CLONE 1568606
MAEEADLELESFGYEDHDHGHHHHHHHHHSHGDMETSPMGVWLSAMGCSLLVSMASLVCLVLLPVIFFKGKPSKAIVDSLAVFGAGAMLGDSFSHQLQHAFGGRAFPLPGT

SEQ ID NO: 82750 - DNA, 835 bp, Zea mays
  misc_feature: Ceres CLONE 1568608
  misc_feature: Encodes the peptide sequence at SEQ ID NO. 82751
ccccgcggtggcggccgctctagaactagtggatcccccgggctgcaggaattcgtctcacccctagaaaaagctattcggtgcccagcggaacggggctgcggaccccatcggaggcggaaagtacgctgttctggccggaggggaaggcgaagaccctgttggagccgtggtccgtgctggactgcacgcggagccccagcaactcaacgtcgactctgtcgtcatccctgggcagcggcgctgaggactcgaccggcgtggcggtggtttcatgacataagcgccgccgccgaagcctccaaatggggagcccccggcgagcacggcggcggctgctggaaggaggactgggcctgcggctgtgagctgccgcctattcccaccggcctctacatggaggtcatggtcgccgacagctgggacgccattctcggcaacgccgctgcggcggcgcatgaccagacgttcttgaactggttcattgaggccgccggcgactcggatcattcaggtacgccgacttcccgtgcatcaccaggccgctcctcgatcatgtgggcttcccgatcccgggcactgacccttctggttttcacgctcgatccctgcctcggctgggtttgcctctgacatgacttccccctgtgggcggcgttggaaaactccccaccttggggcggcgggggctaacatggaagccctcagcctttgggccatatttttcccggagatgtgggtttaattcaaaaccggcgaccctttccgggggcggttccatttaagggccccccacccttacccccccttttgattttcctttgcccccggggct

SEQ ID NO: 82751 - protein, 210 aa, Zea mays
  misc_feature: Ceres CLONE 1568608
PRGGGRSRTSGSPGLQEFVSPLEKAIRCPAERGCGPHRRRKVRCSGRRGRRRPCWSRGPCWTARGAPATQRRLCRHPWAAALRTRPAWRWFHDISAAAEASKWGAPGEHGGGCWKEDWACGCELPPIPTGLYMEVMVADSWDAILGNAAAAAHDQTFLNWFIEAAGDSDHSGTPTSRASPGRSSIMWASRSRALTLLVFTLDPCLGWVCL

SEQ ID NO: 82752 - DNA, 795 bp, Zea mays
  misc_feature: Ceres CLONE 1568613
  misc_feature: Encodes the peptide sequence at SEQ ID NO. 82753
  misc_feature (644)..(644): n is a, c, t, g, unknown, or other
ctccccgcggtggcggccgctctagaactagtggatcccccgggctgcaggaattcgtctcacccctagaaaaactagaaaaaaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgccgccgcaacagcaagctcaagaaaggtgggttcgccgacgagggctccgccaccaccgagtccgacatcgaggagacgctcaagcgcctcgtgtccgaggtcggcaagtcccccgaggaggtngtcgaggcgctcaagaaccagaccgtcgacctcgtcttcaccgcgcatcccacgcagtccgcccgccgctcgctcctgcagaaaaacgcaggatccggaattgtctgacccagctgaatgccaaggactcactgacgacgacaagcaggag

SEQ ID NO: 82753 - protein, 196 aa, Zea mays
  misc_feature: Ceres CLONE 1568613
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKGGFADEGSATTESDIEETLKRLVSEVGKSPEEVVEALKNQTVDLVFTAHPTQSARRSLLQKNAGSGIV

SEQ ID NO: 82754 - DNA, 773 bp, Zea mays
  misc_feature: Ceres CLONE 1568615
  misc_feature: Translation starting site: 185
ctggagctccccgcggtggcggccgctctagaactagtggatcccccgggctgcaggaattcgtctcacccctagaaaaaactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctcccccaggtggttcctagaggttgggccggggccgcgggtctccccgcccgtggactcggcgctccagctgaagacgatcccccgcgcagcgccgggcggacttcgccgcgagcgggtccgtatgggctctgcgactacccaccgacgccaaattgccccggttcaaggtggagtacgaagcgctgtctttttccagaccccgtacggaagtggaagcccccgggaccaaagggcgggaagggaggtgtttccggcgccca

SEQ ID NO: 82755 - DNA, 919 bp, Zea mays
  misc_feature: Ceres CLONE 1568623
  misc_feature: Encodes the peptide sequence at SEQ ID NO. 82756
agctccccgcggtggcggccgctctagaactagtggatcccccgggctgcaggaattcgtctcacccctagaaaaaaaaagctagagacaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttatttttttatggtgggtacaagctttttagtggaaaagaagaagcctagactgatgagagatcaaccacggtcaaggtggcgggaaatggaggtataccccgtattctgggcctgggcaaaatggttaaaaaaaaagaaaggccttaagttgtggcttccaagtttgaaaaattgtggcaaccagaggaaatttgccttttctgagggagatatatttggacatacctactctttactcattccaccatgaaataatcccttggctccgcgggaaccttcctaggccggcggaacaatggcaaaaaggttgtaacttcctttcatgcccaattgaagaaagttgaatgtttttacctttcgggttggcccccaaaaaaggtgaaaaccctggaaccttgccaaaatgggtaaaaaaacctccgggggcttttcaagagatttgcccgggtgggaaaaacaaaagaaataaacaaacatggggggggcaaaaaacgagggggtgaaaacgatgtgccgggggaaaaaaaaaaacataagataaaaaatcaggtgttggtcacctgtttgtacctcgcaccacaccgcccctaataaa

SEQ ID NO: 82756 - protein, 78 aa, Zea mays
  misc_feature: Ceres CLONE 1568623
MASRLVAAAASSSSLSSASPLARLISRRGLAGAADGHGSAKVPLWKDPLSPSKWKEEHFVLASLSMWGVIFLWWVQAF

SEQ ID NO: 82757 - DNA, 1182 bp, Zea mays
  misc_feature: Ceres CLONE 1568628
  misc_feature: Encodes the peptide sequence at SEQ ID NO. 82758
  misc_feature (1034)..(1034): n is a, c, t, g, unknown, or other
  misc_feature (1038)..(1038): n is a, c, t, g, unknown, or other
  misc_feature (1047)..(1047): n is a, c, t, g, unknown, or other
ggggggggagccaaccttatattagtactaatgacacaatttagatgggcataccctttttttttttttaaaagctggtactccccgcggtggcggccgctctagaactagtggatcccccgggctgcaggaattcgtctcacccctagaaaaattctatccacctccgaacctgttctcatggctcattatatccatcgcccgccctctggagagtctggatgctcctgaacctccacgcagccagcgatggaaggagggacgcaagaagttagactgatagtgcaccttgctgtaccatggctctgccttgcttcttgggcatctctgctacccgcgctagcctctggaaatgtccgtgcagcacgtcccatacggagagcgtatttcataaaattcgacttccggaccgattcctcgaccccctacaaagcacaggaggcttcatggcttcctgttctagctggcttggttgagcatcctagggggcaactggttccaggaatccccatgattccgtacaccaaaaactaaccgctcccgcgctccaaattgcttcaccaaaaaatcactgtctggaggaaccagagcaaggggccccttacaaaaaacttagttaaaaactggaatgtaatcgcaaaaaaccatattttccatggactctaaagaaaagcaagggtactgacgctatgggcccctaccccccaagagaagatgccggcgccggacgatggatctctccggtcccggggagctatccgtttttactaacccccgtaaatgccctcaatatatagaaaagtctatggtactacggtcgtatgccttctgaccaataataccataatgcagggcacggttcctcatcgttcgttaaagtgtgggcaccacatattaccacgtctctacacttatttaccacacaagctacgacatcgaacaaaacggctccaaaggtataactattcgtgtcgtgtctgtactacacttcataatgttaacactgtgcaatgtagagaaactctccacaacgncaangagctctcncactcccggtcacgcacttcatatatactcacacagcaagatctacctctctgctctctgtgcaaaaactaagttgatgacctctcaaataaagagagaatagattatatcgagaaaattcgattgaattcagac

SEQ ID NO: 82758 - protein, 94 aa, Zea mays
  misc_feature: Ceres CLONE 1568628
MEGGTQEVRLIVHLAVPWLCLASWASLLPALASGNVRAARPIRRAYFIKFDFRTDSSTPYKAQEASWLPVLAGLVEHPRGQLVPGIPMIPYTKN

SEQ ID NO: 82759 - DNA, 925 bp, Zea mays
  misc_feature: Ceres CLONE 1568629
  misc_feature: Encodes the peptide sequence at SEQ ID NO. 82760
ggagctccccgcggtggcggccgctctagaactagtggatcccccgggctgcaggaattcgtctcacccctagaaaaaaacagcgtcctcctcccgcgtgctctccactcccagaccccggggactacaagggcactgggctaggtccgttagcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaaggtcctcctcaacgccgtcaagagccttctcgcccgcgcctgatgctccgccctggggaaggggtccgctgcaggacaaaggtggggggtacgggcacccccggaccctcctgggcgggccggtgccccccccctttccgcccaaaaaaaccccgtcccggaaaaagcccccgggttttccccccaagggggttgccctgaaacccttgcccccaggggggggaacaaaacttcaaacgcccttttcttccccaaaaaatcctgggtggcccaaggaaacgggggtttccggggaaccaaccccccctataataggggccggggtttcccgtttgcccggggtggggattccacttgggaaggggccccattggaattatcaccacaaatggaggggggcccccctagaattcaggtacaccaccggaaaaaaaagggggctccccgaaacccccggggtatggggaggcctt

SEQ ID NO: 82760 - protein, 146 aa, Zea mays
  misc_feature: Ceres CLONE 1568629
MAAAGTQLGRLLVGGLWLLAALLQRGAAAAVAAVDGRRAIAATGENFVCATLDWWPPDKCDYGTCPWGRAGLLNLDLSNKGPPQRRQEPSRPRLMLRPGEGVRCRTKVGGTGTPGPSWAGRCPPPFRPKKPRPGKSPRVFPPRGLP

SEQ ID NO: 82761 - DNA, 824 bp, Zea mays
  misc_feature: Ceres CLONE 1568631
  misc_feature: Encodes the peptide sequence at SEQ ID NO. 82762
ggagctccccgcggtggcggccgctctagaactagtggatcccccgggctgcaggaattcgtctcacccctagaaaaaagagcaaacgccacgagagtcgcgattcttccaccacttccacgggaccggtcggatccaatccgctgccgcccagccaccgccaccgccgccgccgccggctcctctataggggtcttccccccccccccacatgcaggagtggccggagcccgtcgtccgcgtgcaggcgctcgccgagagcgggctgtccgtcatcccgagctgctacgtcaagccgccgtgcgaccgcccggccccggccccggccccgaccatggcaccaccggcgccggcagtccatccgaggaagaaggagcccagctcggacgccatcgccaccattccggtcgtcgacctcggcgagctgctggccgcagacggcgccgtcgccaccgtcaccgaggccgtcgccgccgcgtgccgggactggggcttcttccaggtggtcaaccacggggtgcgccccgagctgatgcgcgcggcgcgggaggcctggcgcggcttctttcgccgcccgcccgccagaagcagcgctacgccaactcgccgcgcacgtacgagggctacggcagccgcctcggcgtgcagagggggcgccgtcctccactgggggcgactactggtcgcgaccctcgcaacccaaattcatccaagctcaacaagatcctcgaattccgattccagttcatccaatccaaacgcctccccgccctgtatccgttttaggaagaaaaagaaggggaaaaaaccctccaccgcttacc

SEQ ID NO: 82762 - protein, 204 aa, Zea mays
  misc_feature: Ceres CLONE 1568631
  misc_feature (92)..(119): SWISSPROT Homolog: EC 1.14.11.19 Leucocyanidin oxygenase
  misc_feature (90)..(119): SWISSPROT Homolog: EC 1.14.11.13 Gibberellin 2-beta-dioxygenase
  misc_feature (61)..(108): SWISSPROT Homolog: EC 1.14.17.4 Aminocyclopropanecarboxylate oxidase
MQEWPEPVVRVQALAESGLSVIPSCYVKPPCDRPAPAPAPTMAPPAPAVHPRKKEPSSDAIATIPVVDLGELLAADGAVATVTEAVAAACRDWGFFQVVNHGVRPELMRAAREAWRGFFRRPPARSSATPTRRARTRATAAASACRGGAVLHWGRLLVATLATQIHPSSTRSSNSDSSSSNPNASPPCIRFRKKKKGKKPSTAY

SEQ ID NO: 82763 - DNA, 851 bp, Zea mays
  misc_feature: Ceres CLONE 1568632
  misc_feature: Encodes the peptide sequence at SEQ ID NO. 82764
  misc_feature (594)..(594): n is a, c, t, g, unknown, or other
ctccccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcncgctgctcctggacggcaacaccctcaactactttcggaacagcatccccatcaacctggtgggtggccgggatcgcggaagtcaatcctcgtcgggcggcgcctagtactaccggatcaccaacggactggacctagaggacaagctgcacccccggtgggccctctcaacccccttgggcctggccagcgaaccccgaccagggcccccttcctccaaggggaaagggaaatcaaaaacgggccgcgcttggccc

SEQ ID NO: 82764 - protein, 189 aa, Zea mays
  misc_feature: Ceres CLONE 1568632
  misc_feature (83)..(190): Pfam Name: Chloroa_b-bind Pfam Description: Chlorophyll A-B binding protein
  misc_feature (155)..(155): Xaa is any aa, unknown, or other
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGXLLLDGNTLNYFRNSIPINLVGGRDRGSQSSSGGA

SEQ ID NO: 82765 - DNA, 789 bp, Zea mays
  misc_feature: Ceres CLONE 1568633
  misc_feature: Encodes the peptide sequence at SEQ ID NO. 82766
  misc_feature (452)..(452): n is a, c, t, g, unknown, or other
ctccccgcggtggcggccgctctagaactagtggatcccccgggctgcaggaattcgtctcacccctagaaaaagatggtcatcacgccgctgggcgccggcagcgaagtcggccgttcgtgcgtccacatgaccttcaaggggcgtactgtcctcttcgactgcggcatccacccggcgtacaccggcatggcggcgctgccctacttcgacgagatcgatccgtccgccatagacgtcctcctcatcacccactttcacttggaccacgccgcatcgctgccgtacttcctggagaagactacgtttaagggccgtgtgtttatgactcacgccacaaaggctatttacaagctgctgctctcggattatgtcaaagtcagcaaggtgtccgtggaagatatgctgtttgatgagagtgatattgctcgatccatggagaaaatcgaggntatagattcccacagacgttgggagtaatgggatacgcttctggtgctacactgctggccatgtactgggtgccgctatgttcatggtggatatggctgggctgccattctttaactggtgactactccgtgaagaaaacgtcccctaagagctgctgacctcccaagttctccccaaaattttgattaacgagcccacttacggggaaaaaaaacttcccccccgattgtacggaaaaaacccttttccggggggtttccaaaaaccgtttccaagggggggccgggtttttttcccggaattttggcttggggaagaacaaaaaaagttttcttt

SEQ ID NO: 82766 - protein, 134 aa, Zea mays
  misc_feature: Ceres CLONE 1568633
  misc_feature (13)..(130): Pfam Name: Lactamase_B Pfam Description: Metallo-beta-lactamase superfamily
  misc_feature: SWISSPROT Homolog: EC 3.1.26.11 Ribonuclease Z
  misc_feature (126)..(126): Xaa is any aa, unknown, or other
MVITPLGAGSEVGRSCVHMTFKGRTVLFDCGIHPAYTGMAALPYFDEIDPSAIDVLLITHFHLDHAASLPYFLEKTTFKGRVFMTHATKAIYKLLLSDYVKVSKVSVEDMLFDESDIARSMEKIEXIDSHRRWE

SEQ ID NO: 82767 - DNA, 1052 bp, Zea mays
  misc_feature: Ceres CLONE 1568635
  misc_feature: Encodes the peptide sequence at SEQ ID NO. 82768
ctccccgcggtggcggccgctctagaactagtggatcccccgggctgcaggaattcgtctcacccctagaaaaaatcgcatccatccaccacgcaccccaccaacccatacccataccagaggctctctgattttacttctcagcggtagatcggctgagcgagcgagcgagcgaggcacacggagctagctaaacagagcacacggatagaaaagcaagatgtcggacggcacggcgacctgcatcgacatcatcctcgccattatcctgccgccgctcggggtcttcttcaagttcggctgcggggttgagttctggatctgccttatcctcaccttcttcggctacctccccggcatcatctacgccgtctggggccatcacccagtaagccggccggggccgttagcatgcaatggcgcgcggcagggtggatccccgtgggcggggggacgccggtggtggccccttggtctttgagaatggggaattcccttcccttcccttggttttaagttggcgggcctgcccccccgggcgggggggaaagtacctgggggggttatacgccggggcccccttttaaattttgcccttggaaagaaaagttttgggcccccccggcctggaaaagaaaaaattacggggggacacccccttgtggccccttggggagtgtgtttgctttggctctccaatcgttccccaatttgttgcgctttggttaaaagaaacgccggtttcccctccgcccgtggagaaaaaaaaaaaaaaaaaaaaaggggcgctttgtgggcccagagtgtggggcccaacaggggcgccctgggaccccatgggccccttttgcgcgtaacccccggggttgagatccagaccccccgagccagataatggggggagagaaaccggccggtcaccccacggggggaggggccgtcgcggagaaccccggcgcctctcctcccagaagaggcggtaataggcgggagccccctcgctggggggcgtgtgcgcacaaagagaaatgacgcccggcacaaggagggga

SEQ ID NO: 82768 - protein, 86 aa, Zea mays
  misc_feature: Ceres CLONE 1568635
  misc_feature (6)..(56): Pfam Name: UPF0057 Pfam Description: Uncharacterized protein family UPF0057
MSDGTATCIDIILAIILPPLGVFFKFGCGVEFWICLILTFFGYLPGIIYAVWGHHPVSRPGPLACNGARQGGSPWAGGRRWWPLGL

SEQ ID NO: 82769 - DNA, 850 bp, Zea mays
  misc_feature: Ceres CLONE 1568637
  misc_feature: Encodes the peptide sequence at SEQ ID NO. 82770
acccgcggtggcggccgctctagaactagtggatcccccgggctgcaggaattcgtctcacccctagaaaaagactccgacggcgtccgcccgcgtcgcgtggcacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagttccagcgcacggctcgggtcctcctcaccgttcccggcgatggaacggcggcaggagctttgcaggaacttccagcgcggcagctgcaagtacggatcgcactgcaggtttgtgcacgcctcctctcagcagcagcagcaggcgaagcccaacccgtttgggttcggcttagggagtaggcagcagcaacagcagcagttcttcgtttcgtgcgcagtttccagcagcagcagcagcagaagcccaaacccgtttggattttggagtgcaaggcagtgcggcttgccccgtccaaaaaacgctcctggccggggcaagccctttccaaaataaagggggggaagggaccccttcagccccaaggaaaggaaacgggaagggggaccggccaccaggagggagccccccccctccggtacaaatccggaatcccggcagggcaaaaatatgcccaagaattttaaaaaaagaaaaccccccccgggaaaacttccggggctatgctccccccgggggggcgggcccctttgggacctcccggggaaaattttatccttttaaagagcggaagagcttcccg

SEQ ID NO: 82770 - protein, 97 aa, Zea mays
  misc_feature: Ceres CLONE 1568637
  misc_feature (3)..(28): Pfam Name: zf-CCCH Pfam Description: Zinc finger C-x8-C-x5-C-x3-H type (and similar)
MERRQELCRNFQRGSCKYGSHCRFVHASSQQQQQAKPNPFGFGLGSRQQQQQQFFVSCAVSSSSSSRSPNPFGFWSARQCGLPRPKNAPGRGKPFPK

SEQ ID NO: 82771 - DNA, 893 bp, Zea mays
  misc_feature: Ceres CLONE 1568638
  misc_feature: Encodes the peptide sequence at SEQ ID NO. 82772
ctccccgcggtggcggccgctctagaactagtggatcccccgggctgcaggaattcgtctcacccctagaaaaagtgtagctagagcccctgcactggtccggattcgcagagcaaaacggaaatgatcactgtggcagcaccggaggcgcagccgcaggtggcggcggcggcggttgcggcgccggaggagaccgtgttccggtcgaagctgccggacatcgacatccccacccacctgccgctccacgactactgcttctcgagggcggcggaggccgcgggcgcgccgtgcctcatcgcggcggccacggggaggacctacacgtacgccgagacgcgcctcctgtgccgcaaggccgcggcgtgcctccacgggctcggcgtcgcccaggcaaccgcgtcatgctcctgctccagaactccgtcgaagtcgtgcttcgccttcttcggggcgtccttcctcggggccgtcaccacagccgccaaccccgttctgcacgccgcaggagatcccacagcaattcagcgccccccggcgcgaaagtcgtcgtcacccacttccgcctatgtggccaagctccgggcacgaacccctttccgaaggaatcggcgttggacgggaattgccctccaccgtccttcaccatttgaacggcgacccgggccgaaacccccggaaggcctggcctgggcgttcctggggaaccttgctcacgtcccggggaaaggggaaaccccccttcccggaagggtgttcaatcttccccggaaaaaaccccgggggcggctttgcccgtttttcgtcgggggacccgcgggggctgcgcccaaggggggtttcttggctaaccccccgggggggccagggttaacaaaaagtggggccaaaac

SEQ ID NO: 82772 - protein, 256 aa, Zea mays
  misc_feature: Ceres CLONE 1568638
  misc_feature: SWISSPROT Homolog: EC 6.2.1.12 4-coumarate--CoA ligase
MITVAAPEAQPQVAAAAVAAPEETVFRSKLPDIDIPTHLPLHDYCFSRAAEAAGAPCLIAAATGRTYTYAETRLLCRKAAACLHGLGVAQATASCSCSRTPSKSCFAFFGASFLGAVTTAANPVLHAAGDPTAIQRPPARKSSSPTSAYVAKLRARTPFRRNRRWTGIALHRPSPFERRPGPKPPEGLAWAFLGNLAHVPGKGETPLPGRVFNLPRKKPRGRLCPFFVGGPAGAAPKGGFLANPPGGPGLTKSGAK

SEQ ID NO: 82773 - DNA, 834 bp, Zea mays
  misc_feature: Ceres CLONE 1568641
  misc_feature: Encodes the peptide sequence at SEQ ID NO. 82774
ctccccgcggtggcggccgctctagaactagtggatcccccgggctgcaggaattcgtctcacccctagaaaaatcggacatcggagagatgcgcgcgggcggcggcgcgcctccccgacacgcaccactctccccgaccgcctctgccactgccacgctactagtacccgcttctgtcgccatgcccacgccgcgcctcgcacacctccgccacctcctctcattccgctccgcccttccccgcccgctgggtcccaaccaaagccacccgctccccgggtcggttcacccgtctcttctcctcccccgtgccatggctggtgtcgcgtacgcaggtctggctacggggtcggcggaatacgaggaggtgctcgggtgccttgcgtcgctgataacacagaaggtgcgcgcggacaccggcaaccgcggcaaccagtgggagctcatggccaagtacgtccagatactggaactggaggaatccatcgcgcagttgaaagtggttcacgttgctgggaccaaagggaagggttcaacatgcacatctgctgagtcaatccttcgatcatgtggtttccacactgggctcttcacttcaccacatctgatggatgtcggcgagcgattccggcttgatgggctggacatttcagaagaacaagttattacgtattttctggtggtgctggaacacactgtaagacaagactggtgatggtgtaccgatgccgagcctactttaggttccttgcactgctagcattcaagatcttttcacatgaccagggggatggcctactgctcccagttggtttggggagggaattataatg

SEQ ID NO: 82774 - protein, 177 aa, Zea mays
  misc_feature: Ceres CLONE 1568641
  misc_feature: SWISSPROT Homolog: EC 6.3.2.17 Tetrahydrofolate synthase
MPTPRLAHLRHLLSFRSALPRPLGPNQSHPLPGSVHPSLLLPRAMAGVAYAGLATGSAEYEEVLGCLASLITQKVRADTGNRGNQWELMAKYVQILELEESIAQLKVVHVAGTKGKGSTCTSAESILRSCGFHTGLFTSPHLMDVGERFRLDGLDISEEQVITYFLVVLEHTVRQDW

SEQ ID NO: 82775 - DNA, 830 bp, Zea mays
  misc_feature: Ceres CLONE 1568643
  misc_feature (390)..(390): n is a, c, t, g, unknown, or other
  misc_feature (430)..(430): n is a, c, t, g, unknown, or other
  misc_feature (771)..(771): n is a, c, t, g, unknown, or other
ggagctccccgcggtggcggccgctctagaactagtggatcccccgggctgcaggaattcgtctcacccctagaaaaactcccgaaagggctgccgtccgatgggtacacgaaagtgacgaagttgctttgactactgaaccatgcctggatcgtcggagcgaattggatgatcgggccgagggctgccccctcttcccctcgctctcctttccttaatattcaccgtcgagtcatcaaagccgtcaactaattcggaggggctcggctggcccggtcgccctacgctactggcgcttccaaaggctaagctctcgtctttggcgaccagcaaagcaaacggagggagggctcaaacctttcgtgtgggagcgggggatgagccccaatnccttttccctcccgtacacgcgcatactcttgctccgtcncgcgttaggttaggttagtacttaccacttaacttagtacaataacccgcagccgtttttggggggacacggttctcttaaggcaaagaatctgaagtgggcgaacacccggccccgcgggggaaaatgccgggctccggcttcccacacccggctgacacctttcgaagcatttccacggtggacccgaacccgccttggccttcctttctctttccgggccgcgcgttgtttccgcttccctaggggccttttgtcttgttggagagaagaaaagggcccgaagaagaacaaaacttgccccccctgccttaggtcgcgaggacgactaagaagcgggnttgcgacgtttgcccggtcgccagcgaggagttttcaaatttccagggaggaaataggc

SEQ ID NO: 82776 - DNA, 887 bp, Zea mays
  misc_feature: Ceres CLONE 1568644
  misc_feature: Encodes the peptide sequence at SEQ ID NO. 82777
ggagctccccgcggtggcggccgctctagaactagtggatcccccgggctgcaggaattcgtctcacccctagaaaaaatgtgactgctcgcagaactaacgagctaagattcctcccctcactggcgcttgttcccatggtctcccaacaccgagccgccaattattcccactgtcccctcaccacgagatgctgcccttgtgctctgcatgcagatgcaggtgctgccgaggaagaggaggcactcccggtcctggcttctagacgttgtgaaccagatcttggtgcggttgcccgagtagtttactcgtctagaggaggggtttggttctcgacccgatttggtgggggcttcgccactgggatagggagggggacagtttggcctgctggatctttatcgccagttgttggttctgtcctttccattgggctggtactttcttgacggattggttaagcgctgtctgtggggttgttgtgctgctcctcccttcatctcgttttgtggtgatggtggggggaaaggaagaaaaaatttcccttagattccctccttcaccacctggaaaacacttttaacacgccccactggagatcgccaaagaagatcggcctaacagccgccacggtcgttactccttcaacacccgcgaacctccctgccccaagcttcccgacgcgccgagcgcccgggagccgagaatccggcgtcgtgccctcctaaaggccacgaacgggcctccctttccaaccctttaccccggtcgttccccccccatcgagggaataatcttccgccaggtccagcccgaacccaaaagggccgccacgggaacactgtctaatctaggactaaccccggcccccgtgggcttctaatcct

SEQ ID NO: 82777 - protein, 30 aa, Zea mays
  misc_feature: Ceres CLONE 1568644
MQMQVLPRKRRHSRSWLLDVVNQILVRLPE

SEQ ID NO: 82778 - DNA, 910 bp, Zea mays
  misc_feature: Ceres CLONE 1568646
  misc_feature (252)..(252): n is a, c, t, g, unknown, or other
  misc_feature (256)..(256): n is a, c, t, g, unknown, or other
  misc_feature (259)..(259): n is a, c, t, g, unknown, or other
  misc_feature (261)..(261): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (308)..(308): n is a, c, t, g, unknown, or other
  misc_feature (309)..(309): n is a, c, t, g, unknown, or other
  misc_feature (313)..(313): n is a, c, t, g, unknown, or other
ctcaccgcggtggcggccgctctagaactagtggatcccccgggctgcaggaattcgtctcacccctagaaaaaaccaccgcggaccattcctttcctttgtatctctatctatccctcctcggctcctcgccctttcccctcttgcccgagtcgctagcctccctgcccctgcccctgccccgcctcctcccgtggaccacttcctccaccttcgcttccatagcaggctagcagctgagcgaggtcaacntctntcncngtccgacggagaaagagaggggaaaggggaaannnnnnnnnnnnngnngggntggggggggagggggaggagagagggggaagggttggggggtatgctgcggagggggcaccggggcggcgagaacgagcactgggggtatgggtgtgtggggtagacggtcatcacgtaggagtgggaggcaggatgttcacgaacgtgccgagcctcgtttgcgcctttcccgcataagagaagagaggggggtgagaacgaaagaaccgggttggtggaggtcggcgttacggctggaatggggggtgggggggaggcggggtgggtgggcgggggttggcggtaccgtgtggtgggtgaggggattggagcgacgggataaaattacgcgtaggggggagaagaggaccaagatagaatgtcgggttcgggttggttatggccccggtgaatgagtgccactaatactatcgctgcgtttgacgaggcgcacagatagggcattggtaagagcagtatgtgactgaaactaaacaggaaaatatgaatttgagacgacaaccaattgtattaacgggacgttagtcggcagtaatggcaggctctgtacacacggagtagtgacttgagttattgaggaaagaatacaaccgga

SEQ ID NO: 82779 - DNA, 648 bp, Zea mays
  misc_feature: Ceres CLONE 1568651
  misc_feature: Encodes the peptide sequence at SEQ ID NO. 82780
  misc_feature (458)..(458): n is a, c, t, g, unknown, or other
ctccccgcggtggcggccgctctagaactagtggatcccccgggctgcaggaattcgtctcacccctagaaaaagacccaagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggatacctgcctcgagtcagcagctcggttcgtgtacgcgagactcanctcccgtgctactacgatggcgctactggacatgtgaagctgcccatgttcgggtggcccgaccccccgcagggggtacaagaaactgcaggaaggccttccccccgtaccccggaacccttccccccgggtcattggggtttcaaaaaaattttggggaaaaaccccgtggggccccacctttccttcc

SEQ ID NO: 82780 - protein, 163 aa, Zea mays
  misc_feature: Ceres CLONE 1568651
  misc_feature (58)..(135): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (101)..(101): Xaa is any aa, unknown, or other
MAPTVMMASSATAVAPFQGLKSAASLPVARRSTRSLGNVSNGGRIRCMQVWPAYGNKKFETLSYLPPLSTDDLLKQVDYLLRNGWIPASSQQLGSCTRDSXPVLLRWRYWTCEAAHVRVARPPAGGTRNCRKAFPPYPGTLPPGSLGFQKNFGEKPRGAPPFL

SEQ ID NO: 82781 - DNA, 849 bp, Zea mays
  misc_feature: Ceres CLONE 1568652
ctccccgcggtggcggccgctctagaactagtggatcccccgggctgcaggaattcgtctcacccctagaaaaataagagtgctattcctgctggctcttctcttccagatccatgggactacaaaggctatgggatacgtatgttagccacagccggcaagatgatcggatctgatctctggagatggtgtccgcccccatctgatatggaggggtgcggcacccatctggcttcgctccttgttggcgcggtaaggctcctgaggcctttactgcagtcggcccctgccccggcattgtaccccctgaatggaccgcggtgcactctcccgagaggggataacatcgtgtgcgcgacattgttatggcgagcctcggacaggttgaactatgagacctgcgcttggtggcctatgcaggctgctcaacctggatctctccaacaaggtgctatccttgcgggtcagaacattctggtcaccactgttgctaagggtgtgagggtggctgcaggacaatgtgtcgtaccgcacaccggaactgtgggtgtgttgatcgacgttcgccaagagcacgacagagatgaagcggttcacgtagggcttcctgacccagcacatggtggttaaaggtccaaggcattcttacagaaatctggtgggcagcaaggatgattgaggacataggtggcaaaattgaacgggtttcaatttccccggaagagaaaaatagctagggccaccgaggttgtcttcaaaaggggacgttcccccgtattcggtgggaggcccatcacaagagattccgggaaaaacatgggattggggaagacctgggccaggaatcta

SEQ ID NO: 82782 - DNA, 840 bp, Zea mays
  misc_feature: Ceres CLONE 1568654
  misc_feature (496)..(496): n is a, c, t, g, unknown, or other
  misc_feature (533)..(533): n is a, c, t, g, unknown, or other
  misc_feature (597)..(597): n is a, c, t, g, unknown, or other
ctcaccgcggtggcggccgctctagaactagtggatcccccgggctgcaggaattcgtctcacccctagaaaaaactccactgccagtgacatcccattctcttccgagctgcagcgctcaacgacgggaagaataccgtggcgtgggcggcgccatgaagtacagcaaggaagattagcccgagagggcgggcggcgcccgcccacggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgcccgtggcgttcacccgaatgcccccgccgactacccagaacttcacccccttgcaccaaccccaaacgctgggcgaaagttacnggaaacttaccgccttcaactttaagggaagggggcncttgccccggccggccgacccgaaacgggaaaaatttgtttcccccaaacgggcgttttcgggngccgtttcgtggggaacccttaataaagggggtctggggtccccgggagattgtcccaaaagagaaaccgttttccgataacccggtttttttaaaaccggggttggggggggggtccccccccgggttggggggggggggaaacccttttttggggggggggggggaaactccctccctcccacctatttttctttgatgggcccccccgcaggagtaaaaccaccccgggggggccccccg

SEQ ID NO: 82783 - DNA, 781 bp, Zea mays
  misc_feature: Ceres CLONE 1568655
  misc_feature: Encodes the peptide sequence at SEQ ID NO. 82784
  misc_feature (676)..(676): n is a, c, t, g, unknown, or other
ctccccgcggtggcggccgctctagaactagtggatcccccgggctgcaggaattcgtctcacccctagaaaaataaagcattttcctcgtcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatctttcacgcgccgggctctggcgccgggcagatgctcttcctccactgcggcgcaggcggcggtccccggcggcggtttgttccatccnaggggggaaaaaccaatgccttgggccttaaaaaaaggggcccgggcataaaacgggcccttttttttcccctgcccaaaaaaaaaacccccccggggaaaaaaa

SEQ ID NO: 82784 - protein, 37 aa, Zea mays
  misc_feature: Ceres CLONE 1568655
MMGFWLIPMETPARLLWSTSFFRHKIAAMLASSSCFL

SEQ ID NO: 82785 - DNA, 747 bp, Zea mays
  misc_feature: Ceres CLONE 1568657
tggagctcaccgcggtggcggccgctctagaactagtggatcccccgggctgcaggaattcgtctcacccctagaaaaataggaacaccgccgccgatgtttcttctccttactccggcttggctcctctgccaccgagacgacggcagggttgaggctcccgctctgacccacctcatcagcgttctcccgcttcttaccagtcgcgtcttgccctcgcctcgggtcatctgcacagcctctgcgtgaccttgctgtctgctggtttttccagttctgctagctcacccatttctcacttacaaaacgtgcgattctgtccctgatgaccagattcgaccatatgcttttactgagtacggacacatgggaatggccgtacttctggccaatgctgattacacggtcgtcctcagatgaactatcaagttgctgttgctggcactcttgacatgctcattgtcaaggatggcgggttgctctggaagcttcctggccatctgaaattctgtaaagagctcacgctaagtacatctgatcctgtcaaacagatgcatttataatgacgaggtaaacatgtgagagcattcggattaagtcaacgccatgctctggtacgtggcacgcacacttacacgatcaaggagctttgattttgccaccttcttgaatggttctttccgataaaagttggaaggctgcttccaaaaagttttcaaacacctcgatatagcctagccaccgggg

SEQ ID NO: 82786 - DNA, 904 bp, Zea mays
  misc_feature: Ceres CLONE 1568659
  misc_feature: Encodes the peptide sequence at SEQ ID NO. 82787
  misc_feature (236)..(236): n is a, c, t, g, unknown, or other
ctccccgcggtggcggccgctctagaactagtggatcccccgggctgcaggaattcgtctcacccctagaaaaaaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgcgcgaatgcccngtggaaggaggggcagagagggagggcgcaggcgcatctgatctgagctgagcccgcgaggttcgcggtctgcggtgcggcggcagaagtctcgccagcacgatggccagcggcagctcctccaggtacagctcgtacaagttgccggggctgcacggcacgctgctggaggcggcccacctgtcttgcctcgaggacccgtactccctgggcccgcggctggggtggggcccagtcgggctgttccccggcctgcccccaaccggtaaacggggaaggggcctggcctgccatccctccgccaagggcccggtttttttcccccaaaaaactttttccggggccggggctgggaattcccaggtttgggggcccccttgggggttccccccccaacccttgggggctcaagggccggtgttaaaaaaccccccacacttgggcccccttttttttggggtttctcccccccgggggggtattcttccccccccccccccaagggggggggtggtttttccacccgagaggagaggcccccgggttttttctcccccccccctggggagaggggggggccccccctcccccccccggggggtgtgtctccccccccccccctttcgcgccgaaagaaaatatctttcccccccggagagggggccccc

SEQ ID NO: 82787 - protein, 188 aa, Zea mays
  misc_feature: Ceres CLONE 1568659
MASGSSSRYSSYKLPGLHGTLLEAAHLSCLEDPYSLGPRLGWGPVGLFPGLPPTGKRGRGLACHPSAKGPVFFPQKTFSGAGAGNSQVWGPPWGFPPQPLGAQGPVLKNPPHLGPLFFGVSPPRGGILPPPPPRGGVVFPPERRGPRVFSPPPLGRGGGPPSPPRGVCLPPPPFRAERKYLSPPERGP

SEQ ID NO: 82788 - DNA, 908 bp, Zea mays
  misc_feature: Ceres CLONE 1568661
  misc_feature (674)..(674): n is a, c, t, g, unknown, or other
ctccccgcggtggcggccgctctagaactagtggatcccccgggctgcaggaattcgtctcacccctagaaaaacacccgtaccgtgtcctgcgggcttctgtgacaagctcccccggcctcggcgccggcgactgaacaagcgggcgggacccagctcgcatgacctccactgccgcgaggtacaagatggacggagcgtgaagagatgctccccctttaaggcagctagcgaattggctaaaccccgggaattgggtccttcgataaagttaaaatcgcagaacatatgttgactgcaccttacgcggcgatgaaaagtctgaaccgccttatgatgagacttctggctgtgggaagagaaacccccgagaagaaatccagagttgggagattatttccccccacccccctatcaatagggccttaaaccaacccgggtagaggcccccggcctgaaactactatggtcggcgacccaaaaaaaggccaaaatgccgggaaaaatggggcggagatcccccccgggtggcaaaaagggaaaaggacttcccccccagcaaggaggaccccgggggggcgtttttaggtaaaaacaggaaaagccacgcgccgggggggccgagaaaaaattttccccgggccgcggagaaaaaagagggggcccctccccanaaaaaatttggggggggggggggggaaccccccttcccctcccccggaagctaaaacaagaactcggccggggggtcggaagccatttccccgcacaaaaaagaatgtttttcactccaacaaaacaaaccttttgcgggggaagaaaccggcgcgccgcacccggggtggaaaaaaacaatttggggcgcgggggccgcgtttttttaagaagaccagaaaaaaacccccccc

SEQ ID NO: 82789 - DNA, 1027 bp, Zea mays
  misc_feature: Ceres CLONE 1568663
  misc_feature (11)..(11): n is a, c, t, g, unknown, or other
  misc_feature (58)..(58): n is a, c, t, g, unknown, or other
  misc_feature (59)..(59): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (78)..(78): n is a, c, t, g, unknown, or other
  misc_feature (79)..(79): n is a, c, t, g, unknown, or other
  misc_feature (453)..(453): n is a, c, t, g, unknown, or other
  misc_feature (968)..(968): n is a, c, t, g, unknown, or other
cagggaacacngaaggacgcgagcggacgaacatgcaccgaacacggaccgggacgannagaaaaacacaaannnnannttttttggagctccccgcggtggcggccgctctagaatagtggatcccccgggctgcaggaattcgtctcacccctagaaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagaggggaaacagcccggatcaccagctaaggcccctaaatgaccgctcagtgataaaggaggtgggggtgcaaagacagccaggnaggtttgcctagaaagcagccacccctttaaaggagtggcgtaatagctcaactgatcgaagcgcccctttgccgctgaaagatgaaacgggggctaaagcgatcctggcccaaaacctgtgggggattgtcaaaaatggccttcccggtaaggggggaagccttttcccccccttttttaagggggaaaaccaaaaaccccggaaaaagcgcggggggggtcccaaacccaaaacccgcggaaaaacccaaaaaaaatttttcccgggccttttgtgaggttaacacgaaaaaaaaccatttttggggggaggagaaaaattccccaaatgtgcgcccccccccaaaaaaaacccccccagggggggtttctccccccccaccccacaaggggggttctttcctcctccccccccggaagggggggtgtaaaaatatcacagagggcgcctctataaataaaatccaaaggcggccccaaaaaagaggggcgtatttttccccctatagtgggnaaaacacaacggggggggcgagaaaaaatattcccccggggagaaaacacccccccctg

SEQ ID NO: 82790 - DNA, 828 bp, Zea mays
  misc_feature: Ceres CLONE 1568664
  misc_feature: Encodes the peptide sequence at SEQ ID NO. 82791
ctggagctccccgcggtggcggccgctctagaactagtggatcccccgggctgcaggaattcgtctcacccctagaaaaacagaaacgaaatcttgcaattaaactctcttcagctgaatccaaattggctggccttgagaagaatgaagagagtgatatagttgccaaagttcaagctgaggcatcgttgttgaggcatacaaatgcaaacctcagcaagcaagttgagggattgcaaatgagccgactaacagaggttgaggagcttgcttatctacggtggatcaattcttgtctacgccatgagctttgtaactcagatcaagcagctagagcaacgacggatatagattacaatggtggcatggcttttaatgaggatgataatagcgaaggtgacgcaaaaacttccgaggacagttctgatataaaattcagcattgcagaacgcatcaagcagtggtcccagaatgataagagctgccaagcatcgaaaaaggaatcccttcttgatagggcatggattgaagctgcagaagcacgaagcccgacacgtaggcactcactcggtggaccaaagggatgtgcacaagacttcaacatcattaaaagaaggcaatccgatacctttattcagcctcccggatgcgacagatgagtcatttgccttttataaggatcctggcatcaggggagaagcctggataattcttggaaaacaagtatgaattttgggtccgaatctgaaaagttcaagattttgttctccagccaggcccgaaagtatgccaaatccccagggggcccgggatggttgaaaaaagcct

SEQ ID NO: 82791 - protein, 218 aa, Zea mays
  misc_feature: Ceres CLONE 1568664
GAPRGGGRSRTSGSPGLQEFVSPLEKQKRNLAIKLSSAESKLAGLEKNEESDIVAKVQAEASLLRHTNANLSKQVEGLQMSRLTEVEELAYLRWINSCLRHELCNSDQAARATTDIDYNGGMAFNEDDNSEGDAKTSEDSSDIKFSIAERIKQWSQNDKSCQASKKESLLDRAWIEAAEARSPTRRHSLGGPKGCAQDFNIIKRRQSDTFIQPPGCDR

SEQ ID NO: 82792 - DNA, 861 bp, Zea mays
  misc_feature: Ceres CLONE 1568666
  misc_feature: Encodes the peptide sequence at SEQ ID NO. 82793
  misc_feature (341)..(341): n is a, c, t, g, unknown, or other
ctccccgcggtggcggccgctctagaactagtggatcccccgggctgcaggaattcgtctcacccctagaaaaaacgtagccatatcacaccgcacacagtactcgtcctccttgcagagcttgcaccagcacgccaccttaccttgctttgctcgcactcgcacacagttgcgagcgcattgcttgcattgcgcagccgcaggccgcagcacgaagctagccagtaggcggtagatggcgagcagcgcggggaaccgcttcctgaggcagctgagcgcgagcaacggcgacgaagcggtctgcggcggcctgcagatggaccagcaggagtacggcggcnccggcgtggggaggaggggatcccggcggtggtcgaagaagcgggccgccgcccgcgcccgcgcgaggggctacggcgccggcagcgggaatggcgtgaagcagccgggctctgctggcggggaaccgggtgattgttgtgggtggaccaaaagctcgggagccaaccaccccatgatgtggggcgctcaccccccttccgccaaaaaggggggaattccttacggctgggttccaagtccctggcccccccctccggaaaaagggaaagggggaaaaaaaagccctccctccccttggacaaaataggttttgggaaaacttttttaaaagggcctcccagggcccaaaagggtgggaggggcaaaaaactcttttgtgaaaccaagggggcccaaaagggggggcccccgtggctccccccccggggaaaaaaaaatggggaggggccccccctcggtgggtgggggcccccccccggggggagggcccccccccccccggcgggggagaagaagggg

SEQ ID NO: 82793 - protein, 137 aa, Zea mays
  misc_feature: Ceres CLONE 1568666
  misc_feature (36)..(36): Xaa is any aa, unknown, or other
MASSAGNRFLRQLSASNGDEAVCGGLQMDQQEYGGXGVGRRGSRRWSKKRAAARARARGYGAGSGNGVKQPGSAGGEPGDCCGWTKSSGANHPMMWGAHPPSAKKGGIPYGWVPSPWPPPPEKGKGGKKSPPSPWTK

SEQ ID NO: 82794 - DNA, 838 bp, Zea mays
  misc_feature: Ceres CLONE 1568671
  misc_feature: Encodes the peptide sequence at SEQ ID NO. 82795
ctccccgcggtggcggccgctctagaactagtggatcccccgggctgcaggaattcgtctcacccctagaaaaaatgtctcaacaacccgtctccaagaaaccaccttcccccctcgctccaatcccaatccttctccgcggaccaatagaacccaatccgatcactccccacgcagtttccccatatcgaaagatccgatcggagtccggcagctaattcaccggggaaagatgaaggtcgacagggagatggagattctgctgaacgagatccccctcctccaccacgtcggcctcctcggcggcagcgaggccggcgcggacgacgacgccgacctctccttcctcatccacgagctcgccgcgatgggcctcgtcgacggcgacgacgagctgccggcgccgggcgctgccaccggctacggcttccccacgaaaggcgagaaccttgtcgccatgcactcgttctccatggccagccactacgcgcacatgcgctctctgtttgttcccgtcaccttcgacgacgccgccgctgccgacggctgggacatccggtgctccccgccgccttatgtgcctctggctttctccgccacgccgagggccgggtgcaagagcgtgaggaagaatgaacggctcggtgatgacgacgaggcccaagaaatgcggagccgcccgcggcgggccaagtggcacggcggagagccctggcccgccctgcccgggggtcatgtaacaacatggcgccgcgaaccagaacggggggccgccctgcctgcaaccaaaggcctcgacgaccggcaagggccggaggggcaaactatttcctgggcc

SEQ ID NO: 82795 - protein, 202 aa, Zea mays
  misc_feature: Ceres CLONE 1568671
MKVDREMEILLNEIPLLHHVGLLGGSEAGADDDADLSFLIHELAAMGLVDGDDELPAPGAATGYGFPTKGENLVAMHSFSMASHYAHMRSLFVPVTFDDAAAADGWDIRCSPPPYVPLAFSATPRAGCKSVRKNERLGDDDEAQEMRSRPRRAKWHGGEPWPALPGGHVTTWRREPERGAALPATKGLDDRQGPEGQTISWA

SEQ ID NO: 82796 - DNA, 998 bp, Zea mays
  misc_feature: Ceres CLONE 1568674
  misc_feature (950)..(950): n is a, c, t, g, unknown, or other
gagctccccgcggtggcggccgctctagaactagtggatcccccgggctgcaggaattcgtctcacccctagaaaaaactcgtctccattaaaatcggttttctccttggaaatctgctggcgagtcccaggacccgaatgccccactcttattacctgctaattttgaatttcctaatcgggttgcagctgcttatataagctcactaaccccgcattcgcttttccgactcccacctccagccaaatcgggctatagatcaaacgctgcactgtagggagcgtgaagccagcggcgaatggaatccctagccgccacctccgtgttcgcgccctcccgcgtcgccttcccccccgctcgggccctgggtagggcgggtacaattataccaaccaccccccactatcagcccggagcggaaccagccgggggaaaaaggctctggcggcccagaaccccccaggacgagcccccctgatttaacaagagcgccctgcgggaggagaaaagccgggggaaaggacaacaaaaaagcgggggtctttccgagactcggccggcgcccgcgggtaaacggtgaaagggggaaaaccccggtctggtcccgatgattagcggaggtgattatccgatgctcaggtaacaaattctttccccgcccccgtgggtgtggcacctactacaacataatctcggggtgtcccccaataggaacaaaaggggacatagaggagccccacaagggtgagcgggctaaagagagaggcgcgtaaaataagggggggcgcctccaaaagtacgcccacacataaggtggtgggcagagatagcggcaaatattattacatgcgccaccctacaagataatataaaactttattcggggcggaggagctatcgagggtggtataatctatgggcgtccaaattatacttacttcgggctcgntattctggttaaatcacaacacacacggtcaggcatcacctgcggcga

SEQ ID NO: 82797 - DNA, 835 bp, Zea mays
  misc_feature: Ceres CLONE 1568676
  misc_feature: Encodes the peptide sequence at SEQ ID NO. 82798
ctccccgcggtggcggccgctctagaactagtggatcccccgggctgcaggaattcgtctcacccctagaaaagtggccctcctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatggaccctgtattgagaacaagaaagcctctttcagtgaatttgggacctgggattctgggaaacctttttgacggtatccagcgacctcctaaaaacaatcgctattaggtccgggagatgggtatttcccccgggggggtttcagttccctgccctggaaaaaaaggtattgggggggaatttcgcccaccaaagcctggggggtgggaaagtccctccacggggggggaaatcttttccgctcctcgtttttttgaaacacccttgggggcgcccccctgtttcgtcttcccccgcgggttctttgggggaaaaaaatttttatttgtgcccccgggggggcggataaacccggggggaggaccggggggaaaaatttgggattttccggggcgtaaaaaaaaaaattctccccg

SEQ ID NO: 82798 - protein, 100 aa, Zea mays
  misc_feature: Ceres CLONE 1568676
  misc_feature (22)..(85): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLIGEIIRLEGDSATIQVYEETAGLMVNGPCIENKKASFSEFGTWDSGKPF

SEQ ID NO: 82799 - DNA, 823 bp, Zea mays
  misc_feature: Ceres CLONE 1568680
  misc_feature: Encodes the peptide sequence at SEQ ID NO. 82800
  misc_feature (607)..(607): n is a, c, t, g, unknown, or other
ctccccgcggtggcggccgctctagaactagtggatcccccgggctgcaggaattcgtctcacccctagaaaaaaaagggtttgcggggcggcgtatttaagcactcgtggcctcgcctctcctctgcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgaggcatggaacagcgacaccctcccgatctacgagcccggcctcgatgatgttgtgaagcagtgcaggggcaggaacctcttcttcagcactgatgttgagaagcacgtcgctgaggctgacatcatcttcgtctcggtgaacacccccaccaagacccgtgggctggnagctgggcaggctgccgacctcacttactgggagagcgctgctcgtatgatcgccgatgtctcaagtctgacaagatcgttgtcgagaatccaccgtccctgtcaagaccgctgaagctattgaaaaatcttgacccaaacagcaaggcatcaactacagatcctttcaaccgggagttcttgcaaaggcactgctaatgaggactgttcaagctg

SEQ ID NO: 82800 - protein, 133 aa, Zea mays
  misc_feature: Ceres CLONE 1568680
  misc_feature (2)..(132): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (96)..(96): Xaa is any aa, unknown, or other
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLXAGQAADLTYWESAARMIADVSSLTRSLSRIHRPCQDR

SEQ ID NO: 82801 - DNA, 784 bp, Zea mays
  misc_feature: Ceres CLONE 1568685
  misc_feature: Translation starting site: 254
  misc_feature: SWISSPROT Homolog: EC 1.6.99.5 NADH dehydrogenase (quinone)
  misc_feature (497)..(497): n is a, c, t, g, unknown, or other
ctccccgcggtggcggccgctctagaactagtggatcccccgggctgcaggaattcgtctcacccctagaaaaattttggggcccgcatatcgggccccggtgccattctctcaccgttctcgaaaccccgtgtacacgcagcagggtcacgggccacctccctacggaggagacgacccccatctcaaggtcgaggtcgagggctcctctctctctaccatctccgttcgatcccatcgccccgccgccgccatggcgtttctcgcgcgggcgctgcggcagtccaactggcgcctgtcgtcgcgctgccccgccgtggccgcctcctgccgttggatctccccgaccgccgccgcgggatcgccggaggccggcgcggcggtggcgtctgccgacccggagctgcctccgccgcgggagcccgttggcggcgccccgcgtggagcttcctcctaacccggaggacgcgctcgaggtattcgtggatggccatgcngtgcggatccccaagggttcaccgtgctccagcctgcgaggtcgcgggcgtcgacatcccgcgcttctgctaccataggcgactctccatcgctggaaactgccgcatgtgtctcgtcgaggtcgagaagtcgcccaagcccgtcgcttcctgtgccatgcccgcgctccccggggatgaagattaagacaaacaccccagtggcaaaaaaaggcaagggagggtgtcatggaagtccttgctgatgaaaccatcacctcgactgcccaatcttgtgatcagggcca

SEQ ID NO: 82802 - DNA, 784 bp, Zea mays
  misc_feature: Ceres CLONE 1568686
  misc_feature: Translation starting site: 188
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagagtaaccgcaccacaccctcgtacgtcgccttcaccgactccgagcgcctcatcggagatgcggccaagaaccaggtcgccatgaagcccatcaacaccgtctttgatgccaagcgtctcatgggcaggaggtttagtgatgcctctgtccagagtgatattaagctgtggcccttcaaggtcattcctggggcccggtgagaagtcaatgatagtggttcaccaccagggggaggaaaaccagtttgcagccaaaaaaatctcctccagggtcctcttcaagatgcgggaaatccgctaaagcttacccttggaagcccgatcaaaaaatggtggttgtccccggggccctgtggcctatttcaaagaacttcaaagagggggggccccccaaagaaattcctgggggggtaatttcccgggccccaaaaatgggccggcgccttcttcccatggggccccacccccccccgcgggttttggcccaat

SEQ ID NO: 82803 - DNA, 958 bp, Zea mays
  misc_feature: Ceres CLONE 1568688
  misc_feature: Pfam Name: Peptidase_M17_N Pfam Description: Cytosol aminopeptidase family, N-terminal domain
tgtggtatttaatctctaaggagcgggaaaaaggggggatttaaacaagaaggagttttgggcggcccccccaaaactggactcccgtggtggcggccgccttctacgcgcggggactcaccagcccttttccgtcgagccgcctcaggtcaccttttccgcgaaagacatcgaattctccgagtggaagggcgatattctcgctgtcgccgtcacggagaaggatctgtccaaggacgcggactccaaattcgagaatgccgtcttgaagaagctggacggccagctcggcggcctcctgtcggaggctgcggcggaggaagatttcaccgggaagacggggcaggcggtggtcctccgcctcgcggggcagggcttcaagagggtgggcctgatcggtcttggtcagagcgccccgtccaccgccgccgctagccgaggcctcggcgagtctgtcgcgtctgttgccaaggccgctcaagctagcagcgctgcaatcgttcttgcctcccccagtgggatccaggaagagttcaagctgactgctgcagcagcagttgcttctggaaccgtgctggggttgtatgaggacagcagatacaagtctgaatcgaaaaaggggcaccttgaaacaggttggatattattcggactggggttctgggtgccggagggtggaatcagaaaacgtcaagtgatggctaatggatcttttgcggcgggggggggaaaattcgagaaagaagagatgggggaaactcctcctgccaaatggtcctttagcccctggctgggggccttgccggagggaggggcgtcaagaaaatcgctttccaccctcaaagggggatgtagttcccctggcccaacaataacccaggaatgttggaaaaaatgggaaaagaaaccagaggattgggcgttccccgcgcctggggaaggtgtggtgcaagccttc

SEQ ID NO: 82804 - DNA, 887 bp, Zea mays
  misc_feature: Ceres CLONE 1568689
  misc_feature (837)..(837): n is a, c, t, g, unknown, or other
ctggagctcaccgcggtggcggccgctctagaactagtggatcccccgggctgcaggaattcgtctcacccctagaaaaaagtcggatcctcatactgcaagaaccctctctgtctcgctctctctctctctgtctctctctctcacaaggatctgtccaaggacgcggactcaaaatgagagaatgccgtcttgaagaagctggacggacagctggggggcctcctgtcagaggctgcggaggaggaagatttcaccgggaagacggggcaggcggtggtcctccgactcgcggggaagggcttcaagagggtgggcctgataggtctaggtgagagagcccagaccaccgccgccgctagccgaggcctaggcgagtctgtcgcgtctgttgcagagacgctcaagctagcagcgctgcaatcgttcttgccgcccccagtgggatccaggaagagttcaagctgactgctgcagcagcaattgcttctgggaccgggctggggtggtatgaggacagcagatacaagtctggaacgaaaaaggggcacctgaaacaggtggatatgatgggactgggtttctggggcgaagggggaatcagaaaataaagaatgcggagggatctttccccggggggtaatagttgggaaagaaagcatggggaaactcggggggaaaaaggtcccttaacccctggctgggccttgggggaaggagggcggcaaaaaaatagctttccaactttaaaggggaaggggggttcactggggcaacaggaaaccaggagagggggaaagaaaatgggaacaaagagcctaaaaaagagggggggtncctcaaacatagggaggaagtgggcaagacaaaactttttggggaaaaaa

SEQ ID NO: 82805 - DNA, 822 bp, Zea mays
  misc_feature: Ceres CLONE 1568690
  misc_feature: Encodes the peptide sequence at SEQ ID NO. 82806
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaaacaagtcggctcctgtcacgcgacctgctgctgctgccggcgacggcgaggatcctgggggtcgcgcatggcaagcgagagatctcgacgaagccatctcgtcgctggtcctgttccccactggcaacgctaccgaagaggagctgaagacgggggcgtccccccctgcgacatgatggtggcgagccca

SEQ ID NO: 82806 - protein, 212 aa, Zea mays
  misc_feature: Ceres CLONE 1568690
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGNKSAPVTRPAAAAGDGEDPGGRAWQARDLDEAISSLVLFPTGNATEEELKTGASPPAT

SEQ ID NO: 82807 - DNA, 816 bp, Zea mays
  misc_feature: Ceres CLONE 1568696
  misc_feature: Encodes the peptide sequence at SEQ ID NO. 82808
ctggagctccccgcggtggcggccgctctagaactagtggatcccccgggctgcaggaattcgtctcacccctagaaaactctcacctcgacgcgcctccaaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagccttttgggcccttcgatgtctgttagcggtggcatcaatgtcccagtgatgcggaccccgctctgtgctaatgctcctgctgagaaaggaggcaagaacttcatgatcgatttcatgatgggcggtgtttcagctgctgtttcgaagactgctgctgctcacatcgagcgtgtgatgctgcttattcagaaccaagatgagatgattaagtctggtaggctatcagagccgtacaagggtattgttgactgcttcaaacgtaccattaaggatgagggtttctcttccttgtgcgagggtaacactgctaatgttattcgttacttccctactcaggctgtgaactttgcatttaagactactgaaagagggtgttttacttcagaacgatagggatgggtattggaaatggtttgctgggcacctggcctccggtggagctgctggtgctccctctttggttgttgcggaccccttggaca

SEQ ID NO: 82808 - protein, 183 aa, Zea mays
  misc_feature: Ceres CLONE 1568696
  misc_feature (86)..(183): Pfam Name: Mito_carr Pfam Description: Mitochondrial carrier protein
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAHIERVMLLIQNQDEMIKSGRLSEPYKGIVDCFKRTIKDEGFSSLCEGNTANVIRYFPTQAVNFAFKTTERGCFTSER

SEQ ID NO: 82809 - DNA, 794 bp, Zea mays
  misc_feature: Ceres CLONE 1568697
  misc_feature: Encodes the peptide sequence at SEQ ID NO. 82810
ctccccgcggtggcggccgctctagaactagtggatcccccgggctgcaggaattcgtctcacccctagaaaaacttttcctcctcctcccctttgcggcttctcgcagcgctgcgaatcccaatccgcaccgatccgacgcgaatcgatcgagaggcagggggcagcactaatcgaatcgagactagcgccatgaacccgagaggctatcgtagcaacagaacttctctcttcgatggcattgaggagggtggaatccgagcaacatcctattcttctcatgagatagatgagcaagaaaatgatggagctattgatggactgcaggatcgtgtcagcattctcaagcggttgtcaggcgatatccatgaagaggtggagactcataacagaatgctggaccgaatggggaacgatatggatacttcaaggggttttctgtctgggaccgtggacaaattcaagatggtatttgagaccaaatcaagccggaggatgggaaccctcgtcgcatcattcgtcgcccttcttctgctggtttactacttgaccaggtagaagacatgacatgctggaaatggtcatctcatcatctgcgtgccgtgccgtatagatagataccttgaaaaccaccgccctgagtgccaaagtatatgttgatgtggcctgtgggtgtttcgtcaactctgcactgtacacacgactacagcgtgcgtgctggggcgatcctattatctgggtgtgcaggaatcaagtttgttgtccgttccctccttttggtatttagtaacata

SEQ ID NO: 82810 - protein, 121 aa, Zea mays
  misc_feature: Ceres CLONE 1568697
  misc_feature (36)..(98): Pfam Name: SNARE Pfam Description: SNARE domain
MNPRGYRSNRTSLFDGIEEGGIRATSYSSHEIDEQENDGAIDGLQDRVSILKRLSGDIHEEVETHNRMLDRMGNDMDTSRGFLSGTVDKFKMVFETKSSRRMGTLVASFVALLLLVYYLTR

SEQ ID NO: 82811 - DNA, 903 bp, Zea mays
  misc_feature: Ceres CLONE 1568701
acccgcggtggcggccgctctagaactagtggatcccccgggctgcaggaattcgtctcacccctagaaaaaaccttctcttctccctccattcctttcctttgccccaaccatgccatattggagaggcgtcgagatcttatccctcgatccaattccaaacagaaaccgccggagctggaacaagagccgctcgcagcttgctggactctcccgctcctggccccggagccgccggccatggccaagcacaagcagcgcaaggtgtaccaagtctggaaaggcaaaaacgtgagtttgattttgccgtccctcgtaccgaccagaaaaggtcgcgccttttctcgtttttggggattgccctacccgtgcttaatttcatccttgcttttgttgcttgccatcccggcggccttagccttagctagcattggttcatggtggatgggccctaagccatggaacggggaccccattaattaggttggaaaaataaataggcccggaattttcctccagggccccccaaaacaaagcctaaacaatagcctcccccattttccaggcaaaaccttggggtgtggggggggggagaaaaaaatttttttttgagaataaacccttttcccattttctgtgccccgcgggtggggcccaatttgtgggggggaacgggtgtgcccgggggttgccccccctctgggggccccccaaaaaaaaatcccccttgcgggggcgggggggaaagaaggggttgaaactcctctgtgggggaccccaaaaattgccccccagaggggcccccgccccccccgaaaatttttccactcccgcgcccacccccctataataatgccgcccccacccccccccgtggggccccacattgtgccccccgtctag

SEQ ID NO: 82812 - DNA, 921 bp, Zea mays
  misc_feature: Ceres CLONE 1568706
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (476)..(476): n is a, c, t, g, unknown, or other
  misc_feature (477)..(477): n is a, c, t, g, unknown, or other
  misc_feature (479)..(479): n is a, c, t, g, unknown, or other
  misc_feature (488)..(488): n is a, c, t, g, unknown, or other
ggagctccccgcggtggcggccgctctagaactagtggatcccccgggctgcaggaattcgtctcacccctagaaaaaaaaaacaccactccatctctcctcttcccagcgatttcctcttcccctcctcgcccgccgaggccgcccgtcctccgtccgccgtcccagcgagagctttaagattgtgcagacacataatttggatgctcctgcctatgcaagatgtcaaccaccagagatattgtttagtgctgggaaagttatgcagttttggatcataaattctaaatagacaagataattatggaccgtgcagacacatcagggtttgtcagtggtggttgctttggtactacactcctgctgatattctttcatttcgtctattctacagtccgtgtctgaaaaatcgtcagtaacgctgcagctgcctgggcaaaattcatagnnnnnccccccccccaacnnnnnnnggnncnttggaaatnaaggggttttttatctcatttttcttttccacccaccgttaatattgtctttaacgggggagggaaaaaacggcttcttgggaaattccccccttccgcccccttgatggaatagacccctttttgtgtttagtggggaatggctcaagcggccaaagctttctacgggggggaaaaccatgggggcccaaaagcaccctcctgtttttgggatgggccctgaaaccccaggcaatttttgttagttttgcaccccccttgtttatttgggaaaataccccccgaattaatggggatggaaactttacccggcccaaaataattatttggcccccccggggtttaattccctttgggtgttgggggccccacacacccagataattttttttttttcttgccagtggtgccccctggggccatcaaaaaaaac

SEQ ID NO: 82813 - DNA, 838 bp, Zea mays
  misc_feature: Ceres CLONE 1568707
  misc_feature: Encodes the peptide sequence at SEQ ID NO. 82814
  misc_feature (448)..(448): n is a, c, t, g, unknown, or other
  misc_feature (449)..(449): n is a, c, t, g, unknown, or other
  misc_feature (523)..(523): n is a, c, t, g, unknown, or other
  misc_feature (579)..(579): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (660)..(660): n is a, c, t, g, unknown, or other
  misc_feature (668)..(668): n is a, c, t, g, unknown, or other
  misc_feature (669)..(669): n is a, c, t, g, unknown, or other
ctccccgcggtggcggccgctctagaactagtggatcccccgggctgcaggaattcgtctcacccctagaaaaagtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaacttgtgctccgcctcaggggaggcatgcagatctttgtgaaaaccctgaccgggcagactatcacccctcgaggtggagtcctctgacaccattgacnnacgttcaggccaagatcccgggacaaggagggatccctccagacaagcagcggctcatctttgctgggagcaancttgaggaaaagggccaccccttggcaaatttcacttcccgaaaaggaaacccccntccccttgggggttgggccccaagggagggctgcaannnnnnnnnnnnnnnnnnnaaaatttttcggaaagtaaannncgngggcgggnnaaatttcaaccggtccgagggggaggccttaaaaccccttgaaaaatgtaaggggcaaattcccggaaaaaggggggggttttcccccaaaaccaagaaagggggttattcttttctctgaaaacaaacttttggggaaggggggccaacctgtgggcgaataaaaaaa

SEQ ID NO: 82814 - protein, 96 aa, Zea mays
  misc_feature: Ceres CLONE 1568707
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLQLVLRLRGGMQIFVKTLTGQTITPRGGVL

SEQ ID NO: 82815 - DNA, 775 bp, Zea mays
  misc_feature: Ceres CLONE 1568708
  misc_feature: Encodes the peptide sequence at SEQ ID NO. 82816
ctccccgcggtggcggccgctctagaactagtggatcccccgggctgcaggaattcgtctcaccccctagaaaaaattccacccgcttcccccagccgcacgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagatgatgaagtacctccgctttctccgcatgcggatgaacaccaagccatcccatgggcccatccacttccgcgccccgtccaaagatccctgtggcgcacccatccgcgggatgattctccacaagaccaagagggggggaggcgctcttgccaggctcaagacgtacgagggcgtccccgcgccgtaccacaggacaagcgccctggtcatccctggaccttctaaagttcctgaggctgcaaacttggacaccagtactgccctccttgggaaactttccaaggggggccggatggaacttccctgaccccttcggggaccttggagggaaaaaagggaggggaaagggcttaggggggccccttttaaaaaggaagaaaaacaattttggcccaaaatttccccccctaaagggggtggggggttcaacccccccaaagaaaaaaaaattttgggggcgccccc

SEQ ID NO: 82816 - protein, 157 aa, Zea mays
  misc_feature: Ceres CLONE 1568708
  misc_feature (11)..(128): Pfam Name: Ribosomal_L13 Pfam Description: Ribosomal protein L13
MVSGSGVCAKRIVVDARHHMLGRLSSIIAKELLNGQKVVVVRCEEICMSGGLVRQMMKYLRFLRMRMNTKPSHGPIHFRAPSKDPCGAPIRGMILHKTKRGGGALARLKTYEGVPAPYHRTSALVIPGPSKVPEAANLDTSTALLGKLSKGGRMELP

SEQ ID NO: 82817 - DNA, 803 bp, Zea mays
  misc_feature: Ceres CLONE 1568710
  misc_feature: Translation starting site: 176
  misc_feature (564)..(564): n is a, c, t, g, unknown, or other
ctccccgcggtggcggccgctctagaactagtggatcccccgggctgcaggaattcgtctcacccctagaaaaaatctggcatcggtccaactattcagtccaattgccacccactgcctgacgcaagctcgctcgtccgagtccgacgttgataccattggccgccgcgccgccatggccgtgtcgccggaccagcagcagccacctgcagggccagggtctcccttgccgtctcctcgcctccgcgtccgcgtcctcgacaccaccctcgtgccgccgtctccgtcaccaccggagacctcgctcccgctcaccttcttggacatcttctggctgcactccccgcccgtcgagcgcctcttcatctaccgcctcgcccccgacgctgacgtcgacgccatcatctccagactccgggactctttgcaccaggccgtccgcgccttctaccctctcgccggccgcctccgcctcacccccggcacgtccgaccgctacgagctgcactaccgcccgggtgacgccgtcaccttcaccgtcgccgagtgcgacgacgatgacgncgacgcgcacttcgacgccctcgccaccgacgagccccgcgaggttgcccaagatcgcacgctcgtgccgccgctgccggagcgcggcggggctgtcgccgtccagacacgctccttcccgcgcgccgggggcctctcatcggcgtcaacgtgcaccacgccgcctgcgacggctcgggcttcacgcacttccggcacaactggggcgtcccctgcaaagcccgcccataacccccccc

SEQ ID NO: 82818 - DNA, 924 bp, Zea mays
  misc_feature: Ceres CLONE 1568713
  misc_feature: Translation starting site: 505
  misc_feature: Pfam Name: DUF567 Pfam Description: Protein of unknown function (DUF567)
ctccccgcggtggcggccgctctagaactagtggatcccccgggctgcaggaattcgtctcacccctagaaaaaccgagcaatcgcgcgcggccgccgaggtgccaaggcggcggcggtcggtcggtctgcgatatacgatggcggcgccttactacggaggtcctccggcggcgccggcccccgtggcggtggtgtccccgcagttctgtgcgccgtacgtggtgcccctgacggtgaccaagaaggccatcagcctctccgacggcgacttcaccgtcaccgacgccaacggcgccaccgtgctgcaggtcaagggcgccgtcttcagtatccgccaccgccgcgtcctcctcgacgccgccggccagcccatcctcaccatggctggagaaggtattcagcatgcacaacagaatgggaggtgttcagaggggacagctcgaacgagagcgacctgctcttcaccgcgaagaaatcctcgatattccagctgaagacggagatggacatcttcctggcctccaacaccgcgcagcaggtgtgcgacttcaagatcaagggcagctacttcgagaggtcgtgcgccttctacctcggcaactccagcagcatgatcgcccagatgaaccgccagtttaccgtcaccaatgtgctgcttggaagggacacgtttggcgtcactgtgttcccgcacgttgactacgtgttcgtcgctgctcttggtgtgatactggatgagattcatagggaaacgtcccgactgagacataccacacacaccaccagcttctccaccgtgctcgacatgctatgctatgatcatcatcacaggttattctgtcaatatatacttccatgtatgttatgtaagtattatgagttatacacacccccggacaaaggttaaaaaagtggcaagttt

SEQ ID NO: 82819 - DNA, 944 bp, Zea mays
  misc_feature: Ceres CLONE 1568714
  misc_feature: Encodes the peptide sequence at SEQ ID NO. 82820
ctccccgcggtggcggccgctctagaactagtggatcccccgggctgcaggaattcgtctcacccctagaaaaaatggcgtcgagcgacctcgccgagagcctcctccccggcggcgggggcggagcctccgcctcacatgacgaatacgaggagcgcgcgtacgactccgaggacaagatctccatcgccgtgtcggattccgacggcgaagacgacggcacgccggcgtcgcgcccgcccttctcgtggcggaagctctggcgcttcacgggcccgggttttctcatgtgcatcgcgttcctggacccgggcaatctggagggggacctacaggcgggcgccgcggcggggtaccagctgctgtggctgctcttgtgggcaacgatcatgggcgcgctgatgcagctgctctccgcccggctaggcgtggccacggggaagcacctcgccgagctctgccgccaggagtaccctccctgggccactcgcgcgctctgggccatgacggagctcgcgctcgtcggcgcagacatacaggaggtgattggcagcgcgattgccatcaagatcctctcggggggtgccataccgctctggggtggcgtcgtcatcaccgcgctcgattgcttcatctttctcttcctggagaattatggcgtgaggaaactcgaggcatttttcgctgtactgattgcaactatggctggttcatttgcggttatgtttggtgaaacaagcctagtggcagggacttctgatcgggttggttgtccaaaatggagtcaaaagacatttaagcagcggttgggaatgtgggctgcatcatcatgcctcaccatggttttctgcattcagcactatggcagtccaggaagatgtaccaaaccagaatctcgtggtcctagagcagttactacctttacatcgagtcaatccgtgcac

SEQ ID NO: 82820 - protein, 290 aa, Zea mays
  misc_feature: Ceres CLONE 1568714
  misc_feature (82)..(290): Pfam Name: Nramp Pfam Description: Natural resistance-associated macrophage protein
MASSDLAESLLPGGGGGASASHDEYEERAYDSEDKISIAVSDSDGEDDGTPASRPPFSWRKLWRFTGPGFLMCIAFLDPGNLEGDLQAGAAAGYQLLWLLLWATIMGALMQLLSARLGVATGKHLAELCRQEYPPWATRALWAMTELALVGADIQEVIGSAIAIKILSGGAIPLWGGVVITALDCFIFLFLENYGVRKLEAFFAVLIATMAGSFAVMFGETSLVAGTSDRVGCPKWSQKTFKQRLGMWAASSCLTMVFCIQHYGSPGRCTKPESRGPRAVTTFTSSQSVH

SEQ ID NO: 82821 - DNA, 939 bp, Zea mays
  misc_feature: Ceres CLONE 1568715
  misc_feature: Translation starting site: 127
  misc_feature (866)..(866): n is a, c, t, g, unknown, or other
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccctcggcaaccccagcctgatccacgcgcagagcatcctcgccatctgggcctgccaggtcgtgctcatgggtgccgtcgagggctaccgcattgccggcgggccgctcggcgaggtcgtccacccgctgtaccctggcggcagcttcgaccccctcggcctggccgacgaccccgaggccttcgccgagctcaaggtgaaggagctcaagacgggccgctccgcatgttttccatgttcggctttctcgtccagccatcgtcaccggcaaggcccccctcgagaactccctgacacatcgctgaacagtcaanacaaccgatgggctacgccaccacttcgtccccggaacaagctcaacggtttgctttgcactcaattgccttc

SEQ ID NO: 82822 - DNA, 913 bp, Zea mays
  misc_feature: Ceres CLONE 1568716
  misc_feature: Encodes the peptide sequence at SEQ ID NO. 82823
  misc_feature (640)..(640): n is a, c, t, g, unknown, or other
  misc_feature (819)..(819): n is a, c, t, g, unknown, or other
agctccccgcggtggcggccgctctagaactagtggatcccccgggctgcaggaattcgtctcacccctagaaaaaacgcagccccgctatgtcggtcgctgtgctgcgagtgcgagccatggagctactggcacgacccgcagcggcagcgtcctcctcctgcgcgcgaccctcgctacagctccccgccccgggcacatcccgtccccgtcggcccgggttccctactctccgcgcagctgcggcggcggcgatcgccgcggagccgcaatcgaacgagcagcagaatatcattatggaaactgaggtgtttgcctgccctgtctgctacgagccattgatgagaaaagggccaccaggcataaacttgccagcaatttataggtcgggattcaagtgttcaaagtgcaacaagtcatttaccagcaaagacatcttcctggacctcactgtaactgcagggacaaaagaatatagcgaacagaagcccgctagaactgagctgttcaggagtccacttgtctcatttctttatgagagagggtggcgacaaaactttaatcggagtggtttccctggtcttgacgaagagtttcaaatggctcaagactattttcaacccattgctggtggtatccnttctgatgtcagctgtggcagtggcttgtttactaggaagtttgcaagtctgggacatactcagctgtgatcgctttggacttctctgagatatgctccgcaatgctatgaatcattaagcaagagatcctctcctcatgtgaatccgcactcgtgagagcaaaatttcgaggctcccnttttgctctggtcagagatgccatcatgctggacggctatccatggtgccctcacctctatgcggtactgaaatagcgcgtctgaaggcctggg

SEQ ID NO: 82823 - protein, 137 aa, Zea mays
  misc_feature: Ceres CLONE 1568716
  misc_feature (115)..(115): Xaa is any aa, unknown, or other
METEVFACPVCYEPLMRKGPPGINLPAIYRSGFKCSKCNKSFTSKDIFLDLTVTAGTKEYSEQKPARTELFRSPLVSFLYERGWRQNFNRSGFPGLDEEFQMAQDYFQPIAGGIXSDVSCGSGLFTRKFASLGHTQL

SEQ ID NO: 82824 - DNA, 939 bp, Zea mays
  misc_feature: Ceres CLONE 1568717
  misc_feature: Encodes the peptide sequence at SEQ ID NO. 82825
  misc_feature (756)..(756): n is a, c, t, g, unknown, or other
  misc_feature (839)..(839): n is a, c, t, g, unknown, or other
  misc_feature (858)..(858): n is a, c, t, g, unknown, or other
tccccgcggtggcggccgctctagactagtggatcccccgggctgcaggaattcgtctcacccctagaaaaaaaacgcaggccgcagtcgcgtgcggaactagagctccttcagagaagtgccgtgccagtgccaccgccggccgcatcatcgttccgcccccctgagtgttcagtaactttcttccgatcatattatggcttcaaagcagcaccagaaacagttcctggatgaaggcctgatcaaaccgcccaaccccgaagaggacctgaggagcccatggcccctcatggggaaaaatatggggttttgaatcccaaacccaaacccttttagggggtggtacaggcaaaagggaaagggggaacactccccctgggggggtttttataccccccctttttttttttttttttccccgccccctttttaaaacacccccccaagagcgccgggggggggaaaaaaaaaagggggggggggggggaaacacaaaaaagagcggagggtttttttttaagggggggggggaaattttctctccccccccgggggttgtgggggtgggagaaaaaaaaaaaaaaaacacaggggggtgtttttttttttttttttccccaaaaaaaaaaaaaacccgccccccccacccaaaaacaaattaaagaccccgccccccccccgggggggggggtggagttatatatttttattttttgggggggggggggggcaaaaaaaaaaaaagagatacctctncccccccccccccacaaaaaaaaaaagggggggggggggggggggggggggggttaataaacaataaaaaaataaaaacgggncacccgcccggggtggggnggccgaccaaagacacgccttgcgccgcagctgtttatagttcgttttcggtccccacccggcagaggttatcggaaaacc

SEQ ID NO: 82825 - protein, 38 aa, Zea mays
  misc_feature: Ceres CLONE 1568717
MASKQHQKQFLDEGLIKPPNPEEDLRSPWPLMGKNMGF

SEQ ID NO: 82826 - DNA, 940 bp, Zea mays
  misc_feature: Ceres CLONE 1568718
  misc_feature: Translation starting site: 170
  misc_feature (859)..(859): n is a, c, t, g, unknown, or other
ggagctccccgcggtggcggccgctctagaactagtggatcccccgggctgcaggaattcgtctcacccctagaaaaagccctcccaaaccctcgcgccgccgctccccagcacatcgctcccagcgcgccaaatcggcggcaacctcggacccttcactcacccagctatggcggagcgaggcggcgagcgtggcggagaacgcggcggcgagcgtggcggttttggccgcgggttcggtcgcggcgggcgcggcgaccgtggtggtcgccgtggtggccggcgcggcggccgccagcaggaggaggagaagtgggtgcccgtcaccaagctcgggcgcctcgtgaaggagaaccggatcaacaagattgaggagatctacctgcactcgctgccggtcaaggagcaccagatcgtggagaccctcgtcccggggctcaaggacgaggtgatgaagatcacgcccgtccagaagcagacccgcgccgggcagcgcacgcgtttcaaggccttcgtcgtcgtcggcgacggggacggccacgtcgggctcggcgtcaagtgcgccaagggagtcgccaccgccatccgtggcgccatcatcctgggcaagctctcggtcgtgcccgtcaggaggggctactgggggaacaagatcggccagccgcacactgtgccctgcaagggtcacggcaaagtgcgggtccgtcaccgtgcgcatggtgccggcgcccagggggttcgggaatgtcgctgcccgctggcccaggaaggtccttccgttcgccgggcttgaagatgtctttacttcggcccggggctccaccaaaacactccggaaccttcgccaaggcaacctttngattgggcggagtaagaccatcggctgtcctccctcctgagattctggggccgagaaccaattattgccaaggacccggtc

SEQ ID NO: 82827 - DNA, 959 bp, Zea mays
  misc_feature: Ceres CLONE 1568719
  misc_feature: Encodes the peptide sequence at SEQ ID NO. 82828
  misc_feature (777)..(777): n is a, c, t, g, unknown, or other
  misc_feature (802)..(802): n is a, c, t, g, unknown, or other
  misc_feature (817)..(817): n is a, c, t, g, unknown, or other
  misc_feature (843)..(843): n is a, c, t, g, unknown, or other
  misc_feature (874)..(874): n is a, c, t, g, unknown, or other
  misc_feature (918)..(918): n is a, c, t, g, unknown, or other
  misc_feature (959)..(959): n is a, c, t, g, unknown, or other
ctccccgcggtggcggccgctctagaactagtggatcccccgggctgcaggaattcgtctcacccctagaaaaacttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaataaaggccacacacagccgcactcgcacagccgccaccaccacctggtccacgtcgccggcggcaatgtgggcccacctggccgtggcgctgttcgtggcgttagccgtggctcccccggcccgcggctccgacgtgccttcgttcccgctgtcgcaggcgcagtccccgtccaactcctcgtccccgtccaacgccgcctcgcggccgtgccacctggacctctcggccgagctcttcggcggggtagccgcggcgtgcggcgcctgctgtggcccgggctcgctggaccgcggccgctgctgcccggtcctggcggcctggctcttcgcggcgcacgcgcgcaccgcgctgtccgtgcccccggcgccntccacctcggcgctagcgggggacntagggaatggggccngactgcggcgacaactggcccatggntacgtacgtacaccagaagtgtgtctacccnctgggcccccccctgaacggcccggggtggcccttcccggaccnaccgacgtgcgaacggtgctctgctctgcggatccggttcn

SEQ ID NO: 82828 - protein, 162 aa, Zea mays
  misc_feature: Ceres CLONE 1568719
  misc_feature (111)..(111): Xaa is any aa, unknown, or other
  misc_feature (116)..(116): Xaa is any aa, unknown, or other
  misc_feature (135)..(135): Xaa is any aa, unknown, or other
MWAHLAVALFVALAVAPPARGSDVPSFPLSQAQSPSNSSSPSNAASRPCHLDLSAELFGGVAAACGACCGPGSLDRGRCCPVLAAWLFAAHARTALSVPPAPSTSALAGDXGNGAXLRRQLAHGYVRTPEVCLPXGPPPERPGVALPGPTDVRTVLCSADPV

SEQ ID NO: 82829 - DNA, 929 bp, Zea mays
  misc_feature: Ceres CLONE 1568720
  misc_feature: Encodes the peptide sequence at SEQ ID NO. 82830
ctccccgcggtggcggccgctctagaactagtggatcccccgggctgcaggaattcgtctcacccctagaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactactacatccagaaggagagcaccctccaccttgtgctccgcctcaggggatgcatgcagatctttgtgaaaaccctgaccggctagactatcaccctcgaggtggagtcctctgacaccattgacaacgtcaaggccaaggatcagggacaaggagggcatcccctcccgaaccagaagcgggttcatctttggcttgggaaacaaccttgaagaagggggcacccttggccaaatcaaaaatccagaaggggaagcccccccccgtgggggcgggcccccaggggaggcaatgcaaattttccgggaaacccgtgacggggaaaatattcccccccgggggggggtgttttaaacacccttgaaaagtttaggggcaaattcccggaaaaggggggttttcccccaaaaaaaaggggggtcttttttttgggaaaaaccttgtgggaggggggcccccgggccaaaatataaccctcaaagagggacccccccccctggtggcccccccgggggggggaagaaattttttttggaaaaatttggggggggaaaccccccccgggggggggggggccccccccccccccttgtgtttgagagg

SEQ ID NO: 82830 - protein, 86 aa, Zea mays
  misc_feature: Ceres CLONE 1568720
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYYIQKESTLHLVLRLRGCMQIFVKTLTG

SEQ ID NO: 82831 - DNA, 921 bp, Zea mays
  misc_feature: Ceres CLONE 1568721
  misc_feature: Encodes the peptide sequence at SEQ ID NO. 82832
  misc_feature (906)..(906): n is a, c, t, g, unknown, or other
ctccccgcggtggcggccgctctagaactagtggatcccccgggctgcaggaattcgtctcacccctagaaaaaatcaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacaggggcgccggcgaggccgtctccggccgcggatacaaggagtaccgcctcggggactactccaactggctgcagaagcgcgtcgagaacaccaggaactgggaccggatcaggagctgcctccaggactccaaggtctgcaagagcctgcaggacaagaacgagaccgtcgcccagttcatgagttccagcctctcccccatcgagtctggctgctgcaagccccccaccagctgcggctacacctacgtcggcggcacgaactggacgccggtgaccacaactcgacggaccggaactgcagactggagcacgacgcctcgcgctctgctacaatgcagtcttgcagggccgcgtggtggcacgttcaacgaactggaacgcgtcgcgtcgtcgcatcgnctcctcggctaataa

SEQ ID NO: 82832 - protein, 237 aa, Zea mays
  misc_feature: Ceres CLONE 1568721
  misc_feature (5)..(212): Pfam Name: Tetraspannin Pfam Description: Tetraspanin family
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRGAGEAVSGRGYKEYRLGDYSNWLQKRVENTRNWDRIRSCLQDSKVCKSLQDKNETVAQFMSSSLSPIESGCCKPPTSCGYTYVGGTNWTPVTTTRRTGTADWSTTPRALLQCSLAGPRGGTFNELERVASSHRLLG

SEQ ID NO: 82833 - DNA, 821 bp, Zea mays
  misc_feature: Ceres CLONE 1568722
  misc_feature: Encodes the peptide sequence at SEQ ID NO. 82834
  misc_feature (568)..(568): n is a, c, t, g, unknown, or other
ctccccgcggtggcggccgctctagaactagtggatcccccgggctgcaggaattcgtctcacccctagaaaaaattcctcccgagtcgcctccccctcaagttccacaaacgcaagccccaatctcgccgtcaccacctcaatccagcaaacgcaaaccccatctcgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacaccgcccgcctccacgcccaacgctacgcgctctcctaccaggaacccatccccgtcgagcagctcgtccagtccctctgcgacaccaagcaggggtacacccagttcggaggccctcgcccccntcggggtctccttcctattcgctgggtggggacaagcaccacgggtttcaaggtctaaatgagcgaacccatcggggaacctccggcggggtgggaagggccccctcttttggggggcaaaaaacaaggggccgcggaaatcccggtgcttaaggggggttctaaaggggggggtttggcccccggggagggaggccgccccccccccggcccctttaggggcccctccaaaaaaaacaggtgggcccccccc

SEQ ID NO: 82834 - protein, 148 aa, Zea mays
  misc_feature: Ceres CLONE 1568722
  misc_feature (28)..(148): Pfam Name: Proteasome Pfam Description: Proteasome A-type and B-type
  misc_feature: SWISSPROT Homolog: EC 3.4.25.1 Proteasome endopeptidase complex
  misc_feature (130)..(130): Xaa is any aa, unknown, or other
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGPRPXRGLLPIRWVGTSTTGFKV

SEQ ID NO: 82835 - DNA, 1022 bp, Zea mays
  misc_feature: Ceres CLONE 1568723
  misc_feature (147)..(147): n is a, c, t, g, unknown, or other
  misc_feature (192)..(192): n is a, c, t, g, unknown, or other
  misc_feature (195)..(195): n is a, c, t, g, unknown, or other
  misc_feature (474)..(474): n is a, c, t, g, unknown, or other
  misc_feature (475)..(475): n is a, c, t, g, unknown, or other
  misc_feature (479)..(479): n is a, c, t, g, unknown, or other
  misc_feature (555)..(555): n is a, c, t, g, unknown, or other
  misc_feature (556)..(556): n is a, c, t, g, unknown, or other
  misc_feature (610)..(610): n is a, c, t, g, unknown, or other
  misc_feature (637)..(637): n is a, c, t, g, unknown, or other
  misc_feature (638)..(638): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (807)..(807): n is a, c, t, g, unknown, or other
  misc_feature (822)..(822): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (931)..(931): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (965)..(965): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (973)..(973): n is a, c, t, g, unknown, or other
  misc_feature (984)..(984): n is a, c, t, g, unknown, or other
  misc_feature (991)..(991): n is a, c, t, g, unknown, or other
  misc_feature (993)..(993): n is a, c, t, g, unknown, or other
  misc_feature (994)..(994): n is a, c, t, g, unknown, or other
  misc_feature (1003)..(1003): n is a, c, t, g, unknown, or other
ggagctccccgcggtggcggccgctctagaactagtggatcccccgggctgcaggaattcgtctcacccctagaaaaaggagctctaccaccgtccaccatcaccgcctcgtgtgcagcgtgctcgctcacctcctctgtcgacgcnacaccccgaaagccccccgccgcgctcgcagggtgttcgaccttncgnccgggcgccctcaggaaatgggcctcctccgtttcccccgcccccaaggccccccggggttctcccccaaaagcccaaaaaggattgggccccccggggaaacccccccgggggttttccccccgaaaaaaacgtggaagggggggggccttttttttcccccgcgcccccctgttttccccggggggggaaaaaacgccccccccccccccgaaaaaaatttggggggggggggaaaaaaacccctttttttttcaccgaaaaaaaaaaaggggtttnnaaanattttttttaaaaaaaaaagatagggggggggggcgccccgctaaatcctcaaaaaaaaaaggggggggggggggnngtgtgtttaaaaaaaaaaaaaacccttttttcaccccccccacttttttttttncgacgaagcaccgacccccccccccanntttttcttttttggtggtgggggggggggggggaaagagaaaaaatatttttttttttctctcccccccccccctttttgtgataaaaaaaagaagaaaaaaaaactccaccccctcttccttaaaaaaaaaaaaaaaaaaaaagatggagtttttgnnnnnnncccgnaaaagaaaaatctcnttttttttgtttttttaataaaaaaaaaaaaaaaaaaaaaggaagggggggggggaggnnnnccccccccccccccccccccccccnnnnnnnnnnnaaaggagagganaaagaggaatggtgttgttttatattttnnnnangcnnnngnccccccgacgnccccccncnntgaaacaanaaaaaaaaaaaagaggaga

SEQ ID NO: 82836 - DNA, 926 bp, Zea mays
  misc_feature: Ceres CLONE 1568724
  misc_feature: Encodes the peptide sequence at SEQ ID NO. 82837
  misc_feature (788)..(788): n is a, c, t, g, unknown, or other
ctccccgcggtggcggccgctctagaactagtggatcccccgggctgcaggaattcgtctcacccctagaaaaaacagcacatcccattcccctcgtctcatctcaagagcgactagagagagagaggaagagaacaagcgataagctcatctcgcacgcaagatgcgggctccaaggggcgcaggcggctgccgcggcggccaggagcatgtggaactgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctcatgcagttcgggaacccgtccggcgacgacgggcccaaggacggcgacgacgggcccggcagcaccccggcgtacggcgtggcggtgtacaacgtgacgacgggcgagtggcggcgggagcgcggcgcgccccccgtggtgccggtgttcgcgcagtgcgcggcggtggggacccgcgtggccgtgctgggcggctgggacccgcgcagcttcgagcccgtggcggacgtgcacgtgctggacgccgccacggggcggtgggcgcgcgccgcgcccatgcggtcggcgcgctccttcttcgcctgggccgaagccggcggcaaaatctactgtggggggcggcccgacaagcacaggacccgctcagaacggcggaggcgtacgacgcccgggcccaacnctggggacccgctgccccacatgtcggaggaagcccgacaaatggctacggcttggccaccggtctccggggaacggttttctgggcggtcaggggttacccaacggggggccccaggggtggttccaaagcccaacc

SEQ ID NO: 82837 - protein, 254 aa, Zea mays
  misc_feature: Ceres CLONE 1568724
  misc_feature (18)..(65): Pfam Name: F-box Pfam Description: F-box domain
  misc_feature (209)..(209): Xaa is any aa, unknown, or other
MRAPRGAGGCRGGQEHVELIPGIPDDVAVDCLARVPHASHRAMRRVCRGWRSAAAAPAFASARAAAGANEDLVYLMQFGNPSGDDGPKDGDDGPGSTPAYGVAVYNVTTGEWRRERGAPPVVPVFAQCAAVGTRVAVLGGWDPRSFEPVADVHVLDAATGRWARAAPMRSARSFFAWAEAGGKIYCGGRPDKHRTRSERRRRTTPGPNXGDPLPHMSEEARQMATAWPPVSGERFSGRSGVTQRGAPGVVPKPN

SEQ ID NO: 82838 - DNA, 958 bp, Zea mays
  misc_feature: Ceres CLONE 1568726
  misc_feature: Encodes the peptide sequence at SEQ ID NO. 82839
  misc_feature (709)..(709): n is a, c, t, g, unknown, or other
  misc_feature (724)..(724): n is a, c, t, g, unknown, or other
  misc_feature (877)..(877): n is a, c, t, g, unknown, or other
ctccccgcggtggcggccgctctagaactagtggatcccccgggctgcaggaattcgtctcacccctagaaaaaacccagcggcttcccccaaacaaaacctcttctccgccagagtccgcgtcggccagatcaaacgaatcggcacgacgcatcggcatcgcctccgacgatcttgagacaaacaaaacccaccgctgcggcaactccgcctcccgctgacacggggatcgcctgacaacaggcagagaaaagaggcgcagggtttgcccgcgaagatggaggacgtggacgtctcgcggcagctgaagcagatgacgaacttcatccgccaggaggccgtcgagaaggccgccgagatcgaggccgccgccgccgaggagttccaaatagaaaagttgcagctggtggaagctgaaaagaagaagatcaggcaggaatatgaccggaaagagaagcaagttggcatcaagaagaaaattgattactcgatgcagctcaatgcttccagaattaaagtccttcaagctcaggatgatttggtaacagatatgttggagtcagcaaggaaagagctactgtgcataagtagagatcaccccacttacaagaagctcctcaagacacttattgttcagagtttgctgcgcctgaaagatccagctgtgcttctccgctgcagggaagagggatctcaacttgttgatttnagtttggaatctgcnaggaatgagtatgcagataaagcaaatgtatatctcctgagatagtggtagatcgtcaaatctatctggcatctgctcccagtcattatcaggcacctggcccctcatgcccccggtggagttgtggctagctcccgagaatggaaagatggnctgggaaaaccactggatgctagatggcaaggagtttcagaatgagctgccagaaatcgtcagagccttttcggaatgtag

SEQ ID NO: 82839 - protein, 163 aa, Zea mays
  misc_feature: Ceres CLONE 1568726
  misc_feature (16)..(163): Pfam Name: vATP-synt_E Pfam Description: ATP synthase (E/31 kDa) subunit
  misc_feature: SWISSPROT Homolog: EC 3.6.3.14 H(+)-transporting two-sector ATPase
  misc_feature (144)..(144): Xaa is any aa, unknown, or other
MEDVDVSRQLKQMTNFIRQEAVEKAAEIEAAAAEEFQIEKLQLVEAEKKKIRQEYDRKEKQVGIKKKIDYSMQLNASRIKVLQAQDDLVTDMLESARKELLCISRDHPTYKKLLKTLIVQSLLRLKDPAVLLRCREEGSQLVDXSLESARNEYADKANVYLLR

SEQ ID NO: 82840 - DNA, 916 bp, Zea mays
  misc_feature: Ceres CLONE 1568728
  misc_feature: Translation starting site: 84
  misc_feature: Pfam Name: AAA_5 Pfam Description: ATPase family associated with various cellular activities (AAA)
  misc_feature: SWISSPROT Homolog: EC 6.6.1.1 Magnesium chelatase
ctccccgcggtggcggccgctctagaactagtggatcccccgggctgcaggaattcgtctcacccctagaaaaactccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggaggcgacggcgtcggccgcgaaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgacccccgagtcatgggccccgaggtccgccagcgggtcctgcagggggacaccggcctccccgtcaccacgccaagatcaccatggtcgacctgccccctcgcgccaccgaagaccgcgtctgcggcaccattgacatcgagtaggcgctcaccgagggcgtcaaggcgttcgagcccgggctgctcgccaagcccacaggggcatactgtacgtcgacgaagtcaacctgctggacgacacctcgtcgacgtgctgctggattccgctgcgtcggggtggaacacgtggaaaagggagggtatctcatatcccacctggtcgcttcatctcatcggctctggtaacccggaggaagggagctcaggcccacctgctggacgggtcggattcacccccagttggtacctcag

SEQ ID NO: 82841 - DNA, 1190 bp, Zea mays
  misc_feature: Ceres CLONE 1568730
  misc_feature: Encodes the peptide sequence at SEQ ID NO. 82842
  misc_feature (53)..(53): n is a, c, t, g, unknown, or other
  misc_feature (56)..(56): n is a, c, t, g, unknown, or other
  misc_feature (67)..(67): n is a, c, t, g, unknown, or other
ttgttcgcatgtggtgcacttgatgcggaccttgcctttttttttggccctanaanccccggggggntgatagggggaattcccgcggtggcggccgctctagaactagtggatcccccgggctgcaggaattcgtctcacccctagaaaaagcgaaacagaagcacggcaatctcgatctcgttcgttcccctgagcggcagtcagtgcgagcgagcgcgcacacagacaactcatcctctcccctctctctctcacacacacacatccatcatcccatccctgtgacgggcgatccgagggcctaccgacgatggtgtccgccgtgctccggaccatcctcgtgacgggcggcgccgggtacatcggcagccacacggtgctgcagctgctgcagcagggcttccgcgtcgtcgtcgtcgacaacctcgacaacgcctccgaggccgccctcgcccgcgtcgccgagctcgccgggcacgacggcgccaacctcgtcttccacaaggttgaccttcgcgacaggcacgcgttgggtgaacatcttctcgtcgcacagggttcgaggctggcattcacttttgctggggctcaaggttgttgggggagagcgtgcacaaagccccctgctttactaccgaaaaacaaccctgggtcggggaccaatcaacccctcccttgtaaggatgatatggcctgccaaattgggcctgccaagaaaagactggggtgtttccccgccccatcctgcaaaattggtcctattggggcgggggccccccagtgaatagttaccctttggcccccaccgaatagaatatttccgcggtgtttctggggggtccaaaccaaattccccccttagggggggggggaaaaataaagcctcttggtgaaatgtgaaaagaaatttttgtgcgcgggggaaagtgtccacaccgcgttctcgaacacggggaaatgtggaaagaatattattttgtggctacagggagacactttaaaccccccgggtggggagggttattatcaaaagggggagtgaatctcggggaaataaaacccccgcggcgtggtgcctcataataaaaagcgggaaggccccctatagtggcacaataaactcctctattggttgaaaaggatttaccccacttctcgaggagtttagtgggggggggggcatacgt

SEQ ID NO: 82842 - protein, 157 aa, Zea mays
  misc_feature: Ceres CLONE 1568730
  misc_feature: SWISSPROT Homolog: EC 5.1.3.2 UDP-glucose 4-epimerase
MVSAVLRTILVTGGAGYIGSHTVLQLLQQGFRVVVVDNLDNASEAALARVAELAGHDGANLVFHKVDLRDRHALGEHLLVAQGSRLAFTFAGAQGCWGRACTKPPALLPKNNPGSGTNQPLPCKDDMACQIGPAKKRLGCFPAPSCKIGPIGAGAPQ

SEQ ID NO: 82843 - DNA, 932 bp, Zea mays
  misc_feature: Ceres CLONE 1568731
  misc_feature: Encodes the peptide sequence at SEQ ID NO. 82844
  misc_feature (663)..(663): n is a, c, t, g, unknown, or other
ctggagctcaccgcggtggcggccgctctagaactagtggatcccccgggctgcaggaattcgtctcacccctagaaaaaccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgtcccgggtggcgccggcggcggggaggagctctcggtggaggagcgcaacctgctgtccgtcgcctacaagaacgtcatcggcgcccgcatggcctcgtggcggatcatctcctccatcgagcagaaggaggaaggccgcgggaacgaggcgcacgccgcatccatccgcgcctaccgctccaagatcgtagccgagctcgcccgcatctgcgacggcatcctcgcgctcctcgactccccactcgtcccatccgccggcggcgccgagtccaaagtcttctacctcaagatgaagggtgactaccacaggtacccttgctgagttccagtcaagtgcaaaaaagaaggatgctgncgataacaccatgaatgcctacaaagctggtcagggatatgcccttggtgattcgggctcaacccaccccctcaggttcgggctgctccccaattccagtggtctactaccaaaacctcaatccctgaacggtgcttgcacttggaaggaggcctttgatgaagcattccccagctaaaaagccgggaaaagagccctacaagacagactctgatctgcagctccggctggacacttggacttatgacctcgacaccacaaggaagggt

SEQ ID NO: 82844 - protein, 144 aa, Zea mays
  misc_feature: Ceres CLONE 1568731
  misc_feature (8)..(145): Pfam Name: 14-3-3 Pfam Description: 14-3-3 protein
MSPSEPTREESVYMAKLAEQAERYEEMVEFMERVARYVPGGAGGGEELSVEERNLLSVAYKNVIGARMASWRIISSIEQKEEGRGNEAHAASIRAYRSKIVAELARICDGILALLDSPLVPSAGGAESKVFYLKMKGDYHRYPC

SEQ ID NO: 82845 - DNA, 932 bp, Zea mays
  misc_feature: Ceres CLONE 1568732
  misc_feature: Encodes the peptide sequence at SEQ ID NO. 82846
  misc_feature (548)..(548): n is a, c, t, g, unknown, or other
ctccccgcggtggcggccgctctagaactagtggatcccccgggctgcaggaattcgtctcacccctagaaaactagtaacatttgcatattttggtgaaggtaacatcgtggttcttgatcccacatacaaggaagaagcagtaatgggagggaggatgactgctatagttaactcaaatggggatgtttgtgccattcagaaagctggtggagagggtgtcatgtcaagtgttatcatgcagtgtttaagaattgcttcggtaaaggctgctgatataacaagcaaaataaagaaagcagtagactcatacaccaccgagaaagccctaaagaaagtaaaacgtttgccaacctcggttcctcagaaaattaatgtcactaatgtaactatggacggcaaaggtgatggtgaattggaaaacaatctatgcagatgcatagtgatgttcagcagataagcaaagatccaccaactatggtcaatgccagcagccgtgatgatgcccaacaaatgactgaatcatctaatgctgaagtgaacacatncagtgctgtggctgctggagagtctgagtcccatgaaatttgatcgccaaagagtctaaagatgctttcaacccaaacctaaaagaaagaaaaagaaagtggacggatttagtttagtggcaagcctgtaattttgttgccccaaataatcaaggacagtcttcaacacccaaacccctgattgataaggttcatccgggggccaaacaggggttttttgggtttccaatgggaagggggcaaaatgaacggaaatttttcaaagccttaaattgtcttttagaaaggcactttaacctcccaaaactttgacatatttttggaaggggatttccccacccccccatttttgtgtcgcccccggttttcttctcttttgaaaag

SEQ ID NO: 82846 - protein, 104 aa, Zea mays
  misc_feature: Ceres CLONE 1568732
MGGRMTAIVNSNGDVCAIQKAGGEGVMSSVIMQCLRIASVKAADITSKIKKAVDSYTTEKALKKVKRLPTSVPQKINVTNVTMDGKGDGELENNLCRCIVMFSR

SEQ ID NO: 82847 - DNA, 925 bp, Zea mays
  misc_feature: Ceres CLONE 1568734
  misc_feature: Encodes the peptide sequence at SEQ ID NO. 82848
  misc_feature (774)..(774): n is a, c, t, g, unknown, or other
ctccccgcggtggcggccgctctagaactagtggatcccccgggctgcaggaattcgtctcacccctagaaaaaactcccgcaggccgcagcccagcaccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatgtcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcatgctctcagacgttatgaatctggggaagagcgctgcattgcttgtaaactatgcgaagctatatgcccagcgcaggcaattacaattgaggctgaagaacgtgaagatggcagtcgccgaaccacaagatatgatattgacatgacccaatgcatttactgtgggttctgtcaagaggcttgcccagtcgatgctattggtgagggggcctactttgagtttgcactgagacacacgagaactactgtnacgacaggagaaatgctggaaaatgtgatcgcgggagactgagatgctggagactgagatctgaaagctctatcgctgatctgtcctccatatgggtgataaacgggttcttcattttccaaattttgcccacagctgagaatagcaacat

SEQ ID NO: 82848 - protein, 208 aa, Zea mays
  misc_feature: Ceres CLONE 1568734
  misc_feature (156)..(179): Pfam Name: Fer4 Pfam Description: 4Fe-4S binding domain
  misc_feature (117)..(140): Pfam Name: Fer4 Pfam Description: 4Fe-4S binding domain
  misc_feature: SWISSPROT Homolog: EC 1.6.5.3 NADH dehydrogenase (ubiquinone)
MASLLARQAAQALRARQTAQLGPAASAMQGHLRTYMNAGIPKRFKEDEEKEQLAKDVAKDWNAVFERSINTLFLTEMVRGLMLTLKYFFDRNVTINYPFEKGPLSPRFRGEHALRRYESGEERCIACKLCEAICPAQAITIEAEEREDGSRRTTRYDIDMTQCIYCGFCQEACPVDAIGEGAYFEFALRHTRTTVTTGEMLENVIAGD

SEQ ID NO: 82849 - DNA, 1294 bp, Zea mays
  misc_feature: Ceres CLONE 1568737
  misc_feature: Encodes the peptide sequence at SEQ ID NO. 82850
  misc_feature (62)..(62): n is a, c, t, g, unknown, or other
gtgggtttatttttggtttctttctttcctcttagttctttctgggaggttataatattttntttctttttaactcaccgcggtggcggccgctctagaacagtggatcccccgggctgcaggaattcgtctcacccctagaaaaagaaacgcgaagcagccccacactgcccactctgacacgctctgcaccaccacctgctggccgttcccggctcgccgctgccgttgcgccctctcgctcacacctccgccagcccaggtccatcgagcggagaaacccatggccccctcgccgatcctcgtccggccgccggagctggcaaattcaccccttccgcctccccgatgcgtggccgcggtagcacgcggagcctgcggttcggacgggtccagcggacccattctctaggctccgtagccaacgtaggttcgccgcatcggatgtgagagaagactactctttcactcccatagatattgtcgctgatgttaagacggagaagattgtggagccaggaggaaagggattcctttgggttcttagaattgccagaggctgctgtattcaaaagggattgaagggttgtgactcttcaagcatggtaatggaagaacaatttttacctctggaatccccgggggttggaaccacctcaaaattgggccggccccagtaaaagggtttttctttatgccgaggaagggggatcgaaatttattgtgggtgtgggggggcttaacagggccatggtggtgtgtcctaatgcacccctcgggaaatggttgttttgtggccacatggtaaaaaagtaacataaacgcgcaataaacgcggtgttatatggggttggggcgcaaaagggccaacacagaggtagtcctcttagaggcggggtgttatcattgtgccgtgcccctatattttctaatagtggtggagtggcgccccccagaagatgttcctatttttatattaattctccacagtgcccccctgttgttgtcaaattcagcctgacgccacgcgccctgtgtctgcttgattatataacgtgacaagtttcaacctgcccaccgggcgccgttggtaatataggttcgcaactacccggaagggaccttgtgtcatatagtactcccatcctctattggagggtataaggttataaggacaacgcctcctctttccatcggggaaaaggtgaatattaagtggggctctgggggttgtgtaccaacacggtattagcaacaatgggaagagttggggcgccgcttgtgacaaaattct

SEQ ID NO: 82850 - protein, 42 aa, Zea mays
  misc_feature: Ceres CLONE 1568737
MAPSPILVRPPELANSPLPPPRCVAAVARGACGSDGSSGPIL

SEQ ID NO: 82851 - DNA, 848 bp, Zea mays
  misc_feature: Ceres CLONE 1568738
  misc_feature: Encodes the peptide sequence at SEQ ID NO. 82852
  misc_feature (424)..(424): n is a, c, t, g, unknown, or other
  misc_feature (451)..(451): n is a, c, t, g, unknown, or other
  misc_feature (558)..(558): n is a, c, t, g, unknown, or other
ctccccgcggtggcggccgctctagaactagtggatcccccgggctgcaggaattcgtctcacccctagaaaaaatccattcctccctgtctccgccctcttctgactcccgtaggccgtgggtgccgccgccgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatgggccacatncacctcggcctcatgaaccttgatctncagatgaacgaggctgcccgcatgaagctcccccttccgtggcatgccctataacatggaacagatgtacctcaagggggagcatgccaattccaatgtcattgcgntcaagatgaatgttgggggtcacaagtactccaataggtccaacggggaaagacgcaattgtgaaaaacaatgccggcaacaacaacatggggagcgccaacggcccttctgtgggctgaaaacgccttaaaaaattggcgaacaaatgaaatgctcccaaggatgaaagcccctgggggaaaaccctttggcgggaaaaaccaaccccggggggaggttcccaaaaggcacctttttggtttcccccaaaaaattcgggattatgcccaaaaaaaacctccgggttggc

SEQ ID NO: 82852 - protein, 92 aa, Zea mays
  misc_feature: Ceres CLONE 1568738
  misc_feature (66)..(66): Xaa is any aa, unknown, or other
MDSLWHLGDELRGQPKVVEDRQWSLMTSKLAEITRSKGERMNTVPDAKQWDKTSYQLHDDSRMGHXHLGLMNLDLQMNEAARMKLPLPWHAL

SEQ ID NO: 82853 - DNA, 944 bp, Zea mays
  misc_feature: Ceres CLONE 1568743
  misc_feature: Translation starting site: 160
  misc_feature (812)..(812): n is a, c, t, g, unknown, or other
  misc_feature (813)..(813): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
ctggagctccccgcggtggcggccgctctagaactagtggatcccccgggctgcaggaattcgtctcacccctagaaaaaaccggtccaccgcgcatcgaacccccacttgtgccgattctgctgatccctcgccgacaacggccggcgaatcgacaccatggccgctgcgcgccggggccgtggcgacagcgccaacggcgtcgtccgtccccgcccccgcgaccgcggcgtcggcggcgggagcatggcggggcgcgtggccgtcctcgccttctgtgtcgcagggatctggtccgcctacatctaccagggcgtcctccaggagactctatcgacgaagcggttcgggccggatgcgcggcggttcgagcacctcgcgttcctcaacttcgcgcagaacgtcatctgcttcgtctggtccttcataatgattaagctgtggtcgggcgggagtagctccaatggcagcgcaccgatatggaagtactggggcgtcagcgtcaccaataccatcgggccgaccatggggatcgaggctctcaagtacatcagctacccgggctcaggtgttggcaaaatcttctaagatgattcctgtaatgttgatgggaactcttctctatggtgtgaagtacacacttccagagtatttatgcacctttcttgttgccggcggtgtgtccctcctttgcgttgttgaagacaagctccaagacaattaagaagcttgccaacccctatgcaccctctgggtacacattgtgcttcctcacttagcttttgatgatatactaactcgaccccagattnnataagtcaggtaccaaaacaacccatgggatatatgcttgcatgaactctggggacatatatatgctgtaattatgttggtgcgcctttatagnnnnnnnnnnnnnnnnnnnnnnnnnnnnnnnnnnnnnt

SEQ ID NO: 82854 - DNA, 873 bp, Zea mays
  misc_feature: Ceres CLONE 1568745
  misc_feature: Encodes the peptide sequence at SEQ ID NO. 82855
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaagccgtctggttcaaggccggctcccagatcttcagcgagggcgggctggactacctcggcaaccccagcctgatccacgcgcagagcatcctcgccatctggggcctgcccagtcgtgctcatggggtgccgtcaagggctaccgcaattgccgggcggccggctcggccaaagtcgtcaaacccgctgtaccctggcggaagctttcgaacccctcggcctggccgacaaccccgaggcctttcccgaaccccagggtgaaggaactcagaaccgccccccccccaggttttcaatgttgggtttctcgtccaggcattgtacccggaagagcccctccaaaaaccctctgaaccattggtaacaattaaaaag

SEQ ID NO: 82855 - protein, 210 aa, Zea mays
  misc_feature: Ceres CLONE 1568745
  misc_feature (61)..(201): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWGLPSRAHGVPSRATAIAGRPARPKSSNPLYPGGSFRTPRPGRQPRGLSRTPG

SEQ ID NO: 82856 - DNA, 937 bp, Zea mays
  misc_feature: Ceres CLONE 1568746
  misc_feature: Encodes the peptide sequence at SEQ ID NO. 82857
  misc_feature (888)..(888): n is a, c, t, g, unknown, or other
ctccccgcggtggcggccgctctagaactagtggatcccccgggctgcaggaattcgtctcacccctagaaaaagcagaggcaaaagccccacgcttgagagtgagaagaaacagacgcatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctcgtcgcctatttcaccggcgagcggccgccgcctcccgccttcgaggatggaaaccacccattgtttgtgacctggaagaaggctgccaatggttcacaaccacgcctccggggatgcataggaactctggagtcccgtcagattgtcagcggctttagggactacgccctaactagtgcgctgagggaccgacgctttcccccaatacaatcaaaggaactcccaaccttggagtgcacggtatctatactcactgattatgaaattgcagaggactacctcgactgggaggttggaaagcatggtttaattattgaatttacagctccagactccaacacaaaacacagtgcgacctatttgcctgaaagtgcgggccatgaaggttggacacatgtagaaactattgattcactcgtgaggaaggcaggctaccagagaatcatcactgagtccttgaggaagaaatcaaagtcactcgctaccagagcaccctgtacacgatgcactatgggtgatatgttgcgtaccctcagaagaacagagtgcagccccgtcattagtggggctcctcctgtagttatggcnttcagcaagccatgattatcagtataaaaaagctcaagacatttcttat

SEQ ID NO: 82857 - protein, 216 aa, Zea mays
  misc_feature: Ceres CLONE 1568746
  misc_feature (4)..(175): Pfam Name: AMMECR1 Pfam Description: AMMECR1
MVVATEEMVVYCFDTLVAYFTGERPPPPAFEDGNHPLFVTWKKAANGSQPRLRGCIGTLESRQIVSGFRDYALTSALRDRRFPPIQSKELPTLECTVSILTDYEIAEDYLDWEVGKHGLIIEFTAPDSNTKHSATYLPESAGHEGWTHVETIDSLVRKAGYQRIITESLRKKSKSLATRAPCTRCTMGDMLRTLRRTECSPVISGAPPVVMAFSKP

SEQ ID NO: 82858 - DNA, 871 bp, Zea mays
  misc_feature: Ceres CLONE 1568747
  misc_feature: Encodes the peptide sequence at SEQ ID NO. 82859
  misc_feature (710)..(710): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaagacgcgtctcttccacagccgcaacctctatccctcgtctggtatcgtctctcccacacccctctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcataagctgcaccgccagtggaccttctggtacgacatccagtccaagcccaagcccggcgctgcgtggggcacctccctcaaaaaggcgtacaccttcgacaccgtcgaggagttttggggcttgtatgatcatgttttccgtccaagcaagttgcctggaactgctgattttcacctattcaaggctggagtagagccaaaatgggaagacccagagtgtgcaaatggtggtaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagcaatgaagctgtccaggtaacattggcnagaaatgggaggatgtcatcgactacaatgancagatcatctacactttccatgacgactcgagaagggatagccagcagaagtggaccgtacaccgtgtagtcgcacacaaagatgtcctttgtcgactgacagaggctgaaagtggagttttgtgctaa

SEQ ID NO: 82859 - protein, 209 aa, Zea mays
  misc_feature: Ceres CLONE 1568747
  misc_feature (6)..(194): Pfam Name: IF4E Pfam Description: Eukaryotic initiation factor 4E
  misc_feature (187)..(187): Xaa is any aa, unknown, or other
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVTLARNGRMSSTTMXRSSTLSMTTREGIASRSGPYTV

SEQ ID NO: 82860 - DNA, 868 bp, Zea mays
  misc_feature: Ceres CLONE 1568748
  misc_feature: Encodes the peptide sequence at SEQ ID NO. 82861
  misc_feature (722)..(722): n is a, c, t, g, unknown, or other
  misc_feature (728)..(728): n is a, c, t, g, unknown, or other
  misc_feature (845)..(845): n is a, c, t, g, unknown, or other
ctccccgcggtggcggccgctctagaactagtggatcccccgggctgcaggaattcgtctcacccctagaaaaaaacttaagactcgagggcaaccaaacaccagcgccaatgcaagctacacacggttctagattgataaattctaatccggcacagttcttgctcaggcaagcagtcaagcatcgcccatcggaacccatggcaactcctgttgtgtctgtcaccgacgtcagctatgtcgctgcgccggctagcgcgctgccacccgaacctgtcatcaagctcaacgccatggaggcgcagtgggtcgtggttccgctgctgcagcacctcctgctcttcgagggcgacgatctgccgcccttcgacgccatcctccggtccctcaggtcctccctcgcggcgaccctagccacccacgccccgctcgccggcaagctccactacctcgcggacaccggcgacgtcgccatctgccgctccagcggcggccgcgacgtcgacgaccgcggcgtcaggttcgtcgccgcggagtgcgacgccgacgtccgccgcctcgcgggcgacgaggaccacgacgtgctcacgttcgagcgcctcgttccggagctcgacatgaccctgctgccggcgccggtgctggcggtgcagaaaacgtctcgggggggcagcggggtcgccctcggtgtcagcgtgcaccacggcgtcgccgacgccgcncccctntggaagtttcgtcaaggcgtgggccgcggcgtgccgtgggggacacgcgccccgcgccgccggtgttcgaccgctcccgtgtcagatgccccgggcggggaagaagctgccccggancatcctgcggaagtacgccgcca

SEQ ID NO: 82861 - protein, 222 aa, Zea mays
  misc_feature: Ceres CLONE 1568748
  misc_feature (215)..(215): Xaa is any aa, unknown, or other
MATPVVSVTDVSYVAAPASALPPEPVIKLNAMEAQWVVVPLLQHLLLFEGDDLPPFDAILRSLRSSLAATLATHAPLAGKLHYLADTGDVAICRSSGGRDVDDRGVRFVAAECDADVRRLAGDEDHDVLTFERLVPELDMTLLPAPVLAVQKTSRGGSGVALGVSVHHGVADAAPLWKFRQGVGRGVPWGTRAPRRRCSTAPVSDAPGGEEAAPXHPAEVRR

SEQ ID NO: 82862 - DNA, 1006 bp, Zea mays
  misc_feature: Ceres CLONE 1568749
  misc_feature: Encodes the peptide sequence at SEQ ID NO. 82863
  misc_feature (72)..(72): n is a, c, t, g, unknown, or other
  misc_feature (468)..(468): n is a, c, t, g, unknown, or other
  misc_feature (469)..(469): n is a, c, t, g, unknown, or other
  misc_feature (513)..(513): n is a, c, t, g, unknown, or other
  misc_feature (558)..(558): n is a, c, t, g, unknown, or other
ctccccgcgggtggcggccgctctagaactagtggatcccccggggctgcaggaattctgtctcacccctgngaaaaaaaaaaaaaaaaaaaaaaaaaaaaaaaaaaaaaaaaaaaaaaggactccagagtccaaccgcacacggcacagacccgtttcgcctcttcgaccgcgactccctccgaccgagctgcagtgcgcgtgctgcctgccttccactgttcctgcttccagacatggcggcgaggccggtcgctctggctctgccgctgctggccctcgtctgcgccctggcagcgtcggccgacgcgacgcagttcagggtgggcgggcagagtgggtggagcgtgccgggcgccggctccgagccctacaacacctgggcggggcgactccggttccagatcggcgaccagctgctgttcgtgtaccccatggagacggactccgtgctcctggtggacgccnngcgctactacgcctgcaacacctcgtcctacgtctccaggttcnaacgacgggagcacgggggtcacgtccgaccgctcggggggcttncttcttcgttagggggaaagaaggcaggcttgcgtggcaaacaaaaaagttattggtggtggttcctccccgaaacggtccgggggagccgcaccccggaaccaatttttccgggcgctttggggaaacccgcccctccccctgtggtggtggccccccgaccgtggaaaaaaaggcattcctgttggcccacccttgtgcgttggggcccggaggccaccccaccttgggaaaaatccccctttttttttttggggggccggcccccccaaaaacccttttttgtccccggggggcgggttccaaaaaaaactctttttgcccggggggcgctcttaaaaaaaccccggggggggggggcccccccccaaattttttttttaaggggcgggggggttgggggggggccccctacaccccccccttttgtgtggggcccgcgtggggg

SEQ ID NO: 82863 - protein, 256 aa, Zea mays
  misc_feature: Ceres CLONE 1568749
  misc_feature (36)..(118): Pfam Name: Cu_bind_like Pfam Description: Plastocyanin-like domain
  misc_feature (78)..(78): Xaa is any aa, unknown, or other
  misc_feature (93)..(93): Xaa is any aa, unknown, or other
  misc_feature (108)..(108): Xaa is any aa, unknown, or other
MAARPVALALPLLALVCALAASADATQFRVGGQSGWSVPGAGSEPYNTWAGRLRFQIGDQLLFVYPMETDSVLLVDAXRYYACNTSSYVSRFXRREHGGHVRPLGGLXSSLGGKKAGLRGKQKSYWWWFLPETVRGSRTPEPIFPGALGKPAPPPVVVAPRPWKKRHSCWPTLVRWGPEATPPWEKSPFFFLGGRPPQKPFFVPGGRVPKKTLFARGALLKKPRGGGAPPQIFFLRGGGVGGGPPTPPPFVWGPRG

SEQ ID NO: 82864 - DNA, 871 bp, Zea mays
  misc_feature: Ceres CLONE 1568750
  misc_feature: Encodes the peptide sequence at SEQ ID NO. 82865
  misc_feature (487)..(487): n is a, c, t, g, unknown, or other
ctcacccgcggtggcggccgctctagaactagtggatcccccgggctgcaggaattcgtctcacccctagaaaaaagagagaaaggaagagaagggggcggagaagcacgtacgtcgtacatcgcccaccgccctttgcctcgcctcgcctcgcctcgcctgcatatctaacagccggagccggagccggagccggagccgacgccggcgccgacaatcgttccaactgatatggctacgacgccaccaggattcacgggcaacctgaagaaagcacttgcaggtctgagaagaatcagtttagatgggttgcgatggcgcgtatttgatgctaagggtcaggtgctcgggcgattggcttcccaaatagctgttgtgcttcaaggcaaggataaaccgacctatgcaccacatgtagaaaatggagacatgtgcattgtacttaatgcaaaggatatcagtggtacagggagggaaatgacagatnagatttactattggcatacagggtatgttgggccatttgaaggaagggagctcaaggaccagatggagaaagaccccactgaagtgattcgcaaagctgtgttgcgcattgctccccgaacaaactgcgtgatgattgggatcccaagctggagatttttcctgaaacaacatccattcatgaaccgccttgggaacctttgggatgccgccccgggcagtaccccgaatgcccccccctggcaggggtggcatgggaaagggcccaaaaaaaacccggggaacaagcccaaaggggggaaatacctataatgcccccccggagggccccgccaagcccccgaagggaattcgccgcccgcacattttttgctggggaaattta

SEQ ID NO: 82865 - protein, 188 aa, Zea mays
  misc_feature: Ceres CLONE 1568750
  misc_feature (29)..(149): Pfam Name: Ribosomal_L13 Pfam Description: Ribosomal protein L13
  misc_feature (86)..(86): Xaa is any aa, unknown, or other
MATTPPGFTGNLKKALAGLRRISLDGLRWRVFDAKGQVLGRLASQIAVVLQGKDKPTYAPHVENGDMCIVLNAKDISGTGREMTDXIYYWHTGYVGPFEGRELKDQMEKDPTEVIRKAVLRIAPRTNCVMIGIPSWRFFLKQHPFMNRLGNLWDAAPGSTPNAPPWQGWHGKGPKKNPGNKPKGGKYL

SEQ ID NO: 82866 - DNA, 978 bp, Zea mays
  misc_feature: Ceres CLONE 1568752
  misc_feature: Translation starting site: 140
  misc_feature: SWISSPROT Homolog: EC 2.5.1.18 Glutathione transferase
  misc_feature (760)..(760): n is a, c, t, g, unknown, or other
  misc_feature (978)..(978): n is a, c, t, g, unknown, or other
gctctagaactagtggatcccccgggctgcaggaattcgtctcacccctagaaaaactcttcttcccgcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaatggcccaaccctctttttgggtcttcccgtattgaacaagcccacgttgagcaatggatggattttgccgcaacagaagttgatcctggtgttgcatggtacttgtatccaaggctggggtacctcccttatgttagcacaactgaggaaacaggtatttcttcattgaagaggtcgcttgggtgctctgaacacacaccttgcttcaaaaacatacctttgttgggacatgctgtttactcaaggttgacattggtgaaggacatgccaaccttcctcccatgggaattgcaacggaatctttgaacaaacacccttcacgtttggaatttcccctcatgggcgagaaggtttttcttggaacatgggtttaaccgccttaaattcntaaaaggtccatttggggaagtccaaacaaggcagaattctgccccctcctattccgaaaaaagggtgcccccttctaaggaagccaaaggcaatggatgttaaggaaaggagggtccaaagggaggccccccagcccaaggtgggttgaaggccccggcccaagaaggagcccccaaaggcccaagccaagaaatccctcttgaattggctcgcaan

SEQ ID NO: 82867 - DNA, 912 bp, Zea mays
  misc_feature: Ceres CLONE 1568753
  misc_feature: Encodes the peptide sequence at SEQ ID NO. 82868
  misc_feature (503)..(503): n is a, c, t, g, unknown, or other
  misc_feature (542)..(542): n is a, c, t, g, unknown, or other
  misc_feature (551)..(551): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
ctccccgcggtggcggccgctctagaactagtggatcccccgggctgcaggaattcgtctcacccctagaaaaaggtaatccgacggaaacgacaagggcgcggcgagggcggggacagggtcggggaggccctgggcgcgggggcgccaagcgcatggcatcgtcgagggtgatgccgtcgtcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgaggtcgccggccccggcgccggaggtcgccacgcggaggacggcggacgaggtgtggaaggagatcaccggcggaggtggcagtggggaacccgtgccccccgtggcggctcaggctgccgtccccgctggtggtgggtgcgcccgcggcccngagatgacgctggagactttcctggccagggaggagggncgcgtgaangagatggggtttaagggtttcgggcccctctgcgccgggcatgggggttcctgggcggaacggagggcgtgggtgtgctgnnnnnnnncggagccggaaggggaaagaaaccggccacctctggaatccagtggatcgccgcccccattcagcgaccgaaaacggatgatcaaaaaccgccaagtttgcttccccggtccccggaaaaggaaacagggcttaattccgcccaacttaaatccgttggaaacccaccctccaaggaggaaaatgccaaattttttgaaaaaaacagaaaaaacgggccccaaaagcgggtttaaaaactctctggaaagggggtgaggcccggtctttcttc

SEQ ID NO: 82868 - protein, 246 aa, Zea mays
  misc_feature: Ceres CLONE 1568753
  misc_feature (132)..(132): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (162)..(162): Xaa is any aa, unknown, or other
MASSRVMPSSSPSHTASDLARLAQAASRPGGGGSGLGSMNVEELLRGIYSDMPTPAPPASEPERPRSPAPAPEVATRRTADEVWKEITGGGGSGEPVPPVAAQAAVPAGGGCARGPEMTLETFLAREEGRVXEMGFKGFGPLCAGHGGSWAERRAWVCXXXXEPEGERNRPPLESSGSPPPFSDRKRMIKNRQVCFPGPRKRKQGLIPPNLNPLETHPPRRKMPNFLKKTEKTGPKSGFKNSLERG

SEQ ID NO: 82869 - DNA, 1021 bp, Zea mays
  misc_feature: Ceres CLONE 1568755
  misc_feature: Translation starting site: 135
  misc_feature (1021)..(1021): n is a, c, t, g, unknown, or other
tcggtggcggccgctctagaactagtggatcccccgggctgcaggaattcgtctcacccctagaaaaagaacacgaccttaggggttcagatcggatcggaagcttccataagtttccatcgggcgtcgccggtatggcgatccgcaaggggtcttcgtacgccgtcgcggcacttctcgcgctcgcctctgtcgccgccgtcgcaggggaggtcttcttccaggagaagttcgaagatggctgggaaagtaggtgggtcaagtctgagtggaagaaggatgagaacatggctggtgaatggaaccacacctcgggaaaatggaatggagatgccgaggacaaaggtattcaaacctccgaggattacaggttctatgccatttcagccgaataccctgagttcagcaacaaagataagaccctgggggctgcagttctctgtgaagcacgaacagaagcttgactgcgggggggggctacgtcaaattgctgggtggtggatgtaaaacaaaaaaaaatttgggggaaaacaaaccttacagcctttaggtttggaacagaattccgtggggagcagccaccaaaaaaaggttcccctttcccgaacccaaggggggcaaagaaccatttggatttaaaaaggaatgggcccttggggaaaactgatcagttggagaccccaagttttaaccctgtaataaatccggcccagaggggaaaaaacaggctttttccttggttaacggaagaaaagaccattgggggggcgactagaaaaattgtgggtatgtccccccccccctaaaaataaggcgccccaagagtgtaaaaatcccagggagccggggtgaaaagagggatctccctctccccccgtagaaaaaaatcagagggctcttgtaaaaaatccccggaaagacctcaccgtccgtgttgaaaccatcgttaggggtcaaataagaaaaagtagatggcgcccccaaacctaccactaattaaagtgggcgtagaaataaaaan

SEQ ID NO: 82870 - DNA, 907 bp, Zea mays
  misc_feature: Ceres CLONE 1568756
  misc_feature: Encodes the peptide sequence at SEQ ID NO. 82871
  misc_feature (735)..(735): n is a, c, t, g, unknown, or other
acccgcggtggcggccgctctagaactagtggatcccccgggctgcaggaattcgtctcacccctagaaaaactcttttcatttcccatctctctctgcgccgtcccgtgctccctccgctagttctcccaattccttccccacctcctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctgaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattattgttgtgtatgatgtaactgaccaggagagctttaacaatgtcaagcagtggctgaatgaaattgataggtatgccagtgaaaatgtgaacaagcttttggtgggggacaagtgtgacctggctgagaacagagtagtttctaccaggctggcagggccttgctgatgacatcggaataccatcccttgagactagtgcaaggattgcacaatgtggagaaggcatccttgacatggcaggggaganaaagacaggatggctagtcacccagctgcaagtggtgctagaggcctgcaactgggcaatgccggtccgcctgttttcaacaaaagaacggctgccctgatcctcggtcaaatccaagagggggatgtgcacaagcaaacctaaattggtgcgccgggaacttagcccttat

SEQ ID NO: 82871 - protein, 139 aa, Zea mays
  misc_feature: Ceres CLONE 1568756
  misc_feature (10)..(139): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGDKCDLAENRVVSTRLAGPC

SEQ ID NO: 82872 - DNA, 898 bp, Zea mays
  misc_feature: Ceres CLONE 1568757
  misc_feature: Translation starting site: 212
  misc_feature (390)..(390): n is a, c, t, g, unknown, or other
  misc_feature (413)..(413): n is a, c, t, g, unknown, or other
  misc_feature (463)..(463): n is a, c, t, g, unknown, or other
ctccccgcggtggcggccgctctagaactagtggatcccccgggctgcaggaattcgtctcacccctagaaaaagaaacgcgaagcagccccacactgcccacgcggacacgctctgcaccaccacctgccggccgttcccggctcgccgctgccgttgcgccctcgcgctcacacctccgccagcccaggtccatcgagcggagaaacccatggccccctcgccgatcctcgtccggccgccggcgctggcgaattcaccccttccgcctccccgatgcgtggccgcggtagcagcggcgccggcggttcggacggctccagcggccccattctctaggctccgtaccaagtgtaggttcgccgcatcggatgtgagagaagactactnctcccactccgatagatattgtncgctgatggtaagacggagaagattgtggtgttaggaggaagtggattcnttgggtctgcgatttgcagagctgctgtatccaaagcatttgaggtgtgagctccacaggtcaagaaaacatcctaccctgatcccggggttgatcaagccaattggcggccggaaatgtttcccttgcaaaatggaagaaattttgggtgggggcaccgctgtgtgggccaccctgggaggggttgggcttgaaaaacaatggaaagggatatggggggggcaatgccctacccgtaatggcccgaaaaaaaaaggggcgccaaaattttttttttatcccccccggggaaaaaacctcccactctttttttttaaaggggggtttttcccggggaaagaaagagaaaaattttgttcttttcaaaaaaccaccccccggggggggtttttggcgccgcttccttttttctaaaaaaaaaaaaatatgctctcc

SEQ ID NO: 82873 - DNA, 1034 bp, Zea mays
  misc_feature: Ceres CLONE 1568758
  misc_feature: Translation starting site: 122
  misc_feature: SWISSPROT Homolog: EC 4.4.1.5 Lactoylglutathione lyase
  misc_feature (389)..(389): n is a, c, t, g, unknown, or other
  misc_feature (437)..(437): n is a, c, t, g, unknown, or other
ctccccgcggtggcggccgctctagaactagtggatcccccgggctgcaggaattcgtctcacccctagaaaaaacgagaaaggggcgccaagcaaaccgggtcggccagcagacaccgccatgaggactctactacctgtggccgccggccgcgggaccgtcgcctgcgcggccacgcccgtcccccggaggtcgctgctcctctccaccgctgccgcaagtgcggcgctgcagccggagcaggtggctgggacgaggccgttgaggctgaccaggagcgtggcgagcgccgtggcaaagcccaggacctcggccgacgaggccatctcgtgggcgaagatggacaccgcggctccctcacgtcgtctacggggtcggcgacctcgancagacgatcaagttctacaccgagtgccctggggatgaagctgctcangaagaggggacattcccagaggagaagtaccgcaacgcgtttcctccgggtacgggcccggagaaatcgcattttccgtccgtcgagctcactttacatttacggggttggaaaaatatgacataggggcgaaagggttcggccctttttgggcatcccatttcagaggaatgtgggccaaaaacgtagagacctccttaaaaaccaaaaggtgtgcggggaagaggcctcaagggggaggcccgggcccctttcaaaggggggggaaaaaccccttttttccccttgcgggggagggcacccccagcgggccacaattttttggaaatatcccgagagggcctggaaaccccccgggccccctcttggctccggaggtaattccccccggggggggaacacttttacggggggtaaatattttttttataagagcgccccgcgggtgaaaacctccccccgaaaaaaaaatacccccgtaaaaaaaaaccccgcgggaaaatttggggggtcctcccttataaaaaaaaaaagcggggggggaggcacacaaaataatttggtgcgcccccttttggggggaggggtagtttctcc

SEQ ID NO: 82874 - DNA, 879 bp, Zea mays
  misc_feature: Ceres CLONE 1568759
  misc_feature: Translation starting site: 254
  misc_feature (832)..(832): n is a, c, t, g, unknown, or other
ctccccgcggtggcggccgctctagaactagtggatcccccgggctgcaggaattcgtctcacccctagaaaaagtaggagaggatggatgtgcaaacctagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaagttccggcggcttccagtgatgtgttcgccacagaacgagcagcacctgctgcaggacaaacacttaacaacaatgctcgtcctccggagaagaagcagcgggttccgtcggcgtataacagattcatcagggaagagatacgcaggatcaaagcgaacaaccccgacattaaccacaggtaagccttcagcacggcagccaagaattgggcacattatcccaacatcccatttcggttttagacgaactccgggcgagagggcaagaaggagctcgtggatcatgnagagcggccgcgttctgttcgtcgcaagtcgcaagcagcaccgacgg

SEQ ID NO: 82875 - DNA, 951 bp, Zea mays
  misc_feature: Ceres CLONE 1568762
  misc_feature: Translation starting site: 227
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (792)..(792): n is a, c, t, g, unknown, or other
  misc_feature (946)..(946): n is a, c, t, g, unknown, or other
ctccccgcggtggcggccgctctagaactagtggatcccccgggctgcaggaattcgtctcacccctagaaaaactagaaaaaaagcaagctcctcctctcccgcaaacacccacgcccactccatcgctcctctcctccaacatcgctcacgcggtctcctctccccgctcagctccgctcccggagacacgcaagcttcccgttcccgggaacacgcactaaagatgcctccagccttcgccgccgcaccttcctcctcgatatgtggcgttcgcatcccaactgtgcgccgtttcgaagcgcaaagcacggtttccacgcccagatttctgcgtaatcgggtggcagcaaaaacacggtctacatcagcttggtccttgaaggctggcttgtgggattctctcagatctggccttttgaagaataatagcagtacagagacagtagagccaccaccagcaccacttgaagtggaagagcctttgcctgtggaaatagtactcctagaaagaacactacctgatggaagtacagaacaaattttattttcttcagccggagatgttgatgtatatgatctccaagccttatgcgataaggtaggatggccacgcaggcctctttcaaagatagcagcctcattaagaaatagctacttggttgctacactatattcaataattagatcttcagaaacagagggagaagagaagaacagctcattgggatggcacgagcaacctcagaccatggcctcnnnatgcacgattgggatgtccttgttgatccntcatacaggggtcagggtctggtaagcgctcatggagaaagtattcgtactttgctccagagagactcaacacattacactggtgcgggataacaagtatagattctacaagaacctgggggtcgaagtgatcctcaggcatcagggccatgtnctgtt

SEQ ID NO: 82876 - DNA, 938 bp, Zea mays
  misc_feature: Ceres CLONE 1568763
  misc_feature: Encodes the peptide sequence at SEQ ID NO. 82877
  misc_feature (742)..(742): n is a, c, t, g, unknown, or other
  misc_feature (827)..(827): n is a, c, t, g, unknown, or other
  misc_feature (859)..(859): n is a, c, t, g, unknown, or other
  misc_feature (925)..(925): n is a, c, t, g, unknown, or other
ggagctccccgcggtggcggccgctctagaactagtggatcccccgggctgcaggaattcgtctcacccctagaaaaagacgcgtctcttccacagccgcaacctctatccctcgtctggtatcgtctctcccacacccctctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcataagctgcaccgccagtggaccttctggtacgacatccagtccaagcccaagcccggcgctgcgtggggcacctccctcaaaaaggcgtacaccttcgacaccgtcgaggagttttggggcttgtatgatcatgttttccgtccaagcaagttgcctggaactgctgattttcacctattcaaggctggagtagagccaaaatgggaagacccagagtgtgcaaatggtggtaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagcaatgaagctgtccaggtaaacattggcaagaaatggaaggatgtcatcgactacnatgacaagatcatctacacttttcatgacgactcgagaagggatagccaagcagatgtgacggtacaccgtgtagtccacacaangaatgtcgttgtttcgactgacagagcctganagtggagttttgtgctgagatcggcacagctttcattaaacagccccactacctgaagcatttccnacctggtatgatt

SEQ ID NO: 82877 - protein, 223 aa, Zea mays
  misc_feature: Ceres CLONE 1568763
  misc_feature (6)..(207): Pfam Name: IF4E Pfam Description: Eukaryotic initiation factor 4E
  misc_feature (186)..(186): Xaa is any aa, unknown, or other
  misc_feature (214)..(214): Xaa is any aa, unknown, or other
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYXDKIIYTFHDDSRRDSQADVTVHRVVHTXNVVVSTDRA

SEQ ID NO: 82878 - DNA, 982 bp, Zea mays
  misc_feature: Ceres CLONE 1568764
  misc_feature: Encodes the peptide sequence at SEQ ID NO. 82879
ctccccgcggtggcggccgctctagaactagtggatcccccgggctgcaggaattcgtctcacccctagaaaaagcagatgcaacagcaccatcgcgtcaagggctgccacggtcccgccgtcgctgaccatgccgcgcggcgaactcgctgacgccatcgtgggcggaggcggaggaggaggagcggactgggacgcgcgggcgggcctgctgcggctgtctgcgctcggggaccgcatggccgccgtccggggccgtatctgcgcctctatctcgggcgaagcccggcctctctcctacgccgacatccaatctgtctcctccgagatctccgccgctgcccagctcgtcgtcctcaacgccgccgagctcctcgcttcctccgtcccccctcccgccccacctccacctcctcctttcgggcgctccctcttccgctcccggccgagagatcccagttggtggccctttccgcccagaacaaccccctggaggccgccaaggacgaatgggggctaccatggtcttggaggcttcaccccccccaagctgcttagcggagcaccttccacttctggcgagatctgccgggaaaggggtttccggcccgcgacgcctaacctcagggatggacatgtgggccccccccgggggaacggcttcatgaatcctttgtaagcgctcctcccccgccctggtttacgggcccagcctaaatcgcgccccgttggggggaaaactgggggcttttcctcgcccctctttgggggtggcaatagggaacagggaaattctggccgctttccggcccctccaatttctgggtggtggcgcactgtaacgattttttggcgccgcaacgttacaaagagttatcccttgcaaatagatggtgcgcggcaaaatagcttttactgtcctggggggaaccctgaaacccctccccccactgtgaggaagagagacattggcgtttctcct

SEQ ID NO: 82879 - protein, 182 aa, Zea mays
  misc_feature: Ceres CLONE 1568764
MPRGELADAIVGGGGGGGADWDARAGLLRLSALGDRMAAVRGRICASISGEARPLSYADIQSVSSEISAAAQLVVLNAAELLASSVPPPAPPPPPPFGRSLFRSRPRDPSWWPFPPRTTPWRPPRTNGGYHGLGGFTPPKLLSGAPSTSGEICRERGFRPATPNLRDGHVGPPRGNGFMNPL

SEQ ID NO: 82880 - DNA, 935 bp, Zea mays
  misc_feature: Ceres CLONE 1568765
  misc_feature: Encodes the peptide sequence at SEQ ID NO. 82881
  misc_feature (757)..(757): n is a, c, t, g, unknown, or other
  misc_feature (921)..(921): n is a, c, t, g, unknown, or other
ctccccgcggtggcggccgctctagaactagtggatcccccgggctgcaggaattcgtctcacccctagaaaaatctcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccccaagacaatggagaactacaggctgctttatgacaccaagggccgcttccgtcttcacccaatcagggatgaggatgccaagttcaagctctgcaaggtgaggtctgttcagtttggccagaagggcatcccctacctgaacacctacgacggccgcaccatccgctaccccgacccgctcatcaaggccaacgacaccatcaagatcgatctggagaccaacaagatcatggacttcatcaagtttgacgtcggcaacgtggtcatggtgaccggcgggaggacacggggcgtgtaggtgtgatncagaacagggagaagcacagggcggcttcgataccatcacgtcgaggactccatgggcccacagtcgccaccgcatggggcacgtggtcacatcggcagggcaacagcccggggtgagcctgcccagggcaggtatcagctcgcatcatcgagacaaaaagagncgacttgctgccag

SEQ ID NO: 82881 - protein, 191 aa, Zea mays
  misc_feature: Ceres CLONE 1568765
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVDGKVRTDKTYPAGFMDVISIPKTMENYRLLYDTKGRFRLHPIRDEDAKFKLCKVRSVQFGQKGIPYLNTYDGRTIRYPDPLIKANDTIKIDLETNKIMDFIKFDVGNVVMVTGGRTRGV

SEQ ID NO: 82882 - DNA, 1116 bp, Zea mays
  misc_feature: Ceres CLONE 1568766
  misc_feature: Encodes the peptide sequence at SEQ ID NO. 82883
  misc_feature (1025)..(1025): n is a, c, t, g, unknown, or other
gcggtggcggccgctctagaactagtggatcccccgggctgcaggaattcgtctcacccctagaaaaaatgctctcacctagcctacacccggctgttctcgtcgtgggagccgacccccattccgcatccttgtcgccgtgacgcctgaagcctgctccccggaccccgatccggatcgggcgatcccacgcccagactgtccagatgcaagcttgaaacggtgcagctcgacatcgccatgaacaactacatgcccctgtcgatactccctaatccgagctcgtgtcacatccgggtcccaggcaacgagccctaagaaccgtgcggctgcctgtccatgcagaggatattgaaaaggagcataaaacaggaggtggaatacggcggtgttgacgctctcattatcatggaggaggatcaaggaggcgtgcctctaagggttggcctagaagtgaacgagcgggtgctaggatcccctgacgcccgtctatctaaaacaaaagggcgcgccatgcttttgtttccgggggcccctttcaacggacagggcaaaggtaacagggacccgggcgggggccttgggcaagtggaatctccctgggagagtaaacaaagattggagacttggtaacatttggcgacaacctcgttaataaagggtacaaggcgttacataagttggcgcctctttgctttaaccctcttcaagagatagttggcggatctgccggcgctcatattttttgtgggtcaatcttctgccggaacaaatttgtgaagagcggcgaggcaaaaagagagatcccacgtggagggacccacgccgcaaacttgttgtggagggggttgccgcctattacggtgtatataaatagcgcctccggctgttatattgcagctaccacgcgcctgacaattgtgataatagagacggagaggggtgggtcgaatatgcagagcctctggggagggggtatgttaattgagcggcgcgggtctgaggcaaccgcagcgttttagganttttctagtagacagagtagagtctgtctaaatactatgtagagcagactggtagcacccttctctgttgtatgagagaagcccacgcggg

SEQ ID NO: 82883 - protein, 97 aa, Zea mays
  misc_feature: Ceres CLONE 1568766
MQRILKRSIKQEVEYGGVDALIIMEEDQGGVPLRVGLEVNERVLGSPDARLSKTKGRAMLLFPGAPFNGQGKGNRDPGGGLGQVESPWESKQRLETW

SEQ ID NO: 82884 - DNA, 957 bp, Zea mays
  misc_feature: Ceres CLONE 1568767
  misc_feature: Encodes the peptide sequence at SEQ ID NO. 82885
ctccccgcggtggcggccgctctagaactagtggatcccccgggctgcaggaattcgtctcacccctagaaaaactcacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcggcggctccccgggcttcagcggcttcggcggcatgcccgggtcgcccaccgccggctccgtccccgagcacgccaacaagccctgaacgccaacaagcgtggtagtagagtggtgctactgttactgtagtacgtcgtcgtcttcatgcatgcgtggttcgtggttttccctagctcatacgagcagtagtggggcttgcacgtaccgtacgtctagctagcttatatatagctggtgtccactgccttttagtttaataccgcctgcattggagagttgatctgttcatttgggggggttgctttactattaggcagaactgtttggggaaactgtggttaattattagcctttggaacggttgtactaaccgggggcggggtgaatttctgaggctgataagcacatgc

SEQ ID NO: 82885 - protein, 128 aa, Zea mays
  misc_feature: Ceres CLONE 1568767
MARSSKMMVAAALLALALAVSTAEARNIKTTTTEKKDDAVVQPQTFPPFDRLGGGASPAFGGLPGGSIPGSSIPGFSMPGSGSSLPGFSLPGSGSMPLFGGGSPGFSGFGGMPGSPTAGSVPEHANKP

SEQ ID NO: 82886 - DNA, 916 bp, Zea mays
  misc_feature: Ceres CLONE 1568768
  misc_feature: Encodes the peptide sequence at SEQ ID NO. 82887
  misc_feature (489)..(489): n is a, c, t, g, unknown, or other
  misc_feature (490)..(490): n is a, c, t, g, unknown, or other
ctccccgcggtggcggccgctctagaactagtggatcccccgggctgcaggaattcgtctcacccctagaaaaaattcatcccctcctccggtctcgactgccatggccgccgggcgggccttccttggcgcgccgtgctcctccctcgccgccggcgcccgttgccttgccttcgcttcccctttgccccggaacctcacccccgcgctccgctgcggcgttcgcggtcgctgcatcgcctccgcctcctcgtcccctgactcgccccccttgccggagccctacgtgctcaccactcctctctactacgtcaacgctccgccgcatatgggaagcgcctacaccaccatcgcagcggacgccatcgcccgcttccagaggttgctagagaagaatgttatatttattaccggaacagatgaacacggtgagaaaatatctgcttccgcagaggccagtggtagaaaccaaaggagcattgtgatgcnnatttcaagtcatataggacgctctgggctgacttagacatagaatatgacaagtttatttcgcacacggatgttagcatgaggctgttggaacgatttctattccagagtgtaaacatgggcgacttatagagctgattatgaagactttatggggtgaccggggaagagtccagatgaaaaaaactttgggaaaaaatgggtgccctgtgcatccgaaccctggggttaaaaaaaaaaaaaaaactttttctttgccctggccaaagcccaacttaatttggaaaaaccccggacaaaaaataccgggttttgggagaggctcctttacccttttaaaagaggcccagggtgggttttaaaacgggtttaggggccttttctttttttccccgcactctggaaagagggggcctctcccgggcca

SEQ ID NO: 82887 - protein, 140 aa, Zea mays
  misc_feature: Ceres CLONE 1568768
  misc_feature: SWISSPROT Homolog: EC 6.1.1.10 Methionine--tRNA ligase
  misc_feature (129)..(129): Xaa is any aa, unknown, or other
MAAGRAFLGAPCSSLAAGARCLAFASPLPRNLTPALRCGVRGRCIASASSSPDSPPLPEPYVLTTPLYYVNAPPHMGSAYTTIAADAIARFQRLLEKNVIFITGTDEHGEKISASAEASGRNQRSIVMXISSHIGRSGLT

SEQ ID NO: 82888 - DNA, 931 bp, Zea mays
  misc_feature: Ceres CLONE 1568770
  misc_feature: Encodes the peptide sequence at SEQ ID NO. 82889
  misc_feature (849)..(849): n is a, c, t, g, unknown, or other
  misc_feature (920)..(920): n is a, c, t, g, unknown, or other
ctccccgcggtggcggccgctctagaactagtggatcccccgggctgcaggaattcgtctcacccctagaaaaaaagcagatcttgtgaccctccctcagccgcgtcgcgtcccatcctacgatccaaaggtctctctgctcgcagccatggcgaagaactacccgaccgtgagcgccgagtacagcgaggctgtcgagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcaacccccacctgagggccgccttcctgacgccactaagggttctgaccacctgaggcaagtttttggcaagcagatgggcttgagcgatcaggacattgttgccctctctggtggccacaccttgggaggtgccacaaagagcggtctggtttcgaggggggcctggactacaaccctttggtcttttgacactcttacttcagggacctctgagtggtgataagggagggcctcttcagctcccagtgacaaagccctgctgagcgaccctgtttttcgccctcttgtccagaatatgctgcggatgagaagcttttcttgatgactacnaagaggcccactcaagctctcccgaactggggttgctgatgcttaatagacccctatctggaatgataatnctgctgcccgg

SEQ ID NO: 82889 - protein, 196 aa, Zea mays
  misc_feature: Ceres CLONE 1568770
  misc_feature (19)..(196): Pfam Name: peroxidase Pfam Description: Peroxidase
  misc_feature: SWISSPROT Homolog: EC 1.11.1.11 L-ascorbate peroxidase
MAKNYPTVSAEYSEAVEKARRKLRALIAEKSCAPLMLRLAWHSAGTFDVSSRTGGPFGTMKHQSELAHGANAGLDIAVRLLEPIKEEFPILSYADFYQLAGVVAVEVTGGPEIPFHPGREDKPQPPPEGRLPDATKGSDHLRQVFGKQMGLSDQDIVALSGGHTLGGATKSGLVSRGAWTTTLWSFDTLTSGTSEW

SEQ ID NO: 82890 - DNA, 864 bp, Zea mays
  misc_feature: Ceres CLONE 1568772
  misc_feature: Encodes the peptide sequence at SEQ ID NO. 82891
  misc_feature (493)..(493): n is a, c, t, g, unknown, or other
  misc_feature (520)..(520): n is a, c, t, g, unknown, or other
ctccccgcggtggcggccgctctagaactagtggatcccccgggctgcaggaattcgtctcacccctagaaaaagtgggaggggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccgccgccgacggcgagccggcgcccgactgggcgcacgagacgctgctggagcacgacgcggagcgccgcttcttccgctacgagatgaacgacaacaacatgggcttcggcctcttcttcgccacgttccgcgtcgtcccggccgccgccgccggcgggtgcgagctgcgctgggagttcgagtgcgagcccgtgcgcggcacgcccagggacgcgctcgtggcgcgcctgcaggccgggctcgacngcatggcggcgcgcgtgcgtgaccacntcctcgccgctcgcgccgcccctgccgtggtgcccgccggtgcaggtgagctcgtcgtcgtcaagctcgacagctccatcgccgccgtctgatcactggctgggcgcgcgtcgacggcgatccacacgtacaacgaagagacgccgttcgctggtgctctctcctctgtctgctccgcgcgccagctgtccttgcccatcgtgtttccgtttctaactccccgcccccgggttttttaccccttggccgggcccggggggcgctgcctccccccaaatttttcccgccccggcctgatttttgccggctggttgttaaccgggggctggtttttccccccccct

SEQ ID NO: 82891 - protein, 93 aa, Zea mays
  misc_feature: Ceres CLONE 1568772
  misc_feature (55)..(55): Xaa is any aa, unknown, or other
  misc_feature (64)..(64): Xaa is any aa, unknown, or other
MNDNNMGFGLFFATFRVVPAAAAGGCELRWEFECEPVRGTPRDALVARLQAGLDXMAARVRDHXLAARAAPAVVPAGAGELVVVKLDSSIAAV

SEQ ID NO: 82892 - DNA, 963 bp, Zea mays
  misc_feature: Ceres CLONE 1568773
  misc_feature: Encodes the peptide sequence at SEQ ID NO. 82893
  misc_feature (760)..(760): n is a, c, t, g, unknown, or other
  misc_feature (867)..(867): n is a, c, t, g, unknown, or other
ctccccgcggtggcggccgctctagaactagtggatcccccgggctgcaggaattcgtctcacccctagaaaaaaaggaggtccccgtcatcttcggtgaatggtggctggcggacacggaggtggtgatcaagcaggcgcttcagctcggcgctggccccaatgtctctgacgcccacaccatcaacggcctgccagggccgctctacaactgctctgccaaagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccgtcctacccgggcgccaactactacatgtccgccgcgccctactccaccgccaggccggccaccttcgacaacaccaccgtcgccggcatcctcgagtacgagctgtactaccccgacgcgccccggccctccgcctccgcggggagcttcaacgaggccctgccgctctacagaccgaccctgccgcagctcaacgacaccagcttcgtcggcaacttcacggccaagctccgcagcctcgcgacgccgcggtacccggcgggcgtgccgcggacggtggacaggctgttctttctcgcggtcgggctcggcacgcacccgtgccccgncaatcgcacgtgccatggccccacatacacacgcagttcgcggcgtccgtcaacaacgtctccttcgtgctccccacaaggcgctgctgcactcccactttcacggnctgttcagcggggtctactcgcctgaactccccgtgccgcccctggcgcgttcaactacacgggacgcggccaacaacacaacgtggcagcggtac

SEQ ID NO: 82893 - protein, 296 aa, Zea mays
  misc_feature: Ceres CLONE 1568773
  misc_feature (25)..(179): Pfam Name: Cu-oxidase Pfam Description: Multicopper oxidase
  misc_feature: SWISSPROT Homolog: EC 1.10.3.2 Laccase
  misc_feature (253)..(253): Xaa is any aa, unknown, or other
  misc_feature (289)..(289): Xaa is any aa, unknown, or other
PRGGGRSRTSGSPGLQEFVSPLEKKEVPVIFGEWWLADTEVVIKQALQLGAGPNVSDAHTINGLPGPLYNCSAKDTYKLKVKPGKTYMLRLINAALNDELFFSVANHSLTVVEVDAVYVKPFTVDTLLIAPGQTTNVLLAAKPSYPGANYYMSAAPYSTARPATFDNTTVAGILEYELYYPDAPRPSASAGSFNEALPLYRPTLPQLNDTSFVGNFTAKLRSLATPRYPAGVPRTVDRLFFLAVGLGTHPCPXNRTCHGPTYTRSSRRPSTTSPSCSPQGAAALPLSRXVQRGLLA

SEQ ID NO: 82894 - DNA, 955 bp, Zea mays
  misc_feature: Ceres CLONE 1568774
  misc_feature: Translation starting site: 256
  misc_feature: SWISSPROT Homolog: EC 2.1.1.141 Jasmonate O-methyltransferase
gcggtggcggccgctctagactagtggatcccccgggctgcaggaattcgtctcacccctagaaaaagcaaggaagggcgggggctacatagcaagctccttctctgctaaccgagcgagagcagctgtagcctacactctacagctagcgcaactaacgaccatccacctgaaagagggagaacgcattgggggttcttgaagtgcagtgcaggtccaggcagctagcagtgaccgagagtgagggacagggcaatggcgtcctcactgctccactgccccgacaagctcccgttcttggacgtggaggccatcctccacatgaaagaggggctcggcgagaccagctacgcgcagaactcctcgcttcagaagcgaggcatggacaccctgaggagcctcattcaccagcaccgcgacggacgtgtacgtctcgcacatgccggagccgggtcacggtggccgaactcggctgctcctcaggacccaacgcgctgtgcctggccggaggaacaatcgtggggagcatccgcagggcgtgcggcccgtcgtcgaggccgcccgccaaagttcccggtgctgctcaaagacctgccaccaacgaactcaataaccatctttctttagcctgcccgaattttcgcctaccggttccaaggccccggcccggaacgaacaagtgggggccggcccaaatgtggtttccctggtcccggggggcccgggttcgtttcctccggacgggtggttccccaggaaaagcgtggacttcactgtggaccggctccaaccgggcagggtctcccccaagtccctccggggttcttgaaaaaaaacaaaaaaaggccgggtaaaaagggaaaaagtttctcttggagcacaggccccccgccgggcctttggccttaccataagatttcccgatgaaactccaggtattcccagtgcggcccgg

SEQ ID NO: 82895 - DNA, 906 bp, Zea mays
  misc_feature: Ceres CLONE 1568776
  misc_feature: Encodes the peptide sequence at SEQ ID NO. 82896
  misc_feature (655)..(655): n is a, c, t, g, unknown, or other
ctccccgcggtggcggccgctctagaactagtggatcccccgggctgcaggaattcgtctcacccctagaaaaaactccgatacgcggggatgcataggcgtcggcaggaggagctcatgtcgaacaccaatagcgttagccgttagccaccaccagtaggcagtagccacagcagtcatggggtcggtgccgccggcagagggggacaggcgccagccccagcagcagccgcacgtgatgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacggcgccccggggttccgcttcaccgccattgacgacggccttccgccctccgacgccgacgccacccaggacgtccccaagctctgctactccaccatgaccacctgcctaccccggttcatggacctaattgtcaggaccaatgccgaggccgaggccgagggacgccccgccgtgacgtgcgtcgtcgccgacagcatcatgagcttcggcctccgcgccgcgcgagagctcggtctccgctgcgccacgtgctgggacgcagcngctgcagctgcattggctactactactaccgccactcgtcgcacggggtatcgtcccgcttaagatgaacgcagctcaccgacgggtacctggacccgtcgtcgactggatcccttgcgcgccaagaactgcagctccgggacttccgagcttttgcgcaccagggacgggagaaatcatgctcacttcctcttcaagaagtaaagcgaatccccagcctccgccggggcattacccaatcgatgatccca

SEQ ID NO: 82896 - protein, 179 aa, Zea mays
  misc_feature: Ceres CLONE 1568776
  misc_feature: SWISSPROT Homolog: EC 2.4.1.210 Limonoid glucosyltransferase
MGSVPPAEGDRRQPQQQPHVMMIPYPAQGHVTPMLQLAKLLHTRGFHVTFVNNEFNHRRHLRARGPGALHGAPGFRFTAIDDGLPPSDADATQDVPKLCYSTMTTCLPRFMDLIVRTNAEAEAEGRPAVTCVVADSIMSFGLRAARELGLRCATCWDAAAAAALATTTTATRRTGYRPA

SEQ ID NO: 82897 - DNA, 949 bp, Zea mays
  misc_feature: Ceres CLONE 1568777
  misc_feature: Encodes the peptide sequence at SEQ ID NO. 82898
  misc_feature (768)..(768): n is a, c, t, g, unknown, or other
  misc_feature (777)..(777): n is a, c, t, g, unknown, or other
  misc_feature (862)..(862): n is a, c, t, g, unknown, or other
agctccccgcggtggcggccgctctagaactagtggatcccccgggctgcaggaattcgtctcacccctagaaaaaactgcgagggaaggagggagagaaaaaggggagcccgatccaatcccaatcccctcccgccgcgtcacatcgccgccgtcctcgtgccccgttacctctaaaaccctagcggggagccgccgagccggggatgaagatccagtgcaacgcgtgcggggccgcggaggcgcgggtgctgtgctgcgcggacgaggccgcgctctgcgtcgcctgcgacgaggaggtgcacgccgccaacaagctcgccgggaagcaccagcgggtgccgctcctgacggacgccgccgccgctgccgccgcagcggcgccggccgtgcccaagtgcgacatctgtcaggaggcttctggatacttcttctgcctagaggaccgtgcactactttgtagagactgtgatgttgctatacacacagtgaattcctttgtttcagtacatcagagattcctgctaactggagttcaagtgggtcttgatcctgctgatccagttccacctattgctgaaaagcatgttaatgctgttggtggatcagtgaatcaaccagtgagacatcagccaaggagaagcccgacagttcaattttcagttgaagggagtgcttctgttcctaccaaaatgtaacaaatggagattgttccaggcagaattttgtcccacagccagggcagaagtgggtgattggactatgaantatagtacnattcgatcagtagaatctcccgcctagtacatttcagaggaaagccccactttctgcatctagccagaccacacagtcttctccnaccaaattattggcatagtgatgggggcctacacttgtcattctcaggtggtaatggtgacgaagcttaccgaatgggcccgtggat

SEQ ID NO: 82898 - protein, 163 aa, Zea mays
  misc_feature: Ceres CLONE 1568777
  misc_feature (60)..(107): Pfam Name: zf-B_box Pfam Description: B-box zinc finger
  misc_feature (1)..(47): Pfam Name: zf-B_box Pfam Description: B-box zinc finger
MKIQCNACGAAEARVLCCADEAALCVACDEEVHAANKLAGKHQRVPLLTDAAAAAAAAAPAVPKCDICQEASGYFFCLEDRALLCRDCDVAIHTVNSFVSVHQRFLLTGVQVGLDPADPVPPIAEKHVNAVGGSVNQPVRHQPRRSPTVQFSVEGSASVPTKM

SEQ ID NO: 82899 - DNA, 851 bp, Zea mays
  misc_feature: Ceres CLONE 1568778
  misc_feature: Translation starting site: 230
  misc_feature: SWISSPROT Homolog: EC 5.1.3.2 UDP-glucose 4-epimerase
  misc_feature (594)..(594): n is a, c, t, g, unknown, or other
  misc_feature (712)..(712): n is a, c, t, g, unknown, or other
  misc_feature (729)..(729): n is a, c, t, g, unknown, or other
  misc_feature (750)..(750): n is a, c, t, g, unknown, or other
gcggtggcggccgctctagaactagtggatcccccgggctgcaggaattcgtctcacccctagaaaaagcgaaacagaagcacggcaatctcgatctcgttcgttcccctgagcggcagtcagtgcgagcgagcgcgcacacagacaactcatcctctcccctctctctctcacacacacacatccatcatcccatccctgtgacgggcgatccgagggcctaccgacgatggtgtccgccgtgctccggaccatcctcgtgacgggcggcgccgggtacatcggcagccacacggtgctgcagctgctgcagcagggcttccgcgtcgtcgtcgtcgacaacctcgacaacgcctccgaggccgccctcgcccgcgtcgccgagctcgccgggcacgacggcgccaacctcgtcttccacaaggttgaccttcgcgacaggcacgcgttggtggacatcttctcgtcgcacaggttcgaggctgtcattcactttgctgggctcaaggctgtggggagagcgtgcacaagcccctgctttactacgacaacaacctggtcggcacatcacccctcctggaagtgatggctgcnaatgggctgcagaagctggtgttctcgtcatctgcaactgtctatgggtgggcccaaggaagtaccatgcaccgaagaattcccgctctggcgcaccaatccctatgggcggacaagnttgggattgaagaaatntgggccggaacgtcacgggtncgaaccgggacgggaagatcaaccggcccaggtgactccaaccccgtggggccctatcccaggcgggaacatcgggaaaaaacccccggggggtgcccaaa

SEQ ID NO: 82900 - DNA, 951 bp, Zea mays
  misc_feature: Ceres CLONE 1568779
  misc_feature: Encodes the peptide sequence at SEQ ID NO. 82901
  misc_feature (707)..(707): n is a, c, t, g, unknown, or other
tacccgcggtggcggccgctctagaactagtggatcccccgggctgcaggaattcgtctcacccctagaaaaaatcaaccagctgatttctccatcgaatcttgtcggcaaagccaataatcaatcaccagcgacatcaattccttgcccgaccgcccggccgcgcgtcgaggaaccgccgcacagttccatgggcaaggtgcgctccttcttctgccgcgcccgcagcggcaagcgcggtggctcccggccaggcttgtcgtcctcgtctctctcgtccccgtgcccctccgcgaggagggcgtcgccgccggccggggacgagacggagcgcgtcttccgcaagttcgacgcgaacggcgacggccagatctcgcggtccgagctggcggcgctgttcgagagcgtgggccacgcggccaccgacgacgaggtgtcgcgcatgatggaggaggccgacgcggacggcgacggctacatcagcctgcccgagttcgcggcgctcatggactcggcgtccggcgacgccgacgccgtcgaggaggacctgcgccacgccttctcggtcttcgacgccgacggctaacggctcatcacccccgccgagctcgcgcgcgtcctgcgcggcctcggcgagtccgcctccgtcgtccagtgccgccgcatgatccatggcgtcgaccgcaacggcgacggactcgtgtccntcgacgatgtcagctcatgatggcccggcgaatcccggaagatcggtgccctaggacaaggattctgccctgctcgctccccacaaaaattggattcatttcatcaattaacataatgctgcccctatgaattagatcaacctggatcacgagatgtttcctagtccggattattaacaccccagcggcagcaataaaagcccccatttacctactagtttggatggccaacggaatggtttgg

SEQ ID NO: 82901 - protein, 131 aa, Zea mays
  misc_feature: Ceres CLONE 1568779
  misc_feature (45)..(73): Pfam Name: efhand Pfam Description: EF hand
  misc_feature (81)..(109): Pfam Name: efhand Pfam Description: EF hand
  misc_feature: SWISSPROT Homolog: EC 2.7.11.1 Non-specific serine/threonine protein kinase
MGKVRSFFCRARSGKRGGSRPGLSSSSLSSPCPSARRASPPAGDETERVFRKFDANGDGQISRSELAALFESVGHAATDDEVSRMMEEADADGDGYISLPEFAALMDSASGDADAVEEDLRHAFSVFDADG

SEQ ID NO: 82902 - DNA, 946 bp, Zea mays
  misc_feature: Ceres CLONE 1568780
  misc_feature: Translation starting site: 158
  misc_feature (708)..(708): n is a, c, t, g, unknown, or other
  misc_feature (744)..(744): n is a, c, t, g, unknown, or other
  misc_feature (794)..(794): n is a, c, t, g, unknown, or other
  misc_feature (797)..(797): n is a, c, t, g, unknown, or other
  misc_feature (905)..(905): n is a, c, t, g, unknown, or other
ctccccgcggtggcggccgctctagaactagtggatcccccgggctgcaggaattcgtctcacccctagaaaaattcgctcgcgtgctctctctctctctctctgctgcctcagccgccctcgctgtcgctgagccgacagattcattcggccggtcatggctgacgcgttgtgcaacggcgtcgtggcgtccccgtgcggccgggacgtcgccggcagggccaggggcgccggcagggccgcgctcgcggagtcccttcaggtcgccgggcacgccagcaagacctccttctccgccgggaggatgtcggtcaaggacagcaagccgaggcccctgtcgcgtagcctcgaggccgccgcgccaggacagatgaacctgtcgttccccaagggccatgcggtggtgaggagaaggggctgcaccccaacatgcgccgaggtcgagtccgcgcaggacctcgccgactcgctgctcagcgccggcgacaaactcgtggtcgtcgacttcttctccccaggctgcggcggctgccgcgccctccaccccaagatcgcccagttcgccgagaagaccccggggcgtgcagttcctgcaggtgaactacgagacgcacaagtccatgtgctacagcctccgcgtccacgtcctcccttttctcaggttctaccgggaagccgagggccgggtcagcagcttcagctgcaccnacgcaacgatcaacaagttcaaggacgcgctcgccnagcacggggctgagtagtgcaacctcgggcctgcgcgggggctggacaantcngacctcatggctttgctgaaaaaaggacctgcacttcactacaacaagccggcggcctctccccctcgggatacattgcaaggagctgccgcgcccggaggccggggnttctctgctgcgtcttgctcggcaggatctgcgataccatg

SEQ ID NO: 82903 - DNA, 933 bp, Zea mays
  misc_feature: Ceres CLONE 1568781
  misc_feature: Translation starting site: 87
  misc_feature: SWISSPROT Homolog: EC 3.6.3.8 Calcium-transporting ATPase
caccgcggtggcggccgctctagaactagtggatcccccgggctgcaggaattcgtctcacccctagaaaaattgatagaatgtgcatggagcatgactcgcccaggacaagtgctgtgaaccttgggagctttaatgtgatggttgatgcatactgtcatgctgaaagaggtcaatatgcgattaaggtgtttgggaagatgccgagaagaggcctgtgccagatgtactcctccaataatctgattgactggctagggaagaataaacttgttgggaagtctgaaggatggtacatggaggaagctgcaagagctgtatttgtgagtggaataaagcaatcatggccaccacctgtgcaatgtgtgatactgggtgatggtgttcaagtcaggcttccgccttggccaccacctgtttggaaagtatggttgtcaatgaagattactggtccactgagtttcaagttgggtcccaaatggcgagtggaaggattggtctattggaattattgtagtccacaatatacaccagaatttgttgggagttcaggcatcggttcgccagatgacagtcaaagtgaccattggacagactatttcatgctcacatctgttgcgcagcggaaagatagctaccatttgccatgatgctagtattgcccactctgagcatcagtacgttgctactgggatgcctacagaagtggttctggaagttttgggtgaaacatggggacttcctggtggtatacccatctctcgattcatctgatttgcgaagaattgtcagtggtggaataatctgccaaggagtagcacctctggaattgatcgcctcgaaatcaagggaagtattgggaagcaactccgggaaactcctgcttgtaaggaaccttaaaatcctgcaagaaatgttcctcttaaatggccc

SEQ ID NO: 82904 - DNA, 935 bp, Zea mays
  misc_feature: Ceres CLONE 1568783
  misc_feature: Encodes the peptide sequence at SEQ ID NO. 82905
  misc_feature (729)..(729): n is a, c, t, g, unknown, or other
ctccccgcggtggcggccgctctagaactagtggatcccccgggctgcaggaattcgtctcacccctagaaaaaatccttcgcgaggagatcccttcgtcggggaagagaacccgccaggagacctacccttcctcaatcctccgaccctccatggcctcctcctccctggccctccctccaatctctctcctcctcgcgctgctgctcctctccgccccctcgccgtccgcctgcgcctcgctttccttcctcaccgcctcctccaacggctccgcctccacctccgccgacccggagctggaggacctggccccggagcccaccttcctcgaggaggtcatcgacgccgtctcggagaagtacgactgggatccggacgccgaggtcagggtctggccgctcgacgccggcgccgtccgcgtcggctccgtgcagcggtacgagttccgggcgcgggcgggcgggtcggcggcgctggcgcggttctccgacgaggccgtggagtggagactcccctccgcgccggccgtcgaggaggtggatgggccggacggggtcgacgtcgtccccgccgaaggcgcgttcgggttcgacaccggcgtcagggacgtggagctggttgggccggtggagctcaagcttgctggcaaccagacggtagcctcgtcgagctccagttaccttcggggaatgcacatacacaaggcttaagaagatatttgttgcngatgagcatgcattaaaggtcattggtgcacagaaagtttctgtaacccacctcacagtataggtcttctatcaaatggaagttttgtggctagtaacacgacctaagccaatatgggccttgagctactcaaccgtgccccattacttcaagtgggtattgtaggatcaagtcgtattggttgtgcatcaaacaagtgtttctga

SEQ ID NO: 82905 - protein, 186 aa, Zea mays
  misc_feature: Ceres CLONE 1568783
MASSSLALPPISLLLALLLLSAPSPSACASLSFLTASSNGSASTSADPELEDLAPEPTFLEEVIDAVSEKYDWDPDAEVRVWPLDAGAVRVGSVQRYEFRARAGGSAALARFSDEAVEWRLPSAPAVEEVDGPDGVDVVPAEGAFGFDTGVRDVELVGPVELKLAGNQTVASSSSSYLRGMHIHKA

SEQ ID NO: 82906 - DNA, 865 bp, Zea mays
  misc_feature: Ceres CLONE 1568784
  misc_feature: Encodes the peptide sequence at SEQ ID NO. 82907
ctccccgcggtggcggccgctctagaactagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaatggcgattcacaatggtcttcaagaagcggcatcaacgccgacgcccggtgatccagttgcaagcaaggggcccccttcgaaaaggaacatgctgggttcaaggctcttacttttggggcgggggggggaaacggaagttttatttaaagtgccccccggccccaaaaaaaataaacccgtgggcccaaagggaaaaacccctttttcccccccccctttctcaaaaaaaggggagaggggcccaaaaagagaagaatctttttaccacccgaggaga

SEQ ID NO: 82907 - protein, 182 aa, Zea mays
  misc_feature: Ceres CLONE 1568784
  misc_feature (30)..(183): Pfam Name: Ribonuclease_T2 Pfam Description: Ribonuclease T2 family
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLNGDSQWSSRSGINADAR

SEQ ID NO: 82908 - DNA, 919 bp, Zea mays
  misc_feature: Ceres CLONE 1568785
  misc_feature: Translation starting site: 159
  misc_feature (719)..(719): n is a, c, t, g, unknown, or other
  misc_feature (817)..(817): n is a, c, t, g, unknown, or other
  misc_feature (899)..(899): n is a, c, t, g, unknown, or other
agctccccgcggtggcggccgctctagaactagtggatcccccgggctgcaggaattcgtctcacccctagaaaaaaccgcagctcccctctccctatccatccaggccatccgctgtacatcacgcacgttggtcggtgctcccctcggcgagcgagatgcgtgggccggcgtctgtgaaggcggggagccggccgccgtggctgggactgggggcggccgcatgggtgcaggtcgcgggcggcgccggctccacgttcgcgctctactcgcacgcgctcaaggtcgccctcggcgccgaccagagccggcttgcgctgctcggggtcgcctgtgacgtcggcgagaacctcggcctgctcccgggggtgctctgcaaccgcctccaccccgcgctgctcctcatcatcggcgctggcgcgtgcctgtctcgggtacggcaccgcgtggctcctcgtctctggcgtcgcgcccgcgctgccttactggctgatatggtttgggttatgtcttgctatgcatggtggcgcgtggttggcgactgctgttctagtgacaaacatgaggaacttcccagtcagcagaggtgctgttgctggcattctgaaaggtactcgggtttaagtgctgctgtttcaccgaaatatacactggagtgctccgtgattcacccatcaaccttttgctctttctactctcggaattcctgctgtgtgccntcctgcaatgtactttgttcagccttgtgaaccctctctggtggagacgaatgcagagcatgtccattttatgtttgcgcagtagcaagtgtttttcntgggggttatctggtggggctaccatatgggatcactcgtgctctcaatgacatatgaactatcccgcctggctcatgggtnctctcattttgcccccaggt

SEQ ID NO: 82909 - DNA, 1321 bp, Zea mays
  misc_feature: Ceres CLONE 1568786
  misc_feature (1)..(1): n is a, c, t, g, unknown, or other
  misc_feature (949)..(949): n is a, c, t, g, unknown, or other
naggggtgggtgcatgtgtcgtgggtatccttctcctctcccctttatttaatgggtgggccccctttggggggcgccttcgtggcggccgctctagactagtggatcccccgggctgcgggagttcgtctcacccctagaaaaagacgcgtctcttccacagccgcgacctctatccctcgtctggtatcgtctctcccacacccctctgcccctacccagaaaaaccctctaaaatcggcggctggcgccacatggcggaggtcgaggctccggctgctgctgttgctgcggcgacccctgagggggtgactgtgaccgattgctgagcccctacggaggcgaagggtccgcataagctgcaccgtccagtggaccttctggtttgagctccagcccaatcgcatgcccggcgccgcgtggggcacctccctgaaaatgcgtacactttgaacacggttgagggaactgcgccctcaatgaaacatgttctccgaccaagcgaattgcctgggaacgcctgattgtgcacccacttgaggcctgggagtagagcccaaaaatgggggagtaccgagtagggttgctaattcggcggtgaaaatggatagttgccctagtcgaccagcaaaaggccgatctttttgagtaaccccccgggggcttcgcaaacgcttcgatgggactctgtgtgttggggggagggcagggccggatttaaaaccaggattgtcgctctttggcgcggatactgctgttagctgggcggtcgccccgctcgatatggaggagtgtagccgtggccgtgtgcccttttggtcagtaagcttatggtgttacgtgcgcccacgtccttatgtagacaagggtggtgctcacctgggaatatgattagatgtggtggagcgtggtcggagtaatcgggaatgaggggagtggccgcacgcanagagtgtaggactggcggtaccagggtatactcctcttgtatccgcgtgttctacctctcaatacagattcgcgtgtgacagtggggtatgctcccctcataggcgaggacacgtgggcggtgtggagattaaactgtttggttgaataacacgtgcgtctagcctgatgagtcgtttcggtgcggccggtctcctatctctggaagtcgagcggcccgcataatggtgtgatctgttctttccatggtctaacatatgggggaattggttgttgttgtcgctctaattatgtgagtccacgatggcggttgctttgatccggatgtcgcgatttcagtggttgagaggatgtaagcgcagccgcgcgtgcg

SEQ ID NO: 82910 - DNA, 884 bp, Zea mays
  misc_feature: Ceres CLONE 1568787
  misc_feature: Encodes the peptide sequence at SEQ ID NO. 82911
  misc_feature (648)..(648): n is a, c, t, g, unknown, or other
  misc_feature (806)..(806): n is a, c, t, g, unknown, or other
ctccccgcggtggcggccgctctagaactagtggatcccccgggctgcaggaattcgtctcacccctagaaaaaaggcagagatgccaacagaagtcacgtcgacaccagccagccggccggactgcagctcgtcgtcgtcgatgacggccgggaccatgcgtgtgctaggcggggaggtcagcccgttcacggcgcgggcgcgtctggcgctggatctgcgcggcgtggcgtacgagctcctcgacgagccgctggggcccaagaaaagcgacagactcctcgctgccaaccccgtctacgggaagatccccgtgctgctcctccccgacggccgcgccatatgcgagtccgcagtcatcatccagtgcatcgaggacgtggcgcgtggaagcggcggcgccgaggctagcagcctgctgctgccggacgacccctacgagcgcgccatgcaccgcttctggaccgccttcatcgacgacaagttttggccggcgctggatgccgtctccctggcgccgaccccgggagcacgcgcgcaggccgtggtagacacccgcgccgcgctgagcctcctggagggtggcgttcaggaccgcagcaacggcagggctttcttctccggtggcgacgccgcgccaggcctccntggactggccctcggatgcttcctgccggcgctcaagggctgcgaaacggctcacggcctctcactcatcgacgcgtccgcgacgccgctgctggacgggtggtagcagcgcttcgccgcgcaccctgcaagccagcgcgtcctgcgggaaaccgagnaaggtggtgcagttcacgaagttcctccagggacagttcaaggtcccctggtcataattgatttagcgtctcccaaaa

SEQ ID NO: 82911 - protein, 203 aa, Zea mays
  misc_feature: Ceres CLONE 1568787
  misc_feature (4)..(79): Pfam Name: GST_N Pfam Description: Glutathione S-transferase, N-terminal domain
  misc_feature: SWISSPROT Homolog: EC 4.4.1.5 Lactoylglutathione lyase
  misc_feature (169)..(169): Xaa is any aa, unknown, or other
MTAGTMRVLGGEVSPFTARARLALDLRGVAYELLDEPLGPKKSDRLLAANPVYGKIPVLLLPDGRAICESAVIIQCIEDVARGSGGAEASSLLLPDDPYERAMHRFWTAFIDDKFWPALDAVSLAPTPGARAQAVVDTRAALSLLEGGVQDRSNGRAFFSGGDAAPGLXGLALGCFLPALKGCETAHGLSLIDASATPLLDGW

SEQ ID NO: 82912 - DNA, 909 bp, Zea mays
  misc_feature: Ceres CLONE 1568788
  misc_feature: Encodes the peptide sequence at SEQ ID NO. 82913
  misc_feature (820)..(820): n is a, c, t, g, unknown, or other
ctccccgcggtggcggccgctctagaactagtggatcccccgggctgcaggaattcgtctcacccctagaaaaagtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgggtcattcttggacactctgaaaggagagctctgctgggagaatcaaatgagtttgttggagacaaggttgcttttgctctgtctcaaggactaaaggtcattgcatgtgttgggtgagacccttgaggagagggaggctggttcaacccatggatgttgttgctgcacaaaacaaaagcaattgctgagaagatcaaggactggagcaacgttgtttctgccctatgaaccagtctggggctattgaaactggcaaagtcgccaccccagctcaggctcaggaagtgcacgcctccctgaaggattggggtaaaaatcatgtcagccctgaggccctggaatctcaaggatcccctaggggagggtcagtaacgggtggcgaacggaaaaaagctgggcgccacaccccgatggccaagggtttccctgtggggggggggtttntttttaaaccccgagtttttcgcaattattatagcgcccccccccggggtaaaacacccccaaaataatttgcccacccctccccccgg

SEQ ID NO: 82913 - protein, 129 aa, Zea mays
  misc_feature: Ceres CLONE 1568788
  misc_feature (5)..(130): Pfam Name: TIM Pfam Description: Triosephosphate isomerase
  misc_feature: SWISSPROT Homolog: EC 5.3.1.1 Triose-phosphate isomerase
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVG

SEQ ID NO: 82914 - DNA, 931 bp, Zea mays
  misc_feature: Ceres CLONE 1568789
  misc_feature: Encodes the peptide sequence at SEQ ID NO. 82915
  misc_feature (753)..(753): n is a, c, t, g, unknown, or other
  misc_feature (808)..(808): n is a, c, t, g, unknown, or other
  misc_feature (864)..(864): n is a, c, t, g, unknown, or other
ggagctccccgcggtggcggccgctctagaactagtggatcccccgggctgcaggaattcgtctcacccctagaaaaatccttatttagccaacggaattgaactcttcagaaaagggaagctagagataggcactaaggttgcagagttttgttcacatgctttgcttgctttggatgtccttgtccaccctcgagccctttctctggaaagaacagttcctgcaagctctgggttcaactacactgcacagaaaaaaacagtttttggtgctggaacacaccagatctcaccatttggggaccagcctcaagcaatggaggtcgaagacatgaacgatgactggctaatatccaacaacaatgaaccaccagaggttccagtgaacggtagtgctgctgtggtaagtaaagatgtcgtgctggtggaggatggaaagcagctcaatcccatagcagaagatccaaaagtcgacccacccaggatcacagacgcagcacaagatgcaccagcatccaccaagactgatgtcaaggtggtcgatgcagctgcagccacagctgccaagccaaacacagcggagaatccttcgagttccaatgctgtcccctctccagtgggcacaacagattctgattcacgtaagcatgcgtcatttccgagcaggatagtcctcgtgagaacaaaagcccagccgtccatccaggtgtagcttctgcgactccaggtgttggttcaagccacaccacatcnaagcactgaggcccgtcagcagcttcacggaaatgttcggttctgagtctgcatncgatcagagtccgagactgatgccagaatcgtcgaggggaccctgatctgactggnttgggtacagtcccgttttttggtacatctggatggtcgatccgtttgtgacagtgacaacttgtcg

SEQ ID NO: 82915 - protein, 131 aa, Zea mays
  misc_feature: Ceres CLONE 1568789
MEVEDMNDDWLISNNNEPPEVPVNGSAAVVSKDVVLVEDGKQLNPIAEDPKVDPPRITDAAQDAPASTKTDVKVVDAAAATAAKPNTAENPSSSNAVPSPVGTTDSDSRKHASFPSRIVLVRTKAQPSIQV

SEQ ID NO: 82916 - DNA, 923 bp, Zea mays
  misc_feature: Ceres CLONE 1568791
  misc_feature: Encodes the peptide sequence at SEQ ID NO. 82917
  misc_feature (756)..(756): n is a, c, t, g, unknown, or other
ccgctctagaactagtggatcccccgggacggaggaattcgtctcacccctagaaaaaacgcgcagcagcaacccggtagcaggagcgcagccagcaagctcaggcccccagccctactgccaccgcgccgaacgacatggccgagccggcggagcaccgtccagctgaggaggaggaggccgcggcggccggcgaggatgaggacaccggcgcccaggtcgcgcccatcgtgaagctggaggaggtcgccgttaccactggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgacggcgagctcaaagaggagatgtttgctatccgttttggatctgtcgagaattgcaagaagttcaggacactggtgaagagatagctgaacagcagggaagagcgaggagaaagaaatgatgaagtctccactgccgcttctgattgggcccagaatttacagtgggcagagcccgccaggggggaaatgccgagaaaggaggaggctcccgcccccatgaaaaaaagaggcttangagtggagggtgaaggggaacagggggccaaagggagcccttcctttcttttcgttccaagggtcacctcccccccaattttctggggtttcctccacaaaatggttggggtccgggaaatcaaaaccccggcctcctccatgcttttcctgggggatagaaggttt

SEQ ID NO: 82917 - protein, 155 aa, Zea mays
  misc_feature: Ceres CLONE 1568791
  misc_feature (38)..(156): Pfam Name: Ran_BP1 Pfam Description: RanBP1 domain
MAEPAEHRPAEEEEAAAAGEDEDTGAQVAPIVKLEEVAVTTGEEDEDALLDMKAKLYRFDKEGNQWKERGTGTVKLLKHKDTAKVRLVMRQAKTLKICANHLVVATTKMQEHAGSDKSCVWHALDFADGELKEEMFAIRFGSVENCKKFRTLVKR

SEQ ID NO: 82918 - DNA, 898 bp, Zea mays
  misc_feature: Ceres CLONE 1568793
  misc_feature: Encodes the peptide sequence at SEQ ID NO. 82919
  misc_feature (668)..(668): n is a, c, t, g, unknown, or other
  misc_feature (801)..(801): n is a, c, t, g, unknown, or other
ctggagctccccgcggtggcggccgctctagaactagtggatcccccgggctgcaggaattcgtctcacccctagaaaaatccattgaaccttatcatttagaggaaggagaagtcgtaacaaggtttccgtaggtgaacctgcggaaggatcattggtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctactgtggcggcggcggctactgtggtggtggcggcggctacngcggtggcaaccgtggcggcggctacggcaactccgacgggaactggaggaactgagcggtggggcccgcgcggccaagttatccctgttcgctaccgtgatgtttaccctagtccagaaggtttatccttcnttcctgtcctggttgtttgtggcccatctggtgtttttaatggaaaggccccctctggttcaaattgttaagggcggtggtccacccccgggttccc

SEQ ID NO: 82919 - protein, 155 aa, Zea mays
  misc_feature: Ceres CLONE 1568793
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature (138)..(138): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYCGGGGYCGGGGGYXGGNRGGGYGNSDGNWRN

SEQ ID NO: 82920 - DNA, 875 bp, Zea mays
  misc_feature: Ceres CLONE 1568794
  misc_feature: Translation starting site: 287
  misc_feature (603)..(603): n is a, c, t, g, unknown, or other
ctccccgcggtggcggccgctctagaactagtggatcccccgggctgcaggaattcgtctcacccctagaaaaagaatcaccacctctggccactttggcatctgccgatgcgtccactgctcccggccccccgctgcataaatacctcctctcgcggcccattcccacctccccctcctcgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaaccggtgggagcgggtggccgccgatgctgcccgggaggacggcgtccgacgtcgcggcccactacgacgacctggagtgcgatgtcggctgcatcgagccgggcttcgtgcccttcccctgctaccgtaccggcggccgcggccgcccgtcncaatccgcccggggtcacgttcgaactgggaacgccggcgggctgggctttaagcgcctcctgctacttggtccggcgggggcaaagcgcaaacgccggcccgaacaagaagcgcaagaagggccgtcccttggaccggagaaagacaccaagcccgttccttgatgggccttgaaaaaagtaccggggcaaggggaacgggaaggaacttctcccggcaaccttcctgacctagccggaaagcccctcccaaagggggccagcccacgccc

SEQ ID NO: 82921 - DNA, 938 bp, Zea mays
  misc_feature: Ceres CLONE 1568795
  misc_feature: Encodes the peptide sequence at SEQ ID NO. 82922
agctccccgcggtggcggccgctctagaactagtggatcccccgggctgcaggaattcgtctcacccctagaaaaaagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggagatcatcatcgacgtcgagctcgccacccgcctcctccccagggggttcatctggcccgtcgccgcctaccgcgagctcatcaacgggggacctcgtcgtcgacgacaaggacatcggctactactagctgcgcttgttcacctgcttgcactgtgcatatatattgctgctgccgagggcagaccggatcccatgctggctagcgactccacagcttcattttttttactgctcgggttttgcatttgatgtaaccgatccatgaagatttagttaataa

SEQ ID NO: 82922 - protein, 266 aa, Zea mays
  misc_feature: Ceres CLONE 1568795
  misc_feature (42)..(220): Pfam Name: PSI_PsaF Pfam Description: Photosystem I reaction centre subunit III
MAALAAASTAAFAAKPRARLSVACSAATGDSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINGGPRRRRQGHRLLLAALVHLLALCIYIAAAEGRPDPMLASDSTASFFLLLGFCI

SEQ ID NO: 82923 - DNA, 860 bp, Zea mays
  misc_feature: Ceres CLONE 1568796
  misc_feature: Encodes the peptide sequence at SEQ ID NO. 82924
  misc_feature (487)..(487): n is a, c, t, g, unknown, or other
ctccccgcggtggcggccgctctagaactagtggatcccccgggctgcaggaattcgtctcacccctagaaaaaacagcacatcccattcccctcgtctcatctcaagagcgactagagagagagaggaagagaacaagcgataagctcatctcgcacgcaagatgcgggctccaaggggcgcaggcggctgccgcggcggccaggagcatgtggaactgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctcatgcagttcgggaacccgtccggcgacgacgggcccaaggacggcgacgacgggcccggcagcaccccggcgtacggcgtggcggtgtacaacgtgacnacgggcgagtggcggcgggagcgcggcgcgccccccgtgttgccggtgttcgcgcagtgcgcggcggtggggacccgcgtggccgtgctgggcggctgggacccgcgcagcttcgagcccgtggcggacgtgcacgtgctggacgccgccacggggcggtggcgccgcgccgcgcccatgcggtcggcgcgctcctttctcgccttgcgccgaggccgggcgcaagatctacgtgggcgggcgcccacgacaagaccagaaccgcgctcaaaaccgccgaagcctacaagcccgggcccaacccctggacccgctgcccaaaatgtccgaaggaccccaactattggaaaggatgggccaccttcgcgggaaa

SEQ ID NO: 82924 - protein, 232 aa, Zea mays
  misc_feature: Ceres CLONE 1568796
  misc_feature (18)..(65): Pfam Name: F-box Pfam Description: F-box domain
  misc_feature (122)..(169): Pfam Name: Kelch_1 Pfam Description: Kelch motif
MRAPRGAGGCRGGQEHVELIPGIPDDVAVDCLARVPHASHRAMRRVCRGWRSAAAAPAFASARAAAGANEDLVYLMQFGNPSGDDGPKDGDDGPGSTPAYGVAVYNVTTGEWRRERGAPPVLPVFAQCAAVGTRVAVLGGWDPRSFEPVADVHVLDAATGRWRRAAPMRSARSFLALRRGRAQDLRGRAPTTRPEPRSKPPKPTSPGPTPGPAAQNVRRTPTIGKDGPPSRE

SEQ ID NO: 82925 - DNA, 939 bp, Zea mays
  misc_feature: Ceres CLONE 1568797
  misc_feature: Encodes the peptide sequence at SEQ ID NO. 82926
  misc_feature (808)..(808): n is a, c, t, g, unknown, or other
  misc_feature (810)..(810): n is a, c, t, g, unknown, or other
ctccccgcggtggcggccgctctagaactagtggatcccccgggctgcaggaattcgtctcacccctagaaaaaagtagtttcagccttcaggcttccagcgatgtgttcctgcgcctgcgcgcgcctcctccccccgctcttcagccccgctccaagccccaatctcagacccgccttcccgcacagcccgacgccagcccgcagccgcgccgtcgtcgcgctcgcgggcgcagcctcccgggacgacgcgcctgcgccgttgtccagcttcgacttcctcgcactgaagcgggagcttgatgaggaggaggaggcagtggtggctgtggatgcgaaggaaggtgctggagctgtcaatgaggacgatggagagttgggggcggaatggagtgcgggtggtacgaggagacggcggcggaggcagatggcgaggcgatcggctctgcttgcgaagcaggtgattagtgtgacctcggcgcggagcctcgggttcgtgtcgcagctctggatcgacaccgcctcgtgggctgttgcattggttgaagtgaagccaagcttactttcaggtgaagcggagaaattcctttttgaggacatatatcaggttggagacgtggtgcttggtgcgaatgaatctgtgatcgataatgaacataaactggttgggatgcacagcttggtggggctacatgtcgtaacttcccggcgacgcattggtggcaaagtgcgtgggttcacatttgacatcagctcagggtgctatggagtctctcgagcttgactcttttggggcttcgattgtcccntnctagctgggtaacacgtactgtttatttgtcgaaaacgtgctggatatagtctccgatacgtcgtggtgcatgaagacgccgtccacgggttcaacgtttaccaggtcatttgggacccaaactcccgg

SEQ ID NO: 82926 - protein, 226 aa, Zea mays
  misc_feature: Ceres CLONE 1568797
MCSCACARLLPPLFSPAPSPNLRPAFPHSPTPARSRAVVALAGAASRDDAPAPLSSFDFLALKRELDEEEEAVVAVDAKEGAGAVNEDDGELGAEWSAGGTRRRRRRQMARRSALLAKQVISVTSARSLGFVSQLWIDTASWAVALVEVKPSLLSGEAEKFLFEDIYQVGDVVLGANESVIDNEHKLVGMHSLVGLHVVTSRRRIGGKVRGFTFDISSGCYGVSRA

SEQ ID NO: 82927 - DNA, 851 bp, Zea mays
  misc_feature: Ceres CLONE 1568798
  misc_feature: Encodes the peptide sequence at SEQ ID NO. 82928
  misc_feature (424)..(424): n is a, c, t, g, unknown, or other
  misc_feature (819)..(819): n is a, c, t, g, unknown, or other
  misc_feature (821)..(821): n is a, c, t, g, unknown, or other
ctccccgcggtggcggccgctctagaactagtggatcccccgggctgcaggaattcgtctcacccctagaaaaaaccgccacacacaccccgctccaatccaatggcgcctcgccaagccgtcctcgcggtcgtggtcctcgccgcgctgctcccgttcgccctctctcgcgggctgcggcttggccaccaccgcgcccagccgcacccgaggccgcacggccacgcaccgctcggaggtggcgcgtggtcctcggctcacgccaccttctacggcggcggcgatgcgtccggcaccatgggcggggcgtgtgggtacggcaacctctacagccaggggtacggcaccaacacggcggcgctgagcacggcgctcttcaacaacggcctcagctgcggcgcctgcttcgaggtgcggtgcgacncggcggggggcggcggccgctcgtgtctgccgggctccgtcgtggtgacggccaaccaacttcttgccggcccaacaaagcgctcccgtcccaacaaagggcgggttgggggaaacccgcccgggggccccatttttaaaatgtgtggaaacccccgggtttccaaaagaaataggggcctttaaaagggggggggggtttttttcccccccctcccccctccccacggggggggggggggggcaaaaaaaaaaaggagggggggggccctttgttttacccacaaaaaaggggggggcccccccctcttttaataaaagggggggtggggggggaggaaaaaaaaaaaacagaggggggggggggcggccccaccaaaataaaaaaataaaacncngttgtggtggttgtgaaaataagaaaaaaa

SEQ ID NO: 82928 - protein, 168 aa, Zea mays
  misc_feature: Ceres CLONE 1568798
  misc_feature (84)..(147): Pfam Name: DPBB_1 Pfam Description: Rare lipoprotein A (RlpA)-like double-psi beta-barrel
  misc_feature (108)..(108): Xaa is any aa, unknown, or other
MAPRQAVLAVVVLAALLPFALSRGLRLGHHRAQPHPRPHGHAPLGGGAWSSAHATFYGGGDASGTMGGACGYGNLYSQGYGTNTAALSTALFNNGLSCGACFEVRCDXAGGGGRSCLPGSVVVTANQLLAGPTKRSRPNKGRVGGNPPGGPIFKMCGNPRVSKRNRGL

SEQ ID NO: 82929 - DNA, 830 bp, Zea mays
  misc_feature: Ceres CLONE 1568799
  misc_feature: Translation starting site: 134
  misc_feature: SWISSPROT Homolog: EC 4.2.1.20 Tryptophan synthase
tccccgcggtggcggccgctctagaactagtggatcccccgggctgcaggaattcgtctcacccctagaaaaaagcctcatcaatcctcgtacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacggaggtacgacgcggccgccgtcgtcactaccaccaccactgctagagctgcggcggctgctgtcacggttcccgccgccccgccgcaggcgccggcgccggcgccggtgccaccaaagaagcggcggcacccgccgagaggaggagccgtccggtgtcggacaccatggctgcgctcatgcccagggcaagacggcgttcatcccgtacatcacggccggcgaaccggacctagcgacaacggcgaagggctgcgtctgctggaaggcttggcccccacgtcatcgagctgggggtaccctgcctcgaacctatatcgaagggccctaaccaagcgtcggtgggccgggtttttggcaacggaacacccttggaacccgggctcggaaagccccagggagggaacccggaacttgctggcccccggggggcccccccccaaaaaaaaacccccttattgttcccaaacttggggcaaaaaaaaaaaaaggggggggcccccccggcctttaaaggcgcgggattccccccgagggggggccccccccccccctgttgggggggtggtcccccccaaaaaccccc

SEQ ID NO: 82930 - DNA, 853 bp, Zea mays
  misc_feature: Ceres CLONE 1568800
  misc_feature: Encodes the peptide sequence at SEQ ID NO. 82931
ctccccgcggtggcggccgctctagaactagtggatcccccgggctgcaggaattcgtctcacccctagaaaaagctctctcctttgcacccctagctagctagtactactgctgctcctccgacttgctcttcggtttgcttctcttgcctgcctgttgtttcgatccgaatccatctcatgttcttgctgagtttcgcttgatgaccatatatatatatatatatgcttgtttgattttttttctttgcagcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaagctcgagatctcaccctctcatcgacgagttcatacccacaatagatggggaggacggcatatgttacacccacccccaagaaccttccaggtgtgacaaaggatgggctaagcaagcactttcttcaccgggcgttcaagggctacacgacgggcaccaggaagaagagaaagattccgaccggaggggactccacaaggggggagacgaagtggcacaaagacggcaaaacccggcccggggatgtgaaaccgccttcaaaaggggtgcaaaaagatattggggctgtacac

SEQ ID NO: 82931 - protein, 165 aa, Zea mays
  misc_feature: Ceres CLONE 1568800
  misc_feature (43)..(131): Pfam Name: NAM Pfam Description: No apical meristem (NAM) protein
MNRAHSSSSKLINEKLVEHRISTAKHCPHCGEKIDSKPDWVGLPAGVKFDPTDQELIEHLEAKVKDESSRSHPLIDEFIPTIDGEDGICYTHPQEPSRCDKGWAKQALSSPGVQGLHDGHQEEEKDSDRRGLHKGGDEVAQRRQNPARGCETAFKRGAKRYWGCT

SEQ ID NO: 82932 - DNA, 944 bp, Zea mays
  misc_feature: Ceres CLONE 1568801
  misc_feature: Translation starting site: 254
  misc_feature (657)..(657): n is a, c, t, g, unknown, or other
  misc_feature (766)..(766): n is a, c, t, g, unknown, or other
  misc_feature (798)..(798): n is a, c, t, g, unknown, or other
  misc_feature (906)..(906): n is a, c, t, g, unknown, or other
ctccccgcggtggcggccgctctagaactagtggatcccccgggctgcaggaattcgtctcacccctagaaaaagtaggagaggatggatgtgcaaacctagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcagtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaggttccggcggcttccagtgatgtgttcgccacagaacgagcagcacctgctgcaggaacaaacacttaacatacatgctcgtcctcccgagaagaagcagcgggttccgtcngcgtattacagattcatcaaggaagagatacgcaggatcaaagcgaacaaccccgacattatccacagggtagccttcagcacggcagccaagaatggggcacattatncaaacatccatttcagtttagacgactccggncgagagggcaagaagaagctcggtgatcatgaaagcggcggcgtctgtcgtcccaatcgcagcagaaccgactgctgctaaaaaaatcaaggtttctactgatggtancaaaataaatgggacgattgatgaatcctcatcgaccc

SEQ ID NO: 82933 - DNA, 910 bp, Zea mays
  misc_feature: Ceres CLONE 1568803
  misc_feature: Encodes the peptide sequence at SEQ ID NO. 82934
  misc_feature (642)..(642): n is a, c, t, g, unknown, or other
  misc_feature (653)..(653): n is a, c, t, g, unknown, or other
  misc_feature (677)..(677): n is a, c, t, g, unknown, or other
  misc_feature (737)..(737): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaaccttccgccctccgcccaaaaccccacgcgagctcccattcccatccatggcgaccaccacctcttcctcctcgctgaccactcctctcctccgcccgaaccccaataccaaccctgctcccagatctctccaactcctcaggagcaggaggtgcgctcgtgccgtaactaccgccgtagccggaggtgcggtgccttacggggctaatccgcggcgcgggatttggtcgatcagggatgacttggtggtgccaaggtcgccctacttcccagtggagtccgcggcggggcaggagcgtgggccgtcgcccatggtgatggagcggttccagagcgtcgtcagtcagcttttccagcacagaattattcggtgcggaggccccgttgaggatgatatggccaacatcattgtagcacagctgctctacctcgacgctattgatcccaataaggatatcattatgtatgtgaattcgccagggaggtcagtgacagctggaatggctatatttgatacaatgaagcatatcatgcctgatgtatccactgtttgtattggactagctgncagcatgggangcttttctactagtgctgggaccnaaggaagcgatacagcttaccaactcaaggatatgatcccatcacctcctggaggggccnangacaggagactgatcttgaggatcgggccatgagatgctgcaccacaggcgaactaaatgatacctgcatacacactgggcagcccctggatagatcacgtagaactgacgggactactctgagccgaagaagcaagatatggcctatggatgagtacctgatcccccagc

SEQ ID NO: 82934 - protein, 128 aa, Zea mays
  misc_feature: Ceres CLONE 1568803
  misc_feature (1)..(129): Pfam Name: CLP_protease Pfam Description: Clp protease
  misc_feature: SWISSPROT Homolog: EC 3.4.21.92 Endopeptidase Clp
  misc_feature (86)..(86): Xaa is any aa, unknown, or other
  misc_feature (90)..(90): Xaa is any aa, unknown, or other
  misc_feature (98)..(98): Xaa is any aa, unknown, or other
  misc_feature (118)..(118): Xaa is any aa, unknown, or other
MVMERFQSVVSQLFQHRIIRCGGPVEDDMANIIVAQLLYLDAIDPNKDIIMYVNSPGRSVTAGMAIFDTMKHIMPDVSTVCIGLAXSMGXFSTSAGTXGSDTAYQLKDMIPSPPGGAXDRRLILRIGP

SEQ ID NO: 82935 - DNA, 985 bp, Zea mays
  misc_feature: Ceres CLONE 1568805
  misc_feature: Encodes the peptide sequence at SEQ ID NO. 82936
ctccccgcggtggcggccgctctagaactagtggatcccccgggctgcaggaattcgtctcacccctagaaaaaatccattcctccctgtctccgccctcttctgactcccgtaggccgtggtgccgccgccgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgtgacaagacgtcctaccagcttcacgacgacagcaggatgggccacatcaacctcggcctcatgaaccttgatctcaagatgaacgaggctgccgccatgaagctccccttccgtggcatgccctataacatgaaccagatgtacctcaaggggagcaatgccaattccaatgtcaatgcgttcaagatgaaatgttgggggcaacaagtactccaattgtccaaacggggaagaacgccatgggaaaaaaacatggccggcacaccaacaatgggaagcccaacggccccttctgggggttgaaaaagccttccaaaaattgcccaaacaagggaatgctacccgggaaagagaagccctggggggaaacaatctttggccggaaccaccatacccgtggaggggggtttccaagagggcccttttttggtttgcccccaaaaatttttgttttttgcccaaagaaacccccggggggggccctttttcctctaaaaacacacaccccccccttttggggggttttttgagggccccctttttggggggccaattttcccccccctggggggggaaaaaaagggagggggaatttttctcccgccggggg

SEQ ID NO: 82936 - protein, 150 aa, Zea mays
  misc_feature: Ceres CLONE 1568805
MDSLWHLGDELRGQPKVVEDRQWSLMTSKLAEITRSKGERMNTVPDAKQCDKTSYQLHDDSRMGHINLGLMNLDLKMNEAAAMKLPFRGMPYNMNQMYLKGSNANSNVNAFKMKCWGQQVLQLSKRGRTPWEKNMAGTPTMGSPTAPSGG

SEQ ID NO: 82937 - DNA, 836 bp, Zea mays
  misc_feature: Ceres CLONE 1568806
  misc_feature: Encodes the peptide sequence at SEQ ID NO. 82938
ctccccgcggtggcggccgctctagaactagtggatcccccgggctgcaggaattcgtctcacccctagaaaaaactcacacgcccagcaccgcagcacgacaccatcgcgccctggccatcctcccgttcacgtgcacctaccgcacgcaccaccgcggaaagtaaccccgagatccagcgccatcggcacgaccaggcctgtccagggatggggcggagaggggagccctactacgtcgaagcggcgccgccggtggacgtgaacaagaacacagagtggttcatgtacccgggcgtctggaccacctacatcctcctgctcttcttcgcttggctcctcgtcctctccgtctctggttgctcccccggagcagcctggaccgtcgtaaacctcgcgcacttcgccatcacttaccacttcttccattggaagaaaggaaccccttttgctgctgatgaccaaggcatctacagcagattgacatggtgggagcaaattgacaatggtcagcagcttactcggaacagaaagtttttgactgtggtacctgtggtgctgtatctgatcgcatcgcacctgactgactacaagcagccgatgtttttcctcaatacatgggcagtttttgtggctagtgtggcaaaattgccaaacatgcacaaggtccgcatttttggaatcaatggaaactccggaagacccctgcaggaagtacttggatgcaatgcccctgatggggatgaagaactaaacaaaaaaagggggggggttttctcaaatgtgaacaaacgggcttgtaataattgtaccaggtttaggaaaaaactggaaag

SEQ ID NO: 82938 - protein, 208 aa, Zea mays
  misc_feature: Ceres CLONE 1568806
  misc_feature (18)..(161): Pfam Name: ORMDL Pfam Description: ORMDL family
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTWAVFVASVAKLPNMHKVRIFGINGNSGRPLQEVLGCNAPDGDEELNKKRGGVFSNVNKRACNNCTRFRKKLE

SEQ ID NO: 82939 - DNA, 923 bp, Zea mays
  misc_feature: Ceres CLONE 1568808
  misc_feature: Encodes the peptide sequence at SEQ ID NO. 82940
ctccccgcggtggcggccgctctagaactagtggatcccccgggctgcaggaattcgtctcacccctagaaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgaaggctaccgcatcgccggcggcccgctcggcgaagtcgtcgacccgctctaccccggcggcagcttcgacccgctcggcctcgccgacgaccccgaggccttcggcgagctcaaggtcagggagctcagaacggccgccctcgcatgttctccatgttcgggatcttcgtccaggcatccgtcacggggaaggcccgctcgagaacttcgctgaccaaatggcgacccgttcaacaacacgcttggggcctacgcaccactttgtcc

SEQ ID NO: 82940 - protein, 243 aa, Zea mays
  misc_feature: Ceres CLONE 1568808
  misc_feature (65)..(222): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFGELKVRELRTAALACSPCSGSSSRHPSRGRPARELR

SEQ ID NO: 82941 - DNA, 913 bp, Zea mays
  misc_feature: Ceres CLONE 1568809
  misc_feature: Encodes the peptide sequence at SEQ ID NO. 82942
  misc_feature (771)..(771): n is a, c, t, g, unknown, or other
  misc_feature (793)..(793): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaatccattgaaccttatcatttagaggaaggagaagtcgtaacaaggtttccgtaggtgaacctgcggaaggatcattggtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgatggcggtggcggctactgcggtggcggcggctacggtggcggcggcggctactgtggtggtggcggctgctactgcggtgggcaccgtggcggcggctactgcaactccgacgggaactggaggaactgagcggtggggccccgcgcggcaagttatcctgttcgctaccgtgatgtttaccntagtccagaaggtttatcttcnnttcctgtcgtggttgttgttgcccatctgtgtttttgatgcaaagtccctctgggtcagttggtagtgctggggtcatcctcggtttcagcagaccatgcatcaacagctgtggacggg

SEQ ID NO: 82942 - protein, 155 aa, Zea mays
  misc_feature: Ceres CLONE 1568809
  misc_feature (10)..(81): Pfam Name: RRM_1 Pfam Description: RNA recognition motif. (a.k.a. RRM, RBD, or RNP domain)
  misc_feature (48)..(145): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYCGGGRRDGGGGYCGGGGYGGGGGYCGGGGCYCGGHRGGGYCNSDGNWRN

SEQ ID NO: 82943 - DNA, 947 bp, Zea mays
  misc_feature: Ceres CLONE 1568810
  misc_feature: Translation starting site: 167
  misc_feature: Pfam Name: GHMP_kinases_N Pfam Description: GHMP kinases N terminal domain
  misc_feature: SWISSPROT Homolog: EC 4.1.1.33 Diphosphomevalonate decarboxylase
  misc_feature (649)..(649): n is a, c, t, g, unknown, or other
  misc_feature (756)..(756): n is a, c, t, g, unknown, or other
ggagctccccgcggtggcggccgctctagaactagtggatcccccgggctgcaggaattcgtctcacccctagaaaaaaaacaggtcggacggaccctttgccggagacgagcacacgccacagcaggaattatcgggcgtagagcagcgcgaagcgagagatccaatggcggcggcggaggggcagtgggtgctcatggcaacggggcggacgccgactaacattgcggtgatcaagtactgggggaagcgggacgaggcgctcatcctccccatcaacgacagcatcagcgtaacgctcgaccctgaccatctctccgccaccaccactgtcgccgtcagcccctcattcccttccgaccgcatgtggctcaatggcaaggagatctcgctattaggaggaaggtttcagagctgcctcagagaaatcagaaagcgtctcgtgactttgaggacaaggagaagggcgtcaagatcaagaaagaggactgggacaagttgcatgttcacatagcctcgtacaacaacttccccactgctgctggtttggcctcttcggctgctggccttgcctgtttcgttttcacccttggaaagctgatgaatgtgaaagaagattatggagaactttcttcatagcaaggcaggnatctgggagtgcatgccgcagtatatatgggtgtttttgtgaaatggtgcatgggagaaaagatgatggaagtgacagtattgccgtgcagcttgctgacgaacacnactggaatgatcttgtatttattattgcatgggcagttcaagcagaagaaaccagtagcacagtgggatgcgagatagtgttgaaacagtcctctctgcagtacaggcccaaacgtggggccaggtcgggtgttgaaatgaagaagctttcagaccgtgacttgaatctttgccaaattactggggcgata

SEQ ID NO: 82944 - DNA, 791 bp, Zea mays
  misc_feature: Ceres CLONE 1568811
  misc_feature: Encodes the peptide sequence at SEQ ID NO. 82945
  misc_feature (258)..(258): n is a, c, t, g, unknown, or other
  misc_feature (750)..(750): n is a, c, t, g, unknown, or other
ctccccgcggtggcggccgctctagaactagtggatcccccgggctgcaggaattcgtctcacccctagaaaaagcgtagcagcagagagccagagaccagagatggccgccctcgccgccgcctccacggccgccttcgccgcgaagccgcgcgcgcgcctctcctgtggcctgggctccgccgccacggcgacagcagcagcgtgtcgctcgcgtcctcgtgagacgtctccgcgcgctggcgctgtctcgtgctngtgtctgggcgccactccctcgccggggcgcgaatcgggggtgacccgtgcaagagtcaaggcgtcgccagcccagagaatcgatcaagagctaccgcgtcctgaaaaataacgcccaaaggcccccggggttccattaagccccattggaaaaacaaaggccggttcaaaaaaacggaaatcgggtggtggtgggggccaaagggttggccaccccttttttagggggaaaaaaggggactgggggggaaatttttcccccgggggggggtttttttttaaaatccccgggggattataagggggggccaggagaaccccctccccccccccccggggaaaaaaaaccccccccggggggaaaaaatttttggggggggggcccccccccccccccctcccccgggggggtttatttgggcgccccccccccccccgggggttttttaggggggggcccccctcccacaaaaaaaaaagggggttataaanggggggggggttcccccgggggggggcgaataaaattttgg

SEQ ID NO: 82945 - protein, 88 aa, Zea mays
  misc_feature: Ceres CLONE 1568811
  misc_feature (52)..(52): Xaa is any aa, unknown, or other
MAALAAASTAAFAAKPRARLSCGLGSAATATAAACRSRPRETSPRAGAVSCXCLGATPSPGRESGVTRARVKASPAQRIDQELPRPEK

SEQ ID NO: 82946 - DNA, 929 bp, Zea mays
  misc_feature: Ceres CLONE 1568813
  misc_feature: Encodes the peptide sequence at SEQ ID NO. 82947
  misc_feature (797)..(797): n is a, c, t, g, unknown, or other
  misc_feature (876)..(876): n is a, c, t, g, unknown, or other
agctccccgcggtggcggccgctctagaactagtggatcccccgggctgcaggaattcgtctcacccctagaaaaaatcgggatgggatttcagctctcgatggatgaggaattctactgacatgacaacattggcaaccacttacataatacctgtggacttgaacacatttctttttaagatggagctggatattggtgccttggctaaagtcgtaggagataatgcgacttcagaattttttttaaatgcttcgaaagcacgtcatattgcaattgactctattttgtggaactctgagatggaacagtggcttgactattggcttcctggtgatgcagactgtcaggaagtacacgaatggaagcctaactcacagaaccgcaacatatttgcttccaacttcgttccgctgtggctaaatgcataccattccgaattcgtacgctttgctgatgaggcaaaatcaaacagagtcatggcgagcctcaaggcatctggattacttcatgccgcagggatagcaacttccctgacaaacacgagccaacaatgggatttcccgaatggatgggccccactgcagcatcttatagctgaggggctgctgcattctggatcagaggccaaaaaactagctgaggacattgctacgaggtgggtgagaacgaactacgccgcttacaaagcaacgggtgcgatgcatgagaagtacgatgttgaggcttgtggagaatctggaggcggtggaggatacaagccccagactggtttttgctggtcccaatggcgtggntgtgtcatttctggaaagaattcggtgggcagaagggcaaggaaataacttgttgagcggcgagcgctcccgacagggntggatctggtcttgccggaaaagcatcctggttaggcatcgttcatgtcacaa

SEQ ID NO: 82947 - protein, 246 aa, Zea mays
  misc_feature: Ceres CLONE 1568813
  misc_feature (1)..(241): Pfam Name: Trehalase Pfam Description: Trehalase
  misc_feature: SWISSPROT Homolog: EC 3.2.1.28 Alpha,alpha-trehalase
MRNSTDMTTLATTYIIPVDLNTFLFKMELDIGALAKVVGDNATSEFFLNASKARHIAIDSILWNSEMEQWLDYWLPGDADCQEVHEWKPNSQNRNIFASNFVPLWLNAYHSEFVRFADEAKSNRVMASLKASGLLHAAGIATSLTNTSQQWDFPNGWAPLQHLIAEGLLHSGSEAKKLAEDIATRWVRTNYAAYKATGAMHEKYDVEACGESGGGGGYKPQTGFCWSQWRGCVISGKNSVGRRARK

SEQ ID NO: 82948 - DNA, 948 bp, Zea mays
  misc_feature: Ceres CLONE 1568814
  misc_feature: Encodes the peptide sequence at SEQ ID NO. 82949
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (693)..(693): n is a, c, t, g, unknown, or other
  misc_feature (698)..(698): n is a, c, t, g, unknown, or other
  misc_feature (755)..(755): n is a, c, t, g, unknown, or other
  misc_feature (756)..(756): n is a, c, t, g, unknown, or other
  misc_feature (779)..(779): n is a, c, t, g, unknown, or other
  misc_feature (817)..(817): n is a, c, t, g, unknown, or other
  misc_feature (818)..(818): n is a, c, t, g, unknown, or other
  misc_feature (867)..(867): n is a, c, t, g, unknown, or other
  misc_feature (906)..(906): n is a, c, t, g, unknown, or other
ggagctccccgcggtggcggccgctctagaactagtggatcccccgggctgcaggaattcgtctcacccctagaaaaaattctcactcctcccactggcggtcggttcccacgcccgcccaacgccttcgcggtcgtccttgccatggccgtgcaagggcggcacctgtcgcacgacctagcagcccaggcggccggcggctacctgttcctggacgagtacgccgggtgcgcgccggccccggccccggcccggatcggggacgccacgacggcgctcagcgacttcccgcgcgtcgaggttgcctggtgcaactacgacggcttcctgccgaggaagcggccgcgcctggagacggcggcgccagcagcgggcggtggtctcttggaagaccagcgcgcgggtttgcctccggcgggcacggagctcctgctgccactgccagtggcaccgttcgtcgacgcgcggagccgccgggcggttgcggcctccggcacggcgtccaccagtgggagggtggcaagtggcgcgaccgtggcggcctcgcggggactgctgtcgtcgtggacgcaccgccacggcgtggagatcgacgcgctcgttagacttgaggcagagaagatgcgcgcggcgctggaggaggcgcggcggcggcacgcccgcgcgctgtggcnnnncnttgggggcgcgccncgtcngggcggctgcgcgcgtcggagacggacctcgagcgcgcgctccggcgcggcgcggannttgggaagagaatgcccggcagncgggcgccgaatgcccagccttggatgggcgtcgcccnnaaagcaccaggcccgccgccgctggccctcgcggcacgcgtggacagcntctggagccaaccctgggtgcgccggcggggggcccccnagagaaaggcggtaaggcccaaggacccctatccttggttct

SEQ ID NO: 82949 - protein, 258 aa, Zea mays
  misc_feature: Ceres CLONE 1568814
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (185)..(185): Xaa is any aa, unknown, or other
  misc_feature (204)..(204): Xaa is any aa, unknown, or other
  misc_feature (212)..(212): Xaa is any aa, unknown, or other
  misc_feature (225)..(225): Xaa is any aa, unknown, or other
MAVQGRHLSHDLAAQAAGGYLFLDEYAGCAPAPAPARIGDATTALSDFPRVEVAWCNYDGFLPRKRPRLETAAPAAGGGLLEDQRAGLPPAGTELLLPLPVAPFVDARSRRAVAASGTASTSGRVASGATVAASRGLLSSWTHRHGVEIDALVRLEAEKMRAALEEARRRHARALWXXXGGAPRXGGCARRRRTSSARSGAARXLGRECPAXGRRMPSLGWASPXKHQARRRWPSRHAWTASGANPGCAGGGPPRERR

SEQ ID NO: 82950 - DNA, 914 bp, Zea mays
  misc_feature: Ceres CLONE 1568815
  misc_feature: Encodes the peptide sequence at SEQ ID NO. 82951
  misc_feature (768)..(768): n is a, c, t, g, unknown, or other
  misc_feature (786)..(786): n is a, c, t, g, unknown, or other
  misc_feature (839)..(839): n is a, c, t, g, unknown, or other
  misc_feature (865)..(865): n is a, c, t, g, unknown, or other
ctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattngtcccagattggattgcnttgttaagctcaaaaaaaaaaaaaaaaaagagccagaccatagctgcagcttncatccacgaactcccgtctcatttcnaggcatgggcgtgtcgatcgagctcaccaggagtacggctcgtcgtgct

SEQ ID NO: 82951 - protein, 167 aa, Zea mays
  misc_feature: Ceres CLONE 1568815
  misc_feature (1)..(164): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDDASVVFAYYKDGATNPTFLYFSHGLKEIKC

SEQ ID NO: 82952 - DNA, 1333 bp, Zea mays
  misc_feature: Ceres CLONE 1568816
  misc_feature: SWISSPROT Homolog: EC 3.6.3.14 H(+)-transporting two-sector ATPase
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (723)..(723): n is a, c, t, g, unknown, or other
  misc_feature (783)..(783): n is a, c, t, g, unknown, or other
  misc_feature (1027)..(1027): n is a, c, t, g, unknown, or other
  misc_feature (1089)..(1089): n is a, c, t, g, unknown, or other
  misc_feature (1108)..(1108): n is a, c, t, g, unknown, or other
  misc_feature (1318)..(1318): n is a, c, t, g, unknown, or other
gtattggcactnnnttttttgttgtctttttccttcctcttttgttcccgcgttttttttttctttctttttttaactggagctccccgcggtggcggccgctctagaactagtggatcccccgggctgcaggaattcgtctcacccctagaaaaagtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcaactccttcaggaacacgcaaaagatcacggacgccatgaagctggtggccgccgccaaaggtccggcgcgcgcaggaagccgtcgtctcctctcgcccttcctcggaggcgctgggggaggtgctctacaaaatgaaccacccccacccggaggggaggacatcgaacttgcggcctaacccggcaccccgccccgttcaagaaagggtggcccttcaagggtcctggacacagcgaaacccccgccctccagcgggggaggctttcaatcaagcgaacggggcctccaatgaatggtcggggaaaacccccgtcatgccgaattaaagctctcaaatgctaggcctgggggggcccttcccaaggagaacaacctccgatcggntctcctagccgtcgggggggcgaaaaaccaaatggggggcaatatggggtcgtttaactntatactctcagggtcgggcgcgaggcgacacccttttagacgatatgccctacagttgtgttggtggaaatgccaccctcaggaaatgtcgtttgtaatagaaaagggcgcggtggatagagtcatgatgcccgcgtttggggcacccccccacatccccgggttatccaaaaaaagggggatacactttcgcccggacagaggggtagcggctcttcttccctgtgcgcgcagatatcaccgntcaaggagaccgtgtaatatcttcgcgcgcttttcttattccactatcgcacgagccgccgntagagaaataaagtgtccncacaatacaaacagagagtggagaagaacctagggacgtccgtataatacttccgcaagatgattattaagaaataggtctgacgtagtggacaaccccacctcctcccaaaaacctcgcgataccatatgtgcaaaatagacacgtggagccccccgcactaaggattctctgtcgcataaggagtgatgaaagtaagtgtccgctaanacctttgaagagctg

SEQ ID NO: 82953 - DNA, 919 bp, Zea mays
  misc_feature: Ceres CLONE 1568821
  misc_feature: Encodes the peptide sequence at SEQ ID NO. 82954
  misc_feature (767)..(767): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaactcctcattcactttccaagttgtccgaaaagaccagactaccctgttcccccgaagtcagagggggagaggaggctagggatagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggctgtggcggtggcggccgctctgtaccacgttgtgtcggggctcttcgcggccccgcccccgccgccgccgcgcccacgggaggagcccgagacagagccgctccctcctcccgtgcagatgggggaggtctccgaggaggacctccgccagtacgacggctccgaccctaagaagccgctcctcatggccatcaagggccagatctacgacgtcacccagagcagaatgttctatggacctggcggaccttacgccctgttcgccggcaaagatgccagcagagctctagcgaagatgtcgttcgagccacaggacctcaccggcgacatctcgggcctaggtccgtttgagctcgacgccctgcaggactgggagtacaagttcatgagcaagtacgtgaaggtcggcacgtcaagaagagcgtccctgtggtatgcggcagcaccgcgagcaccactgtagctgatnaggcaccgactaccgaagagagccatncgaggcggggggtttgaggagtaggaagccgccggcctatgaaggtgccccagaaaactagagcttttctgtgcatgcggcaattattcgacatggtcccattccgggtcctgtcaagaccctgc

SEQ ID NO: 82954 - protein, 181 aa, Zea mays
  misc_feature: Ceres CLONE 1568821
  misc_feature (70)..(167): Pfam Name: Cyt-b5 Pfam Description: Cytochrome b5-like Heme/Steroid binding domain
MAVVELWETLKQAIVAYTGLSPAAFFTAVAVAAALYHVVSGLFAAPPPPPPRPREEPETEPLPPPVQMGEVSEEDLRQYDGSDPKKPLLMAIKGQIYDVTQSRMFYGPGGPYALFAGKDASRALAKMSFEPQDLTGDISGLGPFELDALQDWEYKFMSKYVKVGTSRRASLWYAAAPRAPL

SEQ ID NO: 82955 - DNA, 948 bp, Zea mays
  misc_feature: Ceres CLONE 1568822
  misc_feature: Encodes the peptide sequence at SEQ ID NO. 82956
  misc_feature (717)..(717): n is a, c, t, g, unknown, or other
ctccccgcggtggcggccgctctagaactagtggatcccccgggctgcaggaattcgtctcacccctagaaaaactgtgatgtaacacttatgtcactggcatatgccgggacaggaaatgtgcttaaggttcagaaacttcttggcatttgctcacagcatcttgagaaaggtgaaacacaccaagggccagctgtcctagggattgctcttattgctatggctgaagaattaggagctgaaatggctgtacgttcacttgagcgtcttctgcagtatggcgagcagaatataagacgggcagtccctcttgctcttggtatactctgcatatctaatcccaaggtaaacgttatggacacactaagcagattgagtcatgatgcagacgccgatgtgtcgatggctgcaattatctcattgggtttgattggtgctggcacaaacaatgccagaatagctggcatgcttcgcaatctttcaagttattactacaaagaagctgctcatctgttttgtgttagaattgcccagggccttgttcacctcggaaagggcttgttgaccctttccccataccattccgatagatttcttctctccccgatggcacttgggggccttgttaccgttctccacgcgtgccttgatatgaagtccacatcctagggaaataccactacatcctctacattattgtcctggcatgcagcccangatgcttttgactgtcgacgaggatctgaagcccctgtcagtacctgtccgcgtcggacaagctgtcaacttggttggtcaggcaggaaaggccaatacaatcccgggtttcagaccactcaacccggttctgcttcagcaggggaaaagcttacttgcaactgaaaataattccactgaccccatactaaaggcttttggattttgaaaaaacccaagtccccgaaagtg

SEQ ID NO: 82956 - protein, 192 aa, Zea mays
  misc_feature: Ceres CLONE 1568822
  misc_feature (106)..(140): Pfam Name: PC_rep Pfam Description: Proteasome/cyclosome repeat
MSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTS

SEQ ID NO: 82957 - DNA, 858 bp, Zea mays
  misc_feature: Ceres CLONE 1568823
  misc_feature (312)..(312): n is a, c, t, g, unknown, or other
  misc_feature (838)..(838): n is a, c, t, g, unknown, or other
ctccccgcggtggcggccgctctagaactagtggatcccccgggctgcaggaattcgtctcacccctagaaaaagtaggagaggatggatgtgcaaacctagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccatatcgcgccggcagatcatgtgtgctatgtgcactgcagcttcgngcacacagttctcgcggtgagtgtcccggggaatagcatgctccacatcgtgacagttcggtgtggacactgcgcaaatctactgtcagttgaccctgaaaagactgacccccctccccccccagaaaaagaatcttccgcccccggaaaaaatcaagggccatgggcttccaaggggctttttcaagaaaaaaatcaggccggcccttttggaacaacccgggttctctctcccccccaaagggttcccggggggtttcccctggtttttgttcccccccaaaaaaagaaaaaccccccttggttggggaaaaaaaaccctttttaaaaaaagtggttcgccccccccccaaaaaaaaagaaacggggggttctcccccccgcgggttttaaaaactactccccccgggaggagagatataccccccgaggtaaatagttggcgggaaaaacccccccccctttttttccgggggggaggattcctcttccggggggcgggcaaaaaaaaaagtgggggggcctntcttttttatacaacccccc

SEQ ID NO: 82958 - DNA, 907 bp, Zea mays
  misc_feature: Ceres CLONE 1568826
  misc_feature: Translation starting site: 153
  misc_feature: SWISSPROT Homolog: EC 1.11.1.11 L-ascorbate peroxidase
  misc_feature: SWISSPROT Homolog: EC 1.11.1.7 Peroxidase
  misc_feature (754)..(754): n is a, c, t, g, unknown, or other
  misc_feature (757)..(757): n is a, c, t, g, unknown, or other
  misc_feature (758)..(758): n is a, c, t, g, unknown, or other
  misc_feature (761)..(761): n is a, c, t, g, unknown, or other
  misc_feature (810)..(810): n is a, c, t, g, unknown, or other
  misc_feature (835)..(835): n is a, c, t, g, unknown, or other
tccccgcggtggcggccgctctagaactagtggatcccccgggctgcaggaattcgtctcacccctagaaaaagcccccagcagatcttgtgaccctcgctcagccgcgtcgcgtcccatcctacgatccaaaggtctctctgctcgcagccatggcgaagaactacccgaccgtgagcgccgagtacagcgaggctgtcgagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccacccccggtagggatgacaagcctcatcccccacctgaggggcgccttcctgacgccactaagggttctgaccacctgaggcaagtttttggcaagcagatgggcttgagcgatcaggacattgttgccctctctggtggccacaccttgggaaggtgccacaagagcggtctgggtttcgaggggcctggactacaaaccctttgggtcttgacactcttacttcaaggacttctgagtggtgataaggaaggcntcnntcnctccccagtgacaaagcctgctgagcgaccctgtttccgcctcttgtcnagaattgctgcggatgagaggcttncttgatgacacaagagccacctcagctccccgacgggggttgtgatgctaaatgacctatctggaggaacat

SEQ ID NO: 82959 - DNA, 924 bp, Zea mays
  misc_feature: Ceres CLONE 1568827
  misc_feature: Encodes the peptide sequence at SEQ ID NO. 82960
  misc_feature (700)..(700): n is a, c, t, g, unknown, or other
  misc_feature (791)..(791): n is a, c, t, g, unknown, or other
  misc_feature (794)..(794): n is a, c, t, g, unknown, or other
  misc_feature (832)..(832): n is a, c, t, g, unknown, or other
tccccgcggtggcggccgctctagaactagtggatcccccgggctgcaggaattcgtctcacccctagaaaaaagccagcgccaaccccggaaaggcggaaacccatcgcaactaatccccaaccccaaacctccaatccacccatcccctcctcatccactccgggcggccatggcctgctccttcgccgccgcgaccgtcgtctcttccgcccccaccccggccgccaggcccctcgccgctgccccgcagtccgtctctgtttcccgctccgcggtcgccaccgccgccaggccgctccgcctcgtcgcctccagatccgcgcgggccatcagactcgtcgcccgcgccggcggcgtcgatgacttgccgctggtcgggaacaaggcgccagacttcgaagccgaggccgtgttcgaccaagagttcatcaacgtgaagctctctgattacatcgggaagaaatacgtcgttctgttcttctaccccttggatttcacctttgtctgcccgaccgagattactgccttcagtgacagatatgaggaattcgagaagttgaacactgaggttcttggtgtctctattgacagtgtgttctcccaccttgcatgggtgcagacagacaggaagtctggtgggcttggcgatcttaaataccacttatttctgatgtcaccaaatcaatttcaaaggccntcggtgtctgatccctgacagggtatcgctctgagaagaactgtcatcattgacaaggagggagtgattcagcactctaccattaataccnttngcattggtcgcagtgtggaacaaaacatgaagaacctncaggcattgcagtacgtccaggagacccaaaacaagtctgccccgccgtttggaaccaggggtagaagtccatgaagcccgacccaaagtaa

SEQ ID NO: 82960 - protein, 181 aa, Zea mays
  misc_feature: Ceres CLONE 1568827
  misc_feature (69)..(164): Pfam Name: AhpC-TSA Pfam Description: AhpC/TSA family
  misc_feature: SWISSPROT Homolog: EC 1.11.1.15 Peroxiredoxin
MACSFAAATVVSSAPTPAARPLAAAPQSVSVSRSAVATAARPLRLVASRSARAIRLVARAGGVDDLPLVGNKAPDFEAEAVFDQEFINVKLSDYIGKKYVVLFFYPLDFTFVCPTEITAFSDRYEEFEKLNTEVLGVSIDSVFSHLAWVQTDRKSGGLGDLKYHLFLMSPNQFQRPSVSDP

SEQ ID NO: 82961 - DNA, 885 bp, Zea mays
  misc_feature: Ceres CLONE 1568828
  misc_feature: Encodes the peptide sequence at SEQ ID NO. 82962
  misc_feature (491)..(491): n is a, c, t, g, unknown, or other
  misc_feature (567)..(567): n is a, c, t, g, unknown, or other
  misc_feature (599)..(599): n is a, c, t, g, unknown, or other
  misc_feature (600)..(600): n is a, c, t, g, unknown, or other
  misc_feature (609)..(609): n is a, c, t, g, unknown, or other
ctccccgcggtggcggccgctctagaactagtggatcccccgggctgcaggaattcgtctcacccctagaaaaaacggccgccctagcttccccacattcagctccttcgccgccgccctagctttcccgcgagcgggacggcagccgccgtatcctccttcctccaataacgagcgggtccaggcaggtagcatcctcgcgcccctgtcgtgtcgcctccgcctctgagttcagctcgccggcagccgccgctcgcaatggaggccctccggaaagcggaggcggagctcacggtgtacgtgcacccctccaacgccaagcgcgtccggcacgccgtctcccgccagctcagcgcgcttctcttcacgtatgtggaccgttttgatggcgtgttgctgatgcatgaagtttcattccttattggcaaagacaaagagggcaaacccatatatgaaaggagtgaccgtaatgatcaaattgctgaacccgntttctatggcaaaatcatgaatggcttggtgccatatttcagcgtccaagtgcatgccaccctgctgctcttctcntcccagccggacatgatcctggaagggatggnntgaatgctncggaaagagtcattcatgccattgtattaagggtttctcagtggcattatgtctgaagatataagttcaaattcaaatggaaaaggattgaagaaaatttgtgagccctcccgaataaaaaccccctgacacaacgaccccactggtcttcaatcaggagccctcgaatttcgtccccgcacattagcggaaagaaccccctacaccaccccaagcaaaaagggggaatgtttctgcaacggatcctaaccggggaagggggcctgccgcgcctaa

SEQ ID NO: 82962 - protein, 113 aa, Zea mays
  misc_feature: Ceres CLONE 1568828
  misc_feature (10)..(102): Pfam Name: RNA_pol_Rpb7_N Pfam Description: RNA polymerase Rpb7-like, N-terminal domain
  misc_feature (78)..(78): Xaa is any aa, unknown, or other
MEALRKAEAELTVYVHPSNAKRVRHAVSRQLSALLFTYVDRFDGVLLMHEVSFLIGKDKEGKPIYERSDRNDQIAEPXFYGKIMNGLVPYFSVQVHATLLLFSSQPDMILEGM

SEQ ID NO: 82963 - DNA, 874 bp, Zea mays
  misc_feature: Ceres CLONE 1568830
  misc_feature: Encodes the peptide sequence at SEQ ID NO. 82964
  misc_feature (597)..(597): n is a, c, t, g, unknown, or other
ctccccgcggtggcggccgctctagaactagtggatcccccgggctgcaggaattcgtctcacccctagaaaaaacgcgcagcagcaacccggtagcaggagcgcagccagcaagctcaggcccccagccctactgccaccgcgccgaacgacatggccgagccggcggagcaccgtccagctgaggaggaggaggccgcggcggccggcgaggatgaggacaccggcgcccaggtcgcgcccatcgtgaagctggaggaggtcgccgttaccactggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgaccgcgagctcaaagaagagatgtttgctatccgtttttgatctgtcgagaattgcaagaangtcaaggacactgttggaaaagatagctgaacagcaaggaaagagcgaagagaaagaaaatgatgaagtctccactgcccgcttctgatttggcacagaaagttacagtgggcagagcccagcaaggaggaaatgcagagaaagaggagctcctgcatccgatgattagaggatgctaaagagggagggtgaaggccaacagggtcaaatggatgccattccattctttcgtttccagggtcagcctccccccaaatttccttgggtttccccaaaa

SEQ ID NO: 82964 - protein, 140 aa, Zea mays
  misc_feature: Ceres CLONE 1568830
  misc_feature (38)..(141): Pfam Name: Ran_BP1 Pfam Description: RanBP1 domain
MAEPAEHRPAEEEEAAAAGEDEDTGAQVAPIVKLEEVAVTTGEEDEDALLDMKAKLYRFDKEGNQWKERGTGTVKLLKHKDTAKVRLVMRQAKTLKICANHLVVATTKMQEHAGSDKSCVWHALDFADRELKEEMFAIRF

SEQ ID NO: 82965 - DNA, 911 bp, Zea mays
  misc_feature: Ceres CLONE 1568832
  misc_feature: Encodes the peptide sequence at SEQ ID NO. 82966
  misc_feature (499)..(499): n is a, c, t, g, unknown, or other
  misc_feature (562)..(562): n is a, c, t, g, unknown, or other
ctccccgcggtggcggccgctctagaactagtggatcccccgggctgcaggaattcgtctcacccctagaaaaaggaaaggcgtggaggccgtctccgagctgtgggatcggtacctcctgcagtttgctggcgatcccaagctccggccggaaaggctagcagagctgatcggagcaattccggcaagtgaccggaagacgcacgaccacttgtacgaagcaatcaacacatatttagtggagcaccggggtctgtccggggaggagaaggcgacgctgtgcggccacctggattgccggaagctgtcgcacgaggcgtgcgtccaggccgtgcagaacgagcggatgccgctccggctgatcgtgcaggcgctgttcgtgcagcagatgcacacgcaccgcgccttcacggagtgctccgactcgttccggtgcacgcgctcaggggagctcgtcccgggcgccggcgggtacacgccgagccccgggtgcccccgncatccccaccagccagcccctgagcggcagcagcccgtacgaaaggcacccacacgccccggngcgacgccaagctccggcgccgggaacgacgcttcgtcggactacgagaacggccagcttcaggaatcaggccctggaccagggaatcttctcgcttaaacggaccctggaagggggacaaaccctggaggggttcggcccccggctcccggggaaggcaaaggacccaaatttcggggtcccccaaaaaacggggccgccggggaactataaaggtagaaaccagggtcccggagggggtattgggccctgggggggggggccccaaccccgggggccccagaggaacccgggccttttcccaagagacccctttttttgggaggggggctcccggggggaaaacaaa

SEQ ID NO: 82966 - protein, 104 aa, Zea mays
  misc_feature: Ceres CLONE 1568832
  misc_feature: SWISSPROT Homolog: EC 3.1.21.4 Type II site-specific deoxyribonuclease
MPLRLIVQALFVQQMHTHRAFTECSDSFRCTRSGELVPGAGGYTPSPGCPRHPHQPAPERQQPVRKAPTRPGATPSSGAGNDASSDYENGQLQESGPGPGNLLA

SEQ ID NO: 82967 - DNA, 872 bp, Zea mays
  misc_feature: Ceres CLONE 1568836
  misc_feature: Encodes the peptide sequence at SEQ ID NO. 82968
  misc_feature (742)..(742): n is a, c, t, g, unknown, or other
ggagctccccgcggtggcggccgctctagaatagtggatcccccgggctgcaggaattcgtctcacccctagaaaaaaacgtgctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctcaaggcggaggcaagggggagtggctcccggggcttccctccccggctacttaaagggacctgccggggaaaatggtttcacccttgggcccggggggaaccccgaaaacttggggggttctcccgggaactttgaaaaggggggggggaatttgggggggggggaattttttcccgggggggtccaaaggggggggtttttatcccccccctggtgtcccccccccggtagaaattttttttcccccccccccccccggggggagaaaaaaacctctctctttccccagaaaaaagggggggggggggggaaaaaaaaaaaaagggggggggacccccccttcctctttttttttatattcccccccccccgggggggggggggggggccccctggggttttttttcctttcctcccctccccccccaaaaaaaaaaaaaaaaaaaaaggggggggggggggggtgggggtgggtgtttacctncccccccccacagaagggggggggggggggtttttttttttctcttcttccctcaaaaaaaaaaaaaaaattggtgtggggggtgggggggggggggtagagaaaaagtttaaaaaaaaaatcaaatttt

SEQ ID NO: 82968 - protein, 85 aa, Zea mays
  misc_feature: Ceres CLONE 1568836
MASVTARAPVAALRPSSSSAFLGHSSRLGRTATASPTRRSLKAEARGSGSRGFPPRLLKGTCRGKWFHPWARGEPRKLGGFSREL

SEQ ID NO: 82969 - DNA, 874 bp, Zea mays
  misc_feature: Ceres CLONE 1568837
  misc_feature: Encodes the peptide sequence at SEQ ID NO. 82970
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (625)..(625): n is a, c, t, g, unknown, or other
ccccgcggtggcggccgctctagaactagtggatcccccgggctgcaggaattcgtctcacccctagaaaaaactccaatccaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgagtgtggggggnnnnnnnnnnnnnnnnnnnnnnnnnnncccggctnnngggngggaaacctggtcattttgctagagagtgcccatctgggggatggtgggagagggacaatattgggtgggagagtgacagggttgggggcccggggaagggggcccccctaattgggatccagccgagggtgggaccactcgcctggcgtgacccaacaagcgcacccgaaaggggggcttattcaaacatgctggaaccctgtggggaccccagggaagaccattttcttcaaaaaccgaggctggat

SEQ ID NO: 82970 - protein, 219 aa, Zea mays
  misc_feature: Ceres CLONE 1568837
  misc_feature (9)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (123)..(123): Xaa is any aa, unknown, or other
  misc_feature (124)..(124): Xaa is any aa, unknown, or other
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (131)..(131): Xaa is any aa, unknown, or other
  misc_feature (132)..(132): Xaa is any aa, unknown, or other
  misc_feature (135)..(135): Xaa is any aa, unknown, or other
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRVWGXXXXXXXXXXRLXGGKPGHFARECPSGGWWERDNIGWESDRVGGPGKGAPLIGIQPRVGPLAWRDPTSAPERGAYSNMLEPCGDPREDHFLQKPRLD

SEQ ID NO: 82971 - DNA, 889 bp, Zea mays
  misc_feature: Ceres CLONE 1568838
  misc_feature: Encodes the peptide sequence at SEQ ID NO. 82972
  misc_feature (755)..(755): n is a, c, t, g, unknown, or other
  misc_feature (760)..(760): n is a, c, t, g, unknown, or other
  misc_feature (767)..(767): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (879)..(879): n is a, c, t, g, unknown, or other
  misc_feature (880)..(880): n is a, c, t, g, unknown, or other
ggagctccccgcggtggcggccgctctagaactagtggatcccccgggctgcaggaattcgtctcacccctagaaaaagccactcccctcccgtccctatggcggccgttaccacagccactgccgccgcgtcctcctcctccttcctccaccgccgaagccccgcctgcctgcgcgccacgctccgcgccgcgccgcggcactgccgcaactccagctccaggctcgcctgccgcgccgccgaggtgtccggggccgagtcgtcctcggccgcggcggagggcgcgggaggaggcgggggcgcgtcgtgggtgcccgtggtgccgctcgccgcgctgccgcgcggagagcgccgcgtgatcgtgcaggacggggaggagatcctgctgctctggtacaagaaccaggtcttcgccatcgagaaccggtcgccagcggagggcgcctacaccgagggcctcctcaacgccaagctcacgcaggacgggtgcattgtttgtccatcaacagacagcacatttgaccttcgcaccggggagataaaagaatggtatccgaaaaaccctgtcctacgggctcttacgccagccttgaggaaactattcacctaccgcgtgaaaacagacgaagaaacatatacatcagcttcagcggggccgatggtgcggggtcagcggagattatattcagcgggaaagctcagcctggtgtgactgcatcggatgtcaatgtggaaagagtgaggatggtcgtcnacaangatgtcngaaggctcnnngctcacagtgacacgagctgatcacggaaaagccgccatatcggcttcctcctgctgatgatttcgagcttctactggcaagggcctctcaggggacgggnntctggactt

SEQ ID NO: 82972 - protein, 204 aa, Zea mays
  misc_feature: Ceres CLONE 1568838
MAAVTTATAAASSSSFLHRRSPACLRATLRAAPRHCRNSSSRLACRAAEVSGAESSSAAAEGAGGGGGASWVPVVPLAALPRGERRVIVQDGEEILLLWYKNQVFAIENRSPAEGAYTEGLLNAKLTQDGCIVCPSTDSTFDLRTGEIKEWYPKNPVLRALTPALRKLFTYRVKTDEETYTSASAGPMVRGQRRLYSAGKLSLV

SEQ ID NO: 82973 - DNA, 916 bp, Zea mays
  misc_feature: Ceres CLONE 1568840
  misc_feature: Encodes the peptide sequence at SEQ ID NO. 82974
  misc_feature (734)..(734): n is a, c, t, g, unknown, or other
  misc_feature (739)..(739): n is a, c, t, g, unknown, or other
  misc_feature (740)..(740): n is a, c, t, g, unknown, or other
ctccccgcggtggcggccgctctagaactagtggatcccccgggctgcaggaattcgtctcacccctagaaaaactcttcttcccgcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccctctttttgggtcttcccgtattgaacaagcccacgttgagcaatggatggattttgccgcaacagaagttgatcctggtgttgcatggtacttgtatccaaggcttgggtacctcccttatgttagcacaactgaggaaacagctatttcttcattgaagaggtcgcttggtgctctgaacacacaccttgcttcaaacacataccttgttgggcatgctgttactctagctgacattgtaatgacatgcaacctctaccatggaattgcacggatcttgaccatgacttcacgtctgatttcctcatgtcgagagtatttctggacatggntaacnnagctactcagaaggtcattggtgagtcaagcaggcagatctgcacctctattcgaaaatgctgctcctctaagagccaaagcaaggatgtcagaaggagctcaaagaggccctatgcaatgtggtgagcactgcttagagagccctagcaatgctagaatctctgactgctgcact

SEQ ID NO: 82974 - protein, 253 aa, Zea mays
  misc_feature: Ceres CLONE 1568840
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (193)..(193): Xaa is any aa, unknown, or other
  misc_feature (195)..(195): Xaa is any aa, unknown, or other
MALVLHSGAGNKNAFKALIAAEYSGIKVELTKDFEMGVSNKTPEFLKMNPLGKVPVLETPDGPVFESNAIARYVARLKDDNPLFGSSRIEQAHVEQWMDFAATEVDPGVAWYLYPRLGYLPYVSTTEETAISSLKRSLGALNTHLASNTYLVGHAVTLADIVMTCNLYHGIARILTMTSRLISSCREYFWTWXTXLLRRSLVSQAGRSAPLFENAAPLRAKARMSEGAQRGPMQCGEHCLESPSNARISDCCT

SEQ ID NO: 82975 - DNA, 861 bp, Zea mays
  misc_feature: Ceres CLONE 1568841
  misc_feature: Encodes the peptide sequence at SEQ ID NO. 82976
  misc_feature (441)..(441): n is a, c, t, g, unknown, or other
ctccccgcggtggcggccgctctagaactagtggatcccccgggctgcaggaattcgtctcacccctagaaaaaaccgagcaatcgcgcgcggccgccgaggtgccaaggcggcggcggtcggtcggtctgcgatatacgatggcggcgccttactacggaggtcctccggcggcgccggcccccgtggcggtggtgtccccgcagttctgtgcgccgtacgtggtgcccctgacggtgaccaagaaggccatcagcctctccgacggcgacttcaccgtcaccgacgccaacggcgccaccgtgctgcaggtcaagggcgccgtcttcagtatccgccaccgccgcgtcctcctcgacgccgccggccagcccatcctcaccatgctggagaaggtattcagcatgcacaacagatgggaggtgttcagaggggacagcntcgaacgagagcgacctgctcttcaccgcgaagaaaatcctcgaatattccagctgaagaccgaagattggacatcttcctgggcctccacaccgcgcaacaggtgtgcgacttcaagatcaagggcacctacttcgaaaaggggtgggcctcttacttggaaatccggagtttgatcccccaaataaaccgcctttttccctcccaatgtgctctttgaaagaaacctttggggtcccttggtccccccctttaaaacagtgttcccccccccctttgttgggaaaccggggagaaatcttttgggaaagccccccccttggaagaaaacccccccccccccccccaattttttccccaccgttgtgccaacaattgtttttgttgttttttttccccccccgcggttttttttttttt

SEQ ID NO: 82976 - protein, 158 aa, Zea mays
  misc_feature: Ceres CLONE 1568841
  misc_feature (16)..(143): Pfam Name: DUF567 Pfam Description: Protein of unknown function (DUF567)
  misc_feature (101)..(101): Xaa is any aa, unknown, or other
MAAPYYGGPPAAPAPVAVVSPQFCAPYVVPLTVTKKAISLSDGDFTVTDANGATVLQVKGAVFSIRHRRVLLDAAGQPILTMLEKVFSMHNRWEVFRGDSXERERPALHREENPRIFQLKTEDWTSSWASTPRNRCATSRSRAPTSKRGGPLTWKSGV

SEQ ID NO: 82977 - DNA, 1025 bp, Zea mays
  misc_feature: Ceres CLONE 1568842
  misc_feature (337)..(337): n is a, c, t, g, unknown, or other
  misc_feature (531)..(531): n is a, c, t, g, unknown, or other
  misc_feature (621)..(621): n is a, c, t, g, unknown, or other
  misc_feature (732)..(732): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (781)..(781): n is a, c, t, g, unknown, or other
  misc_feature (782)..(782): n is a, c, t, g, unknown, or other
  misc_feature (811)..(811): n is a, c, t, g, unknown, or other
  misc_feature (812)..(812): n is a, c, t, g, unknown, or other
  misc_feature (864)..(864): n is a, c, t, g, unknown, or other
  misc_feature (865)..(865): n is a, c, t, g, unknown, or other
  misc_feature (892)..(892): n is a, c, t, g, unknown, or other
  misc_feature (904)..(904): n is a, c, t, g, unknown, or other
  misc_feature (932)..(932): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (947)..(947): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (996)..(996): n is a, c, t, g, unknown, or other
  misc_feature (998)..(998): n is a, c, t, g, unknown, or other
  misc_feature (1005)..(1005): n is a, c, t, g, unknown, or other
ctccccgcggtggcggccgctctagaactagtggatcccccgggctgcaggaattcgtctcacccctagaaaaattcctcccgagtcgcctccccctcaagttccacaaacgcaagccccaatctcgccgtcaccacctcaatccagcaaacgcataccccatctcgccgccgccgcgatgtctcgccgctatgacagcgcacgaagaatctttctggcgggagggcgtccctccccggtggaatacccttgggagggattggaaaacccggggcaccccccggggttctagggggcagaggggggggccccccgggggaaaaaaagggggcccccnaatcccccaaaaccccgccccccagaaaaaaaaataaaaaaaacccccccggggggggggggggggggggttttttttaaaaaaaatttttttttatacccccccccccccccacaaagaaggggctctcttaaaaaaaaaaacccccgcggggggggtcccctcctcctctctctcagaggggggggggcgcncttggggggggcccccccccccccggtggtttttttttttggggggggggggggggaggaaattttttttttcttttttatattatacanaaaaaggggagggggggggggggggggggtgttttgggggtccccccccccccccccctccccaaaaaaaaataaaagaaaaggggggggggggggggggcggggggcccncccttttatttttttcttcttcccccccacccatagaggggggtnnntnnttatgttgtgtgtttgggggggtgtgtgnncccaattttcttttcttacttttattataacccaaccccccccacccccccnnggcggcggggggggggggggggggagnggtttatgggtntgttgttttttgttgttttatttttttnttcgcgcnnnccccncgnnnnnncnnnnnaaaaaaaaaaaaaaaaaaaaaaaaaaaaaaaaaananaaaatgntccctcccccctcgcgcccc

SEQ ID NO: 82978 - DNA, 861 bp, Zea mays
  misc_feature: Ceres CLONE 1568844
ctccccgcggtggcggccgctctagaactagtggatcccccgggctgcaggaattcgtctcacccctagaaaaactagaaaaaaagcaagctcctcctctcccgcaaacacccacgcccactccatcgctcctctcctccaacatcgctcacgcggtctcctctccccgctcagctccgctcccggagacacgcaagcttcccgttcccgggaacacgcactaaagatgcctccagccttcgccgccgcaccttcctcctcgatatgtggcgttcgcatcccaactgtgcgccgtttcgaagcgcaaagcacggtttccacgcccagatttctgcgtaatcgggtggcagcaaaaacacggtctacatcagcttggtccttgaaggctggcttgtgggattctctcagatctggccttttgaagaataatagcagtacagagacagtagagccaccaccagcaccacttgaagtggaagagcctttgcctgtggaaatagtactcctagaaagaacactacctgatggaagtacagaacaaattttattttcttcagccggagatggtgatgtatatgatctccaagccttatgcgataaggtaggatggccacgcaggccctcttcaagatagcagcctcataagaaatagctactggggtgctacactatattcaatattagatcttcagaacagagggagaagagagaaacgctcattgggagggacgagcaactcagacatgccttcatgaacgaattgggatgtcctggtgaccctctacccgggtcagggcctgggaaaggcccagggaaaaaaatccgactttgccccaagaaccccaaacatttaacggtggg

SEQ ID NO: 82979 - DNA, 877 bp, Zea mays
  misc_feature: Ceres CLONE 1568845
  misc_feature: Translation starting site: 166
ctggagctccccgcggtggcggccgctctagaactagtggatcccccgggctgcaggaattcgtctcacccctagaaaaaagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcatacccctggagatcattcacctgctcaccgatgccaacccccatcaggtcgtcgtcgacgcgatcatcaacagtggccccccgtgaggatgccacccgttattgttccccctggtggttttgagaaggcaggcctttggatatcctcacccctgaaggaagggggaccaagggcatcctacttcctccccactggggccaagggaaatggcttcccggaacttaaaacccttgccaatgggccttgcaaataaactaaataacctggccaaggggccttcccaaaagttccccccccaaaaaaattgggccgggtggccaaaggccaaccctgaaagggggctgggttccccgggggccccctgggcggggaaactttttatgggtgggggagagcaaaacgggtccccggttttccaaaggtgttaagggttttttgagacc

SEQ ID NO: 82980 - DNA, 1124 bp, Zea mays
  misc_feature: Ceres CLONE 1568847
  misc_feature: Encodes the peptide sequence at SEQ ID NO. 82981
  misc_feature (696)..(696): n is a, c, t, g, unknown, or other
  misc_feature (773)..(773): n is a, c, t, g, unknown, or other
  misc_feature (804)..(804): n is a, c, t, g, unknown, or other
  misc_feature (866)..(866): n is a, c, t, g, unknown, or other
  misc_feature (949)..(949): n is a, c, t, g, unknown, or other
  misc_feature (1030)..(1030): n is a, c, t, g, unknown, or other
gcggtggcggccgctctagaactagtggatcccccgggctgcaggaattcgtctcacccctagaaaaacaggcaccggcagaccaaagcctcgctcggaccggtcgaccacaccaccaatggacgccgaggctccgctcctcctccccatcgacattaccatcgtgccgtcggcgccctcctcctcctcctcctccccttccacccggagcatcgtcctccgcatagcggccgtgctcgccgtggcgtgcgcgtccctgctagcgcagcacgaggccagcaagggcttcgcagtcgccgtcgcgaacgacgcggcgcggggcagcgcggcggcgcggcgcttccacctgcacttggcgtccaacggccgcgccgagagcatcctcctgcacgccagccgcgccgtggagcgcgcgctgttcccggacgcgtggttcccgcgcagggaggtggggcgcggtgaccgtccgggaggggccgcgcgcaacctcaccgcggggcgccgggcgccactggagcggcgccgccggcgccgggggggaaaacgtctgggggcccttaaacccccgggacctcgtaagccgctttactcgggtcgggcgcccaaacgaacgcccgccggaggggtgtacagcgagcgggccccccctagcggtatcacgcacgcattgggggggtctccgggagaaaacgcccnaccgaagaaccccgccactaccacgtcgggctgacccgacggaaggggctaggtgggcgcgaactccctctttccgnccgcccgcgcggcgcacgcgccgaacataantcaaggttcggcttgccgtcccaccgtaaattaactgacgacaaatacgaccgcaacccagngatgcgccgccgagttactcacgcggagcaaagccaacccagtaggacgaaggacaaaaggcggagggtccggttcagcaacnaccaatcaggacccgggaccacactcctgtgagacggactaatatgctcgcggcagacagcactactccaaacatacagancgtgcgtttagtggatcgcggattgacggcgcgtgcgggcgcacctccgcgtcggtagcgcgacgagacggaacgcccagctcgctccctaccg

SEQ ID NO: 82981 - protein, 203 aa, Zea mays
  misc_feature: Ceres CLONE 1568847
  misc_feature (193)..(193): Xaa is any aa, unknown, or other
MDAEAPLLLPIDITIVPSAPSSSSSSPSTRSIVLRIAAVLAVACASLLAQHEASKGFAVAVANDAARGSAAARRFHLHLASNGRAESILLHASRAVERALFPDAWFPRREVGRGDRPGGAARNLTAGRRAPLERRRRRRGGKRLGALKPPGPRKPLYSGRAPKRTPAGGVYSERAPPSGITHALGGSPGENAXPKNPATTTSG

SEQ ID NO: 82982 - DNA, 1071 bp, Zea mays
  misc_feature: Ceres CLONE 1568851
  misc_feature: Encodes the peptide sequence at SEQ ID NO. 82983
gctctgaatagtggatcccccgggctgaggaattcgtctccccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcaaggcctccaaggtagagcccccccctccaccaattcaccgggaccctcgacaagaaacccccccacaaaaccggtttaaaatgctttccccaatatccgggcctgaaaaacaaggcttgcccaaaaagggagaaggtttccgaaaaaagcggccccaaggctggaaaatttgaaaggaaaaaacctggtttaagtcccaaaaaaaaaccaatttgggtggggtaaaagtattggggctctttaaacccatggtgggaaactttacccctctcatttggaagcaaaaaatacacaaggggctttcaaagtcttgtggtgttgtgccacatcccccttcatttagaaagcggtgggaatttccccaaattttgttaaaccgggtgtttgtggtggggtggcctctcccccacctcccctgttttgtctcctgaataagatagtggggggggtgcccccttttactctggcgcttgggtgtttataagggaaaaatagggctctccccccttggggaaatctcaattgtggttcccccataaggaaaaaaatggcaattccggtccctggtgtgtcttccccccctcgtgctcacaataacagaaagagatatagtctttgtagttttccacccaagatattttgtgggggccttttttttaggcgaaatttttctacccaacaaatctctccaataaggtcttgagaaaaaatatgtggggaggtgggacttttgcgtgtacccaaactcccagcgc

SEQ ID NO: 82983 - protein, 90 aa, Zea mays
  misc_feature: Ceres CLONE 1568851
MAPKRGGRAPVPAKKKTDKVTNPLFEKRPKQFGIGGALPPKKDLHRFVKWPKVVRIQRQRRILKQGLQGRAPPSTNSPGPSTRNPPTKPV

SEQ ID NO: 82984 - DNA, 855 bp, Zea mays
  misc_feature: Ceres CLONE 1568852
  misc_feature: Encodes the peptide sequence at SEQ ID NO. 82985
  misc_feature (437)..(437): n is a, c, t, g, unknown, or other
tccccgcggtggcggccgctctagaactagtggatcccccgtggctgcagggaattcgtctcacccctagaaaaaactgcatcagagcacgaccacactacccacccacctccactactgaccgattcccagaaagctcgatctagcgcgcgcggctgcagagtgcagacgacgacgtacaccatggcgcggcggtccctggccctgctgctcgcgtcgtcgctcgccctcatgtcggccgccgtcgcatcggcggactcgtggctctacgacaagttcaacacggacggcaccgtccgcacccagtacgacgcgtcggggcaggaggtggcgatgctcagcctggaccgcagctccgggcgcggctttcactcctaggagcagtacctgtacggcgagttcagcgtccagatgatgctcatccccggctactccgnctgcaccgtctcgtgcttctaactctcgtcgggcgacgcgaacgggacaacgagacgacatgtagtcatgggcaaagcgagcgggcagccggtgttgctgaaacctaacgtgggggccaccggcgaacgaaaatgggacacatttccacccctgggtggacccctccgcgaattaccaaccttaacctttttgggaacccaaccaaatcccgttcaaaggggaaggggaaatgtatccggggcttaaaggttaccccaactgtgcgtacccaagggggggggcctggggctttcacccccccggggggaaggggccctctgggccccccaaaaaggaaaaggggcccggggaaattttcccccccccccctttttgtttcccttcgggggggtaaccccccaaaaaccgggggtttgg

SEQ ID NO: 82985 - protein, 64 aa, Zea mays
  misc_feature: Ceres CLONE 1568852
MARRSLALLLASSLALMSAAVASADSWLYDKFNTDGTVRTQYDASGQEVAMLSLDRSSGRGFHS

SEQ ID NO: 82986 - DNA, 892 bp, Zea mays
  misc_feature: Ceres CLONE 1568853
  misc_feature: Encodes the peptide sequence at SEQ ID NO. 82987
tggagctccccgcggtggcggccgctctagaactagtggatcccccgggctgcaggaattcgtctcacccctagaaaaagcccttcccagcctctcgctctcccgccgacgcgcacgtcctccgcgccgagcccagaggcagacagaggacgcggccatggcgtccatcccgtgcaccttccagctgagcacggcggcgtcgaggagggtgtcgccgcgggtggcggcgcagggagaggccaaggaggagggggagcggtgctgaggacgccgctgctgggcgcggggaggcggggcctggggtggctgcggccgtcgcggttgagccgcgtggtgccggcgagcgagagcgggcgggcgggtcccacctgctggttcaagttcggcaacaaggacgccgagggtgccggcatctacggcagccaggccagggacgacttcgaccgcgacgacgtcgagcagtacttcaactacatggggatgctgggcggtggagggcacctacgacaagatggaggcgctgctgaaccaggacattcaccccgtggacatcctcctcatgctggcagcctccgagggcgaccgcccccagatcgaggagctgctccgcgccggcgccaggttcgacgtcaagggactccaaaggccggacggcgctcgaccggggcaccgacaagaaccgagagttcattcctcggctccgccggccagaagggctggaacgacaatgggcaagtcaatccgggcccgggtccttcgggaattttggggggccagggaaacaaaaatcccccccttttccggaaacggggggaggtccccccgggggggaaacaacggtgttggaaagggaacttttcccaaaaccgcgtgtttcctacgagaaaaaggg

SEQ ID NO: 82987 - protein, 127 aa, Zea mays
  misc_feature: Ceres CLONE 1568853
MEALLNQDIHPVDILLMLAASEGDRPQIEELLRAGARFDVKGLQRPDGARPGHRQEPRVHSSAPPARRAGTTMGKSIRARVLREFWGARETKIPPFSGNGGRSPRGGNNGVGKGTFPKTACFLREKG

SEQ ID NO: 82988 - DNA, 921 bp, Zea mays
  misc_feature: Ceres CLONE 1568854
  misc_feature: Translation starting site: 141
ctccccgcggtggcggccgctctagaactagtggatcccccgggctgcaggaattcgtctcacccctagaaaaaaccgagcaatcgcgcgcggccgccgaggtgccaaggcggcggcggtcggtcggtctgcgatatacgatggcggcgccttactacggaggtcctccggcggcgccggcccccgtggcggtggtgtccccgcagttctgtgcgccgtacgtggtgcccctgacggtgaccaagaaggccatcagcctctccgacggcgacttcaccgtcaccgacgccaacggcgccaccgtgctgcaggtcaagggcgccgtcttcagtatccgccaccgccgcgtcctcctcgacgccgccggccagcccatcctcaccatgctggagaaggtattcagcatgcacaacagatgggaggtgttcagaggggacagctcgaacgagagcgacctgctcttcaccgcgaagaaatcctcgatattccagctgaagacggagatggacatcttcctggcctccacaccgcgcagcaggtgtgcgacttcaagatcaagggcagctacttcgagaggtcgtgcgccttctacctcggcaactccagcagcatgatcgcccagatgaaccgccagtttaccgtcaccaatgtgctgcttggaaggacacgttgggcgtcactgtgttcccgcacgttgactacgtgttcgtcgctgctctttgtgtgatactggatgagattcatagggaacggtccgactgaggaacatacacacacaccacaagctttctcaccgttgctcgacatgctatgctattatcatcatcacggttatcttgtcaatatatacttcccaggatgttttgtaagtttaatgagtaatacacttccccggatcaaatggtttaaaaaggggccaaa

SEQ ID NO: 82989 - DNA, 924 bp, Zea mays
  misc_feature: Ceres CLONE 1568856
  misc_feature: Encodes the peptide sequence at SEQ ID NO. 82990
tggagctccccgcggtggcggccgctctagaactagtggatcccccgggctgcaggaattcgtctcacccctagaaaaaatacccttcccatttctcgtggcgcccacgggccacggccacgccgtagatctcctcctcgtcgcagggctccggcggtctcgccggcggtgagctgaagcgatggagctctggagcaagctgcgaaacctggatgcctacccgaaagtgaacgaggacttctacagccgcaccctctccggcggtctcatcaccatcctctcctccctcgccatcctcctcctcttcttctccgagatccgactttatctatattctgccacggaaagtaagctcactgttgatacctcgagaggggaaagactacatatcaattttgatgttacgttcccggcccttccttgttctctagttgctgttgatacgatggatgtcagtggagagcaacattatgatataaggcatgacataataaagaaaagaattgatcatcttggtaatgtaattgaatcaagaaaagacggagttggtgcccctaagattgaaagaccgttacagaagcatggcggtaggcttgaccacaacgaggtttactgtggatcttgttatggtgctgaggagtcggatgatcagtgttgcaactcctgtgaagaagttcgtgatgcgtatcgaaagaaagggtgggctgtcaacaacgtagaattaattgatcagtggcagaagggaggctatgtacaaagggtaaaagatgaacaaggggaaggatgtaccatccatgggatttggtaatggtgaataaagtagctgggcaacttttcactttgccccctggggaaaattttggggacagtcattcaaccttcctgacaggacctggttgaaactcccaacccggaaccttacat

SEQ ID NO: 82990 - protein, 208 aa, Zea mays
  misc_feature: Ceres CLONE 1568856
MELWSKLRNLDAYPKVNEDFYSRTLSGGLITILSSLAILLLFFSEIRLYLYSATESKLTVDTSRGERLHINFDVTFPALPCSLVAVDTMDVSGEQHYDIRHDIIKKRIDHLGNVIESRKDGVGAPKIERPLQKHGGRLDHNEVYCGSCYGAEESDDQCCNSCEEVRDAYRKKGWAVNNVELIDQWQKGGYVQRVKDEQGEGCTIHGIW

SEQ ID NO: 82991 - DNA, 967 bp, Zea mays
  misc_feature: Ceres CLONE 1568857
  misc_feature: Translation starting site: 163
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (655)..(655): n is a, c, t, g, unknown, or other
  misc_feature (656)..(656): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
  misc_feature (671)..(671): n is a, c, t, g, unknown, or other
  misc_feature (681)..(681): n is a, c, t, g, unknown, or other
  misc_feature (683)..(683): n is a, c, t, g, unknown, or other
  misc_feature (685)..(685): n is a, c, t, g, unknown, or other
ctggagctccccgcggtggcggccgctctagaactagtggatcccccgggctgcaggaattcgtctcacccctagaaaaaaggtaatccgacggaaacgacaagggcgcggcgagggcggggacagggtcggggaggccctgggcgcgggggcgccaagcgcatggcatcgtcgagggtgatgccgtcgtcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgaggtcgccggccccggcgccggaggtcgccacgcggaggacggcggaggaaggtgtggaaggagatcaccggcggaggtggcagtggggaacccgtgccccccgtggcggctcaggctgccgtccccgcttggtggtggtggcgcctgcggcccggagatgacgctggagtttttccttgggccagggaggagggcgcggtgaaggagtgggggttttagggggttttcgggccccctctgcgccggccatggggttcctgggcggagcggaggggcgtgggtgtgcgnnnnnnnncnntaagcngnnannggnaaagaaaacngnanctcatggattcaagtggatcgcgccgcgatgcagcgacagatacggatgatcaaataccgcgaatctgctgcccggtcacggggagaggaagcagggctatttccgcagaactaaaaatcgctgggtaacgcccctcgaggaggaaaaatgccaagttgttgaaaatacaggaatgacggcaccagaagcggctttaagagcccctggaaagggggaccccgtcattctgaggaaaaaacctcgggagaacttagaaagaagaacccattgccgggggttgt

SEQ ID NO: 82992 - DNA, 1317 bp, Zea mays
  misc_feature: Ceres CLONE 1568860
  misc_feature (47)..(47): n is a, c, t, g, unknown, or other
  misc_feature (56)..(56): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
aatcaatgttcactcttttgtgtcggttcacatactttcatccccgncccgggggnggggttcnnnnttaaactggagctccccgcgggggcggccgctctagaactagtggatcccccgggctgcaggaattcgtctcacccctagaaaaaaaacctccttggacacgactcgccgcacccatcccaatccgccgccgctgccatggccgacgagattgacactatgccggctcccgcgggctcccgcggccgatcctgcgcacgctaccgaggacgacgacagggaggagggcgagatcgccaccgacgcccgctgcgtcgggcttcccggcgcgaaccacgtcgagcacacagggacctgctggggtccacaacccgcccggaaacaacaacatggcctgctgggggagctccataagacccatccacaccttccccaccaaaaaagggatttttggggccttgtaaataacccccccgcggcactaccagttgaacccggcggagccttaatttgccttggcttccagaaccaggatttgagccccaaatggggaagaacccgatctggtgcctaatggccgtggagaaaggaaccctcccgctttgttgttaaaggagggaaacatccgagacgcgccttgtgggggggccacacccgagctggggcctatgggatccgggcgaaaacaaattcccaactttatggtcctcattgtaaaatcttcggtgcgcgcccatggtggtttcataccgccttcctttagacggtggggagagggtaagaaagatgaagtcgcttctcctttcggcgtagctacagaaaatcagtctttggggtgataatgagccaaagaacactggcgccctgaggcaaattagatcgtctgttttatccgggatgagacgacgtggggggcagaaaggaggataactttgctctcggggagaccgtgtaacacgtaggagcgcctctccggtgtgggaggaattcatatatcgtctattccactgaatacacgagatgttctcaccgctaacttatgttgcatctcactgtgggtgaatgctgaacgagagacaacgcgaataatcctgtgtgtgttgaagtgctcgcgcaagaatggattgttatacacctcccgactgggaggttgggtttctgtatgcgacaactttgctgatttacacagtccctcccctaatggggtcatcataaaggagtcttatcactctgcaccgaagtggagagggctctagaacgtattgggcacaacccgagcgcgtgcaacgtgttccccccctattatgtgcg

SEQ ID NO: 82993 - DNA, 921 bp, Zea mays
  misc_feature: Ceres CLONE 1568861
  misc_feature: Encodes the peptide sequence at SEQ ID NO. 82994
  misc_feature (697)..(697): n is a, c, t, g, unknown, or other
  misc_feature (801)..(801): n is a, c, t, g, unknown, or other
  misc_feature (847)..(847): n is a, c, t, g, unknown, or other
  misc_feature (848)..(848): n is a, c, t, g, unknown, or other
ctccccgcggtggcggccgctctagaactagtggatcccccgggctgcaggaattcgtctcacccctagaaaaagactcctcgcaaccgccggccgactcgagcagcgccccagcagcctctgctccgctgcctctggcgaccgccggagcccgaggaggaggaggagggaagatctcgctcgatccaaggaggtgagtacaagatggtgagctcctcgtcgccggtggtcaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccatcctcacatactgctcctgcaaatcggtaatacattctgcaaacttcctggtggacggttgaagcctggagaaaatgaaatcgagggtttgaaaagaaagttatgcagcaaacttgctgtgaactcgccttcctttccacctaactggcaggttggagagtgcgttgctgtgtggtggaggccgaactttgagactgtgatgtatccttactgtcctccacatatcactaagcccaaggagtgcaagaaacttttcattgttcacctatccgaaagagagtattttgctgttccaaggaatctgnaactgcttgctgttccactgtttgaactctacgacaatgttcagaggtacgggcctgtcatctctacatcccgcagcagctttctaggttcagtttcacatggntagctcttagggtgatgatacaagaaaaccatgtgggcaggcagcnntctcgtgctgactagctgatcacgtaccctgactgattttatccattgtgctggattttttaaatagactaca

SEQ ID NO: 82994 - protein, 199 aa, Zea mays
  misc_feature: Ceres CLONE 1568861
  misc_feature (165)..(165): Xaa is any aa, unknown, or other
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLXLLAVPLFELYDNVQRYGPVISTSRSSFLGSVSHG

SEQ ID NO: 82995 - DNA, 933 bp, Zea mays
  misc_feature: Ceres CLONE 1568864
  misc_feature: Encodes the peptide sequence at SEQ ID NO. 82996
  misc_feature (762)..(762): n is a, c, t, g, unknown, or other
  misc_feature (856)..(856): n is a, c, t, g, unknown, or other
ctccccgcggtggcggccgctctagaactagtggatcccccgggctgcaggaattcgtctcacccctagaaaaacttcccatgcaccgcccgctgccgtgcccgccctgccctccaccttctcccggcgcaataaacaagtcgaggcgaggcgaggcggcagcggcggcggcggcattgccgagatttccgtgattcttgcgcttgttagttgtgctgtgtatagttgggccggccgggggtggttccgtacagttccttctctgttggagtagtcggcggcgatgggtatcctcgcgctcatcaccggcaaggcgggcgccagcgggttcgggtcggcgtccacggcggagcatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctaaacatcctgataaataatgcaggcgtcatgttctgcccttttcactgtctaaaaacggggtcgagatgcagttcgcgacaatcatctcggacactttctgcttaccaatctcctccttgataccatgaaggccactgccnagtctacgggcattgagggcccgcatgtgaactgtcatcagtcgcccaccacatacgtatcccgaaggaaattgactcgattacctcacgatgnagaaatatacacgaccaaatggcttatgggacagtctagctggcgaacttgctgcatgcgaagaagctctctagaag

SEQ ID NO: 82996 - protein, 152 aa, Zea mays
  misc_feature: Ceres CLONE 1568864
  misc_feature (34)..(149): Pfam Name: adh_short Pfam Description: short chain dehydrogenase
  misc_feature: SWISSPROT Homolog: EC 1.3.1.33 Protochlorophyllide reductase
MGILALITGKAGASGFGSASTAEHVTDGADASRLTVAITGGASGIGLETSRVFALRGAHVVIAARNTEAASEARKTIMEKNPTARIDVLKLDLSSLKSVRAFVDQFNSMKLPLNILINNAGVMFCPFHCLKTGSRCSSRQSSRTLSAYQSPP

SEQ ID NO: 82997 - DNA, 859 bp, Zea mays
  misc_feature: Ceres CLONE 1568865
  misc_feature: Encodes the peptide sequence at SEQ ID NO. 82998
  misc_feature (157)..(157): n is a, c, t, g, unknown, or other
ggagctccccgcggtggcggccgctctagaactagtggatcccccgggctgcaggaattcgtctcacccctagaaaaagctcgctccctccctccctccctcccgcgcggatcacagaagggctcacggtcacggccggcctcccaattcgcaaccntcgcctccgcctctcctcctaccccctccgaaaagcaagctccggccgggccgccaccaccaccacctgcgcgcgcgtgcacgcgctcccacacacagacagacagacagacagacagagtgagagacgcacggtggttcggggtctcccttctgccaggcgcacgaggagccatggcgcagcgcgacaagaatggagagccccacgagctccgggcgccggagatcacgctgtgcgccaaacactgcgggttcccgggtaaccccggccacgcagaaccctgtgccagaactgcttctcggcgtcgaagttcgccgtcgtccccctaccctcctcctcctctttccctggggttccggcggggttcccaacccaaaggcagcaagccctccttcttaaaaccccgccaaccggtgggagggccctggccccctcccgggggcccccggggccccggggccaagggcccaggtttaacgaaaccccccgggaaaggggggtcccccaaaaaccggggctcccacactttccccaaaaaaaccccggggggctttaaaagggggtttcccgggggcccccctcgcgggagaaaatctttttttggggggggggcccccccgcgtgtttcttttaataaccgggacggggggggggtacgcttctccaaaaaatcaagagggggggggccccccccccccgaag

SEQ ID NO: 82998 - protein, 176 aa, Zea mays
  misc_feature: Ceres CLONE 1568865
MAQRDKNGEPHELRAPEITLCAKHCGFPGNPGHAEPCARTASRRRSSPSSPYPPPPLSLGFRRGSQPKGSKPSFLKPRQPVGGPWPPPGGPRGPGAKGPGLTKPPGKGGSPKNRGSHTFPKKTPGGFKRGFPGGPPRGRKSFFGGGAPPRVSFNNRDGGGVRFSKKSRGGGPPPPE

SEQ ID NO: 82999 - DNA, 914 bp, Zea mays
  misc_feature: Ceres CLONE 1568866
  misc_feature: Translation starting site: 122
  misc_feature (674)..(674): n is a, c, t, g, unknown, or other
  misc_feature (787)..(787): n is a, c, t, g, unknown, or other
ctccccgcggtggcggccgctctagaactagtggatcccccgggctgcaggaattcgtctcacccctagaaaaaccccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcatgatccagggctactcgctcgccaagggcatgggcgtcgggaagcacatcgccagcgacaccttcaccgtcggcggctaccagtgggcgatctacttctacccagacgggaagaaccccgaggacaactccggctacgtctcggtcttcatcgcgctcgcgtccgacgggcaccgacgtgcgtgcgctcttcgagctcacgcttctagaccagagtggcaagggcaagcacaaggtgcactcgcactttgaccgctccctagagtccggaccgtacaccctcaagtaccgcggatccatgtggggctataaaaggttctttcggcgtaatgctcttgagcaatcagattttctttaagatgattgctttgagataaactgtactgtggggtgttgtagtatncactatgggatattcccaggccacattcatagagggtccagagtctgacataggctatcatttttgaactcttttggacactctggaaggtgtagatgtcattttttagtganccaggagagaagtccatgcccataagttggtattggctgcccgatcttcctttttaatctgaattttcgacctgaatctgagagaaaagaacgaactggtcagggatgaaatcaggaaatcgtattg

SEQ ID NO: 83000 - DNA, 911 bp, Zea mays
  misc_feature: Ceres CLONE 1568867
  misc_feature: Encodes the peptide sequence at SEQ ID NO. 83001
  misc_feature (688)..(688): n is a, c, t, g, unknown, or other
tccccgcggtggcggccgctctagaactagtggatcccccgggctgcaggaattcgtctcacccctagaaaaaaggcccagccatcctctctcgcacacagacactcgttcgccgtctcagccacagccagagagcaccgacactcaggccaggccgatcaatgggcaagaagagcggccgcagcggcgccgacgcgcccaaggcgacggcgttcgtgctgaaggtggcgatgcactgccgctgcgacggctgcgtccccaagatccgcgccgcggtcaacaaactgacgctccggtgcgagggcatccagtcgctggaccagtcggcgctggacaccaagggcgaactggcgctggtggccacggcggacccggagaggctgcgccgccgcctgcgcgaggccacggggaagagcgtcgacatcgtcttccccaagcccgcagcggccaacggcggcagcagcggcagggaggaggcgaacgccgccgtccaggctcaggctcaggcccaggcccaggcccaggcgctgctgctcgccgccggtctgcaacagcagcagcagcacggccgtccctggtacgcctccagcaggggtgggtacggcccgccgccggagccgtacgtggcttcctaccccgccacccgcgtggggcgcgtacccacacaacggcctcgatgacgcctacngcggcggatggttcgggtactgagcgaccgggcgagagtagagcagcggatggagctttttgaggtcgggtactgagcgaccggcgagagcagacagcggatggagcttttgcgttgtgtagtgtgtcaatggtgatgtccgcacgtgagtactgtagtgatctgggatagcaggactgacaaaaatgggtggggttgggtgttgttgaacaaccattgtttt

SEQ ID NO: 83001 - protein, 172 aa, Zea mays
  misc_feature: Ceres CLONE 1568867
MGKKSGRSGADAPKATAFVLKVAMHCRCDGCVPKIRAAVNKLTLRCEGIQSLDQSALDTKGELALVATADPERLRRRLREATGKSVDIVFPKPAAANGGSSGREEANAAVQAQAQAQAQAQALLLAAGLQQQQQHGRPWYASSRGGYGPPPEPYVASYPATRVGRVPTQRPR

SEQ ID NO: 83002 - DNA, 901 bp, Zea mays
  misc_feature: Ceres CLONE 1568868
  misc_feature: Translation starting site: 75
  misc_feature (584)..(584): n is a, c, t, g, unknown, or other
  misc_feature (585)..(585): n is a, c, t, g, unknown, or other
  misc_feature (827)..(827): n is a, c, t, g, unknown, or other
ctccccgcggtggcggccgctctagaactagtggatcccccgggctgcaggaattcgtctcacccctagaaaaaatggcgtcgagcgacctcgccgagagcctcctccccggcggcgggggcggagcctccgcctcacatgacgaatacgaggagcgcgcgtacgactccgaggacaagatctccatcgccgtgtcggattccgacggcgaagacgacggcacgccggcgtcgcgcccgcccttctcgtggcggaagctctggcgcttcacgggcccgggttttctcatgtgcatcgcgttcctggacccgggcaatctggagggggacctacaggcgggcgccgcggcggggtaccagctgctgtggctgctcttgtgggcaacgatcatgggcgcgctgatgcagctgctctccgcccggctaggcgtggccacggggaagcacctcgccgagctctgccgccaggagtaccctccctgggccactcgcgcgctctgggccatgacggagctcgcgctcgtcggcgcagacatacaggaggtgattggcagcgcgattgcatcaagatcctctcggggggtnngcatacgctctggggtggcgtcgtcatcaccgcgctcgattgcttcatctttctcttcctggagaattatggcgtgaggaaactcgaggcatttttcgctgtactgattgcaactatggctgttttcttttgcggggtttggttgggtgaaacaaaagcctaggtggcaagggaaactccctgatcgggtgtgggggggtcccaaaaattggagttcaaaagacaattaagccaaggcgggntgggaaattggggggcctgcatcattcatggccccaaaaaggttttttcttggcttttcccgcacctaggtgcg

SEQ ID NO: 83003 - DNA, 934 bp, Zea mays
  misc_feature: Ceres CLONE 1568869
  misc_feature: Encodes the peptide sequence at SEQ ID NO. 83004
ccccgcggtggcggccgctctagaacttgtggatcccccgggctgcaggaattcgtctcacccctagaaaaatccagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccggggtcgggggcaaggcctcgcgcagcctccgcctcaagcgcccctcgtgccgcccccacggccgcctcgacgtccgcgtcgccgtcaaggagccgtccatgtactacgacccctacccctaccgtgcccccgcggcctacgccaacacgggcggcggcacccgtgacccctacggctcgtccgctgctgctgccggcggctactacggctccggaagcggatacggttcctgtgtgccccctcagggggggggggggggttaggggcccgccaaccctacaccggatcgcccccggggggggtacctttcaacttaaggggcccggcccgccgcctcaaccagggggagggtagggggctcctcctgccggctgaatagggggctcctccttgtcccccccccgcgccggttaggaaaccggcccctttgcttccaacgggaaaaaaaaaacaatggggggggggggcgggggt

SEQ ID NO: 83004 - protein, 192 aa, Zea mays
  misc_feature: Ceres CLONE 1568869
  misc_feature (7)..(95): Pfam Name: C2 Pfam Description: C2 domain
MGSRYEVEVTVGSARDLKNVNWRNGDLKPYAVVWIDSGSKCSTRVDLDNGESPAWDEKLLVPLPPTSRLDDAVLYVDVVHANAAQGVKPLVGSARLPLRDVLDDAGVGGKASRSLRLKRPSCRPHGRLDVRVAVKEPSMYYDPYPYRAPAAYANTGGGTRDPYGSSAAAAGGYYGSGSGYGSCVPPQGGGGG

SEQ ID NO: 83005 - DNA, 912 bp, Zea mays
  misc_feature: Ceres CLONE 1568870
  misc_feature: Encodes the peptide sequence at SEQ ID NO. 83006
  misc_feature (709)..(709): n is a, c, t, g, unknown, or other
  misc_feature (722)..(722): n is a, c, t, g, unknown, or other
  misc_feature (765)..(765): n is a, c, t, g, unknown, or other
gcggtggcggccgctctagactagtggatcccccgggctgcaggaattcgtctcacccctagaaaaaaccacctactccgcctgcgcctgcgagctgtgctgtgctgcgcaacggggagatccaatccacagaacaggatgcagtccaagcaccgggtcttcgcggaggacctgctcctggcggcggcggcggagggcgaggaccacttcgaccgggtgcccgactccctggtgctcctcatcttcaacaagctggccgacgcgcggtcgctggggcgctgctccgcggtgtcgcgccgcttcagcgcgctggtcccgctcgtggacgacgcctgcctgcgcatcgaccgcgtcatccccgccgacgccgccgacgcgggggcgccgcgcccgcgcgccgcgctctcgcacctcctcaagtccgtgctgctcgccgtgctcaagcccttcgcgcactgcgacgccaagtccgcgtcgccgcataagcacgcgcaccagcagcagcagcaccactcgcccgcccaggtgctcaggaacttcagcagcatccgcagcctccggatggagctcccggtctccgacgtgggcaccgacgacggcgtcgtgctcaggtggaaggccgtcttcggcagcacgctgcagagctgcgtcatcctcggcggcaccagggtgggacgttgcggggtacgcgcacgccccctcctcgggntcgctccccccgnggtcgacgacgacggctgcagcatcccggagtccctgtacacnacgggcgggctcagctgcgcgtcgtctggacatcagctcctcattcgcgcgccaccagcactacctcctccgcgaaacgtcaaggacaccccaccctcagcggtggccgctgacgaccccgcgggcaggacctcatcaggggcccac

SEQ ID NO: 83006 - protein, 258 aa, Zea mays
  misc_feature: Ceres CLONE 1568870
  misc_feature (191)..(191): Xaa is any aa, unknown, or other
  misc_feature (195)..(195): Xaa is any aa, unknown, or other
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPHKHAHQQQQHHSPAQVLRNFSSIRSLRMELPVSDVGTDDGVVLRWKAVFGSTLQSCVILGGTRVGRCGVRARPLLGXAPPXVDDDGCSIPESLYTTGGLSCASSGHQLLIRAPPALPPPRNVKDTPPSAVAADDPAGRTSSGAH

SEQ ID NO: 83007 - DNA, 859 bp, Zea mays
  misc_feature: Ceres CLONE 1568871
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (338)..(338): n is a, c, t, g, unknown, or other
nnnnnnnnnnnnnnnnnnnnnnnnnnnnnnnnnnnnnnnnnnnnnnnnnnnnnnnnnnnnnnnnnnnnnntttaaaagctggagctccccgcggtggcggccgctctagaactagtggatcccccgggctgcaggaattcgtctcacccctagaaaaaaggtaatccgacggaaacgactagggcgcggctagggcggggacagggtccggggaggccctgggcgcgggggcgccaagcgcatggcatcgtcgagggtgatgccgtcgtcctcgccgtcacacacagcctctgatctcgcgcgcctagcgcaagccgccagcatgtcccccggtcggncatggggcagcgggactgggctccatgaacgtggaggagactcctccgccgtcatccctacagcgaacatgccccacccccgggtcggccggccccgccgtcgggaaacccccgaaaccgcccctaaaggtttccccggggcccccgggcggccgggaaggtccgccacccccccgaaaggaaaccgccccaaaagaaaaaggtgtgtggaaaagaggaaaaaccccccccgggcgcggaaaagtgttgggccaaattgggggggggaaaaaccccccggtgtggccccccccccccggtgggggggggggggctcttaaaggggggttgtggcgggttcccccccgcgccggggggtggggggggggggggggggccccccggggggtggcccccccggaaaataataaaaaccccgggggagaagaaatttttttctcttgggccccccccctgtggataaaaatagaacccccccccccccataaaaaaaaaaaaaaaaaaaggggggggcgccctca

SEQ ID NO: 83008 - DNA, 918 bp, Zea mays
  misc_feature: Ceres CLONE 1568873
  misc_feature: Encodes the peptide sequence at SEQ ID NO. 83009
  misc_feature (487)..(487): n is a, c, t, g, unknown, or other
ccccgcggtggcggccgctctagaactagtggatcccccgggctgcaggaattcgtctcacccctagaaaaaacaaggccgagcagaggcagaggcagaggcagttcctctcatggaggcgtccttgctcgtggctcccaagccttccatgcccaggaccatcttctccgccaggcgagccggtcggagttggaggtgcctcgtcgtcgctgccaccatcaagcaacaactcggcacacggtcagaaagtgtggacgtcgatgcgccggtcgagcacctagcgccgccttcgaaggcgacgacgggagctcgcggcggcctgctcgccgccgtggcgacgacaacgagcagctgcacggcagtgttaccgtgtcacgccttatcaggcgccggagcggtggaatcgggaccgtggtggtggacgtcgccgctggacaccctgtaccgcgcggcggcggtgctgggcgacctggacccggcgacggcncgggcggtggcgggcgtggcggggccggtgctgtcggcgttcggcttcctgttcatcctgcggatcgtcatgtcgtggtacccgaggctccccgtgacggagttcccgtacgtagtggcgtacgcgcccacggagccgttccctcgcgtcacgcgcagggtcatcccgccgctcggcggcgtcgatgtcacgcccgtcgtctggttcggcctcgtcagcttcgccagcgagatcctcgtcggggcacaggggcctgctcgttctcctctcgcagcagcgctagcgaccactgcgtttctgcttccatccttcgatgaacaaatagtagtcatttttacaatggcacacttcggccattatcatttgattttaagaggaatttaggtggccctcgctatcgggcccttatttataatggtacgctatccctt

SEQ ID NO: 83009 - protein, 252 aa, Zea mays
  misc_feature: Ceres CLONE 1568873
  misc_feature (128)..(207): Pfam Name: YGGT Pfam Description: YGGT family
MEASLLVAPKPSMPRTIFSARRAGRSWRCLVVAATIKQQLGTRSESVDVDAPVEHLAPPSKATTGARGGLLAAVATTTSSCTAVLPCHALSGAGAVESGPWWWTSPLDTLYRAAAVLGDLDPATARAVAGVAGPVLSAFGFLFILRIVMSWYPRLPVTEFPYVVAYAPTEPFPRVTRRVIPPLGGVDVTPVVWFGLVSFASEILVGAQGPARSPLAAALATTAFLLPSFDEQIVVIFTMAHFGHYHLILRGI

SEQ ID NO: 83010 - DNA, 903 bp, Zea mays
  misc_feature: Ceres CLONE 1568874
  misc_feature: Encodes the peptide sequence at SEQ ID NO. 83011
  misc_feature (694)..(694): n is a, c, t, g, unknown, or other
ctccccgcggtggcggccgctctagaactagtggatcccccgggctgcaggaattcgtctcacccctagaaaaagtcctcctcctgttctttgtttcccgtcccatcgtgtgtgagcgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtcgggagcctgagcgctgagtggctggccgatgagaggacccaggtcgtcggcactttccctcccaagaagagagggtggaccggcttagtggagaagggacaccgccggccagaccaacatctactccgtcgagccgatggtgtacgtggccgagagcgccatcagctccggcacgggcggtacgtcggcggagggcgccgtagaacacgccgccatcgccgcggggctcgtcctcatcaccgtagccgcgggctcggtcatcctcatcccagtgaaacagacccagtgcccgcagtgccggatagcgnctacagcggcccgcgctcagctactacgtcacaagttccagccgggggtggctgccccgggccataacctctaagcccccgcccccgccgagcaaaaagacggggcgcccccaccgtctaaggttccggagttaccgccccccactggcccccgggagctaatctgttttggggattgccccttttcctcggatgtaccattcccctgt

SEQ ID NO: 83011 - protein, 200 aa, Zea mays
  misc_feature: Ceres CLONE 1568874
  misc_feature (179)..(179): Xaa is any aa, unknown, or other
MACPAQSMLSASGCIFLRSKPQAASQVRGGIIGGGRSSRPFLLTCNASSSPSPSSPAPAQEDPDCNEEECAPEKEVGSLSAEWLADERTQVVGTFPPKKRGWTGLVEKGHRRPDQHLLRRADGVRGRERHQLRHGRYVGGGRRRTRRHRRGARPHHRSRGLGHPHPSETDPVPAVPDSXYSGPRSATTSQVPAGGGCPGP

SEQ ID NO: 83012 - DNA, 940 bp, Zea mays
  misc_feature: Ceres CLONE 1568875
  misc_feature: Encodes the peptide sequence at SEQ ID NO. 83013
  misc_feature (752)..(752): n is a, c, t, g, unknown, or other
  misc_feature (779)..(779): n is a, c, t, g, unknown, or other
  misc_feature (825)..(825): n is a, c, t, g, unknown, or other
acccgcggtggcggccgctctagaactagtggatcccccgggctgcaggaattcgtctcacccctagaaaaaatgcactagctcctcctctcttgcccaccagcgactcccgtagctggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaagaggagttctgcatcgagaaagtggagttcgatgacaagaaggagaagaaggtggtggtggtgcgtgggaagttcgacgccgagaagctctgcaagaaggtgtggtccaaggccgggaagatcgtgaaggggattgtcatcgctgaggtgtggccaataccagccccgcccaaggagtgcaagcctgaggcaccgaaatgttgcgactgtgagaagtgcaagcccatgcccaagcctgagccaccgaaatgttgcgactgtgagaagtgcaagcccaagcccaagcctgagccaccgaaatgttgccactgtgagaagtgcaagcccaagcctgagcctccaatacagagaaatgctgcagtgcctgttgtcactgcaagcctaagcctgatcccatacgctgatatgttgtgtctgttgcactgcaagccgggagagaaggagagaagaaggaagaaagaggacgatagtagccgcgcgggncaaaccgagtacagtttgtgccctccngtacctgctgcgaacccgcgatgtgcctatctggcgtggagtgccngctcagcacagtgcagtgctgcagaagcctcggctcgccgccatgtcgcgccaaccgccgcgtgcactgtctagcagcgcctgtgtctgcgaagaaacgcggggtctgcaccgtg

SEQ ID NO: 83013 - protein, 236 aa, Zea mays
  misc_feature: Ceres CLONE 1568875
  misc_feature (213)..(213): Xaa is any aa, unknown, or other
MGILVITVDLDCCRCRAKITKVLDCLKEEFCIEKVEFDDKKEKKVVVVRGKFDAEKLCKKVWSKAGKIVKGIVIAEVWPIPAPPKECKPEAPKCCDCEKCKPMPKPEPPKCCDCEKCKPKPKPEPPKCCHCEKCKPKPEPPIQRNAAVPVVTASLSLIPYADMLCLLHCKPGEKERRRKKEDDSSRAGQTEYSLCPPVPAANPRCAYLAWSAXSAQCSAAEASARRHVAPTAACTV

SEQ ID NO: 83014 - DNA, 901 bp, Zea mays
  misc_feature: Ceres CLONE 1568877
  misc_feature: Encodes the peptide sequence at SEQ ID NO. 83015
ggccgctctagaactagtggatcccccgggctgcaggaattcgtctcacccctagaaaaaaagtccggagcaacagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgtcctctccgtcgtctcattcccgcacctgtccctccccgcctcgtcccatccgctcccgcaggaagctgctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgaccgtgacgccgcggcgcgggttcgagcgctgcgccacggacacgttccgcgtcgccgggccctgcggctacggcgtctgctacctctacatgcgccgggtcgggccgccgccgccgggtgggacgcccgagtgggtcaggttgtaccaaccggggtccggggcgcccctccacctttctattacggggaacggctccccgacggggtttgggtagggtttcaaacgctgcgtcaaaggccgggggccggcgcctcttgccaaaattggggcccccgggccggaacacttgtaaaggaacgaaccccgaaaccctcccggttccttgggggaaaagggggagaggttacaaagaccccctcttggggccgggggggtccttgcgttcccgggg

SEQ ID NO: 83015 - protein, 178 aa, Zea mays
  misc_feature: Ceres CLONE 1568877
  misc_feature (53)..(173): Pfam Name: ATS3 Pfam Description: Embryo-specific protein 3, (ATS3)
MASGAVPPQRVALLALAVLSVVSFPHLSLPASSHPLPQEAAAAAAAGAAAGGEASEPHGTAADGAAVARRACTYTVQIKTSCASPRSSADAVSLAFGDAYRNEVYAATVTPRRGFERCATDTFRVAGPCGYGVCYLYMRRVGPPPPGGTPEWVRLYQPGSGAPLHLSITGNGSPTGFG

SEQ ID NO: 83016 - DNA, 857 bp, Zea mays
  misc_feature: Ceres CLONE 1568878
  misc_feature: Translation starting site: 147
  misc_feature: SWISSPROT Homolog: EC 1.11.1.11 L-ascorbate peroxidase
  misc_feature (490)..(490): n is a, c, t, g, unknown, or other
tccccgcggtggcggccgctctagactagtggatcccccgggctgcaggaattcgtctcacccctagaaaaaaagcagatcttgtgaccctccctcagccgcgtcgcgtcccatcctacgatccaaaggtctctctgctcgcagccatggcgaagaactacccgaccgtgagcgccgagtacagcgaggctgtcgagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattccttnccaccccggtagggaggacaagcctcaacccccacctgagggcccgcctcctgacgccacctaggggtctgaccacctgaaggcagttttttgccaagcagatgggcttgaacgatcaagaaattgttgccctctctgggggccacaccttggggaaggggccccaaagaacgggtctggtttcaagggggctggactacaaacccttggggtcttgaacaactcttacttcagggactttcggaatggggaaaagggagggcctttctttaactccccaggggaaaaaacccgtgctgagagacccggtttttccccccccctttgcaagaaattttctgcgggaaaaaaaaaggcttttccttgt

SEQ ID NO: 83017 - DNA, 739 bp, Zea mays
  misc_feature: Ceres CLONE 1568883
  misc_feature: Encodes the peptide sequence at SEQ ID NO. 83018
  misc_feature (536)..(536): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (710)..(710): n is a, c, t, g, unknown, or other
  misc_feature (712)..(712): n is a, c, t, g, unknown, or other
  misc_feature (714)..(714): n is a, c, t, g, unknown, or other
  misc_feature (717)..(717): n is a, c, t, g, unknown, or other
  misc_feature (732)..(732): n is a, c, t, g, unknown, or other
ctccccgcggtggcggccgctctagaactagtggatcccccgggctgcaggaattcgtctcacccctagaaaaaattccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgccccacatggtttatgttctgacaagtccgacagggcactacctccccagcaaggtcaagaaggttgggggtcccaacttcctgagctggagtggccctgatgcccaacgggcctactgcccctaatttgctccaaacgggccccccaaaacccaagggaatccggggagggggctgcccaccctcaattgggggccccaaaaagtttgtttggggccccccccccgagaggaaaaaaaanccgggtttttttttttaaaaaaaaaatggggggggcccctttccttttgggggggaaaaacccccggcccgggggcggggggaaaccaaaaaaaaaaaggggcccccccccctttttttggcgacggggggccccccaaaaaggggggggggatcccccccccccnnnnnnnanantntanatataataaataaanacaataa

SEQ ID NO: 83018 - protein, 94 aa, Zea mays
  misc_feature: Ceres CLONE 1568883
  misc_feature (14)..(94): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPHMVYVLTSPTGHYLPSKVKKVGGPNFLSWSGPDAQRAYCP

SEQ ID NO: 83019 - DNA, 916 bp, Zea mays
  misc_feature: Ceres CLONE 1568888
  misc_feature: Encodes the peptide sequence at SEQ ID NO. 83020
ctccccgcggtggcggccgctctagaactagtggatcccccgggctgcaggaattcgtctcacccctagaaaaagctctctcctttgcacccctagctagctagtactactgctgctcctccgacttgctcttcggtttgcttctcttgcctgcctgttgtttcgatccgaatccatctcatgttcttgctgagtttcgcttgatgaccatatatatatatatatatgcttgtttgattttttttctttgcagcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaaccggattgggtggggctgccggcaagcgtcaagttcgatccaactgaccaggagctgatcgagcacctcggaggcgaaagtgtaagatgaaggctcgagatctcaccctctcatcgacgagtttcatacccccaatagattgggggagaacggcttttgttcacccaccccgaaaaacctccaggggtgacaaaggaaggccctaagcaaggactttttttcacgggccggtcaaaggcctaaccaaggggccccagggaaaaaggggaaattccccccgggggggcccaccccccaggggggggaaacaagtggggccaaaacccgcgaaaaaacccgccccgggttattggaaaaagcgccccaaaaaaggggggcaaaaaaatatttttggtgggttacacacactttttgtgggacacccccccgcggccggagaaaaaaaaaa

SEQ ID NO: 83020 - protein, 66 aa, Zea mays
  misc_feature: Ceres CLONE 1568888
MNRAHSSSSKLINEKLVEHRISTAKHCPHCGEKIDSKPDWVGLPASVKFDPTDQELIEHLGGESVR

SEQ ID NO: 83021 - DNA, 992 bp, Zea mays
  misc_feature: Ceres CLONE 1568889
  misc_feature: Encodes the peptide sequence at SEQ ID NO. 83022
  misc_feature (442)..(442): n is a, c, t, g, unknown, or other
ctccccgcggtggcggccgctctagaactagtggatcccccgggctgcaggaattcgtctcacccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctgtttaagatgcttctcaagtacgggcctgaagacnaggctgccaagaaggagagcttctgaagaagggcccaagctgaaaatgagggaaaaacggtggagtccaagaaaacaatgggttggaaagttggcccttaccctgggaacttccccctttggaccaaaacaaggtccaccttggtggccctcccctcaggaccgggatcccaattgaaacgggtttggtggggcttccaacccccttccaggaaaaataagaagccccttttccggcttttttaaaaggaaggcccccctctggaatcattttgtcccaaaaaaaaaagggcacccctttggggtcccccccctttacaaaaaaagaataatccgtggtttcccaaaaatctttgggggtttttagggaaatctccacaaatttttttttggggcgaaaaaaagggggggggggggtctttggggtctatatttggggggaaaaacaaggggcgggaataaactcccccaaaagagggcccgcaccaaaaacaatttttctcccttggtgtcccccccctttttgagggaaaaaaaaacccttttttttt

SEQ ID NO: 83022 - protein, 107 aa, Zea mays
  misc_feature: Ceres CLONE 1568889
  misc_feature (100)..(100): Xaa is any aa, unknown, or other
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYGPEDXAAKKESF

SEQ ID NO: 83023 - DNA, 932 bp, Zea mays
  misc_feature: Ceres CLONE 1568890
  misc_feature: Translation starting site: 122
  misc_feature (658)..(658): n is a, c, t, g, unknown, or other
  misc_feature (833)..(833): n is a, c, t, g, unknown, or other
  misc_feature (836)..(836): n is a, c, t, g, unknown, or other
ctccccgcggtggcggccgctctagaactagtggatcccccgggctgcaggaattcgtctcacccctagaaaaaccccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcatgatccagggctactcgctcgccaagggcatgggcgtcgggaagcacatcgccagcgacaccttcaccgtcggcggctaccagtgggcgatctacttctacccagacgggaagaaccccgaggacaactccggctacgtctcggtcttcatcgcgctcgcgtccgacggcaccgacgtgcgtgcgctcttcgagctcacgcttctagaccagagtggcaagggcaagcacaaggtgcactcgcactttgaccgctccctagagtccggaccgtacaccctcaagtaccgcggatccatgtggggctataaaaggttctttcggcgtaatgctcttgagcaatcagattttcttaaagatgattgcttgaagataaactgtactgtngggtgttgtagtatcaactatggattattccagggccacattcatagaggttccagagtctgacataggctatcattttgggactcttttggacactctggaaggtgtagatgtcatttttagtgtagcaggagagaagttcatgccccataagtggtattggctgcccgatctnccntttttagatctgaattttcgaccatggatctgatgaggagagaacgaactgggtacggggatgaaaatcagagatcgttattgagatttggatccg

SEQ ID NO: 83024 - DNA, 909 bp, Zea mays
  misc_feature: Ceres CLONE 1568892
  misc_feature: Translation starting site: 163
  misc_feature: SWISSPROT Homolog: EC 4.1.1.33 Diphosphomevalonate decarboxylase
  misc_feature (765)..(765): n is a, c, t, g, unknown, or other
  misc_feature (766)..(766): n is a, c, t, g, unknown, or other
  misc_feature (885)..(885): n is a, c, t, g, unknown, or other
ctccccgcggtggcggccgctctagaactagtggatcccccgggctgcaggaattcgtctcacccctagaaaaaaaacaggtcggacggaccctttgccggagacgagcacacgccacagcaggaattatcgggcgtagagcagcgcgaagcgagagatccaatggcggcggcggaggggcagtgggtgctcatggcaacggggcggacgccgactaacattgcggtgatcaagtactgggggaagcgggacgaggcgctcatcctccccatcaacgacagcatcagcgtaacgctcgaccctgaccatctctccgccaccaccactgtcgccgtcagcccctcattcccttccgaccgcatgtggctcaatggcaaggagatctcgctattaggaggaaggtttcagagctgcctcagagaaatcagaaagcgtctcgtgactttgaggacaaggagaagggcgtcaagatcaagaaagaggactgggacaagttgcatgttcacatagcctcgtacaacaacttccccactgctgctggtttggcctcttcggctgctggccttgcctgtttcgttttcacccttggaaagctgatgaatgtgaaagaagattatggagaactttcttcatagcaaggcagggatctgggagtgcatgccgcagtatatatgggtggttttgtgaaatggtgcatgggagaaaaagatgatggaagtgacagtattgccgtgcagcttgctgacgaacacactggaatgatcnntgtattattattgcagtggtcagttcaaagcagaaagaaccagtagcaccagtgggatgcgagatagtgttgaaacagtccctctctgcagtacaaggccagacggtggggccaagtcngggtgttgaaaatggaagaagcac

SEQ ID NO: 83025 - DNA, 975 bp, Zea mays
  misc_feature: Ceres CLONE 1568893
  misc_feature: Encodes the peptide sequence at SEQ ID NO. 83026
  misc_feature (975)..(975): n is a, c, t, g, unknown, or other
ctccccgcggtggcggccgctctagaactagtggatcccccgggctgcaggaattcgtctcacccctagaaaaaccccagcttgctcagtagtggttgctagcatacatatccaatccaattatattgctacaatacaggcctacaccctcagctcaacgtcgacgtcggcgatgtgtctgccgttctcctgttgccaccgcggtgaccatgacacaaaggagtctgaagtggaaagccaaccttattatcatccgtctcctgtgaaagaagcacatgatggtcaccgtgcgaccaacgacatgcctcccgtcgtcgaggacaacagcaagaacggaggagggcacacgacgggtttcagcagccactcagacgacggcgttgtccgacccccacagacgacgataactaccgagaagatcgtggcgccgcccaccactactccagcaccgcaagctgcttctagggatctggctgtgcagcaagctcctcagggtacgtatgtctctgctagtcgtcctcgccacaaccatgggcgtgggtcgtctgcagcatcgcctcccagcgaagccgtcgtcacaaagtcgtactaccgattgctcggcgtgggtggtgaggactactagatagttaccctactgcatgctgcggccacagaagccgcctattatccccaaaaaatttctcggttcgttctactctacccctttcgtgaccccttaatattgatcctctggggccctttttggggaaaacaaagaattttttgcaccaaccgccgtgtaaggtccgaacatctcccgcggggaaactttctccaacggcattttccggaaaataaactgagagaacccggcttgaagaaaacccttgcgccccccctttgccgggtggggcaataccataagtgctccctacaaaaagcagcacaattatattcccctccaccccaccttatatttattggcaattgggn

SEQ ID NO: 83026 - protein, 150 aa, Zea mays
  misc_feature: Ceres CLONE 1568893
MCLPFSCCHRGDHDTKESEVESQPYYHPSPVKEAHDGHRATNDMPPVVEDNSKNGGGHTTGFSSHSDDGVVRPPQTTITTEKIVAPPTTTPAPQAASRDLAVQQAPQGTYVSASRPRHNHGRGSSAASPPSEAVVTKSYYRLLGVGGEDY

SEQ ID NO: 83027 - DNA, 829 bp, Zea mays
  misc_feature: Ceres CLONE 1568894
  misc_feature: Encodes the peptide sequence at SEQ ID NO. 83028
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
ctggagctccccgcggtggcggccgctctagaactagtggatcccccgggctgcaggaattcgtctcacccctagaaaaaaagggaaacacaggaacgacaggcaattcgaggcgggcaatctaatcgtctgccatcccgtctcatcgttctcccaaatctgagagcgttcccaggacctagggttcttgagatccagccccaggatggatccgaaccctagagctcccctcctcctcgccatcgtcgttctcgcgcttggcgtatccgtggtggccagcgccgaggacgacgcgtcgggggtctctctgggccgccgcgccggggggttcttgcacggcctgaagaaggatgcactggcggagggcgatcatggggtggcactagacgaagttggaccggggctgttcgacgcactctttgccagcctctccatgatactagtcagtgagattggagatgagaccttcatcattgctgccctgatggcgatgccgccaccccaaccaaattgggttgtgccggggggcttatcctgcgcttttttgtgaagaaagattttggcaaacggggacttgggaaaaaattggccccaatttttgttttctggggggaacccccccctattggggggggcccccaaatttttttgacaatttttttttttgggaaaaaaacgggggggggggttttttttttgcgcggggaaaaaaaannnntttaccccccccggggggggccccccccccaaaagggaggggggggggggtaaaaaaaaaactctttattctgggggggggggggaggagaagaaaaccaccccccccggc

SEQ ID NO: 83028 - protein, 114 aa, Zea mays
  misc_feature: Ceres CLONE 1568894
MDPNPRAPLLLAIVVLALGVSVVASAEDDASGVSLGRRAGGFLHGLKKDALAEGDHGVALDEVGPGLFDALFASLSMILVSEIGDETFIIAALMAMPPPQPNWVVPGGLSCAFL

SEQ ID NO: 83029 - DNA, 924 bp, Zea mays
  misc_feature: Ceres CLONE 1568896
  misc_feature: Encodes the peptide sequence at SEQ ID NO. 83030
  misc_feature (830)..(830): n is a, c, t, g, unknown, or other
ctccccgcggtggcggccgctctagaactagtggatcccccgggctgcaggaattcgtctcacccctagaaaaaatctcaagccaccatcgaccttcaagtctcgctacgtagcagtgcaataaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctcggcgaggtcgtcgacccgctctatcccggcggcagcttcgaaccgctcggcctcgccgacgaccccgtaggcctcgctgagctcaagggtgaaggagctcagacggccccgctcgccatgtctccatgttcggattttctcgtcagncatcgtcaccggaagggcccgctcgagaactcgctgaacacattgcgacccgtcaacacaacgcttggggctacgccacacttcgtccgggaaa

SEQ ID NO: 83030 - protein, 262 aa, Zea mays
  misc_feature: Ceres CLONE 1568896
  misc_feature (65)..(218): Pfam Name: Chloroa_b-bind Pfam Description: Chlorophyll A-B binding protein
  misc_feature (231)..(231): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFEPLGLADDPVGLAELKGEGAQTAPLAMSPCSDFLVXHRHRKGPLENSLNTLRPVNTTLGATPHFVRE

SEQ ID NO: 83031 - DNA, 1121 bp, Zea mays
  misc_feature: Ceres CLONE 1568899
  misc_feature: Encodes the peptide sequence at SEQ ID NO. 83032
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
tcaatgttatttacacacttctccctccacaccctgaaattggcaaaaaaaataaaannnnnnnnntttttttttctggaactccccgcggtggcggccgctctagaatagtggatcccccgggctgcaggaattcgtctcacccctagaaaaactccgcctcccaagtcccacccccactccctcgctcaccagaggaactagcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggctgcggccgcggccaataagcagcagcagcagcagcagcggtgccgtgtgactgcggacccccccacagccagggcccggtagtaagggagctccccaaggacaaggaggagggacttcgaggccgacttcccgcgagtttcgaagcgcggccctcggcgaaggatgaccgtgggacaagcgagcggccaaaaggcggcgtaccccggtaggtcccagggagccttcccctcccgccggggatacccgaacgaaaggtttttgccctttcgcccaaccggccgggcccaaatggccgggccaagttttaatttgggcggtggaattgaacctccccctcccctccccaaaaagggtattggctccccacggggaagaaaatatgaagccccagttataaaaaaaacccccgggcgccccgggaaaaagaaaaccactgttacaagggggggaatatacaggtgccagcggggtccctttggtgggggacaaaatgggggcccagcctcgaaaaattcagtggaacccccttaacaatggggggggcccccgcggtctggggctccggataacccccacacaccccccccccaaggaaggcgactcttgggggaataccaaacgccacatactccccgagaaaccccccgcgcaaaaaaacgccaatgggtattttttccccaatatagcgtaaggggacccgtttaaag

SEQ ID NO: 83032 - protein, 45 aa, Zea mays
  misc_feature: Ceres CLONE 1568899
MCGGAILSGFIPPSGVAAAAAAANKQQQQQQRCRVTADPPTARAR

SEQ ID NO: 83033 - DNA, 842 bp, Zea mays
  misc_feature: Ceres CLONE 1568900
  misc_feature: Encodes the peptide sequence at SEQ ID NO. 83034
  misc_feature (545)..(545): n is a, c, t, g, unknown, or other
ctccccgcggtggcggccgctctagaactagtggatcccccgggctgcaggaattcgtctcacccctagaaaaatccttgccacacttgcgctcctctccgagactccgagttgtcgtctccgtcgctgctggctgctgcgccactcccccagccccgagatctgctcaacaatggcgacgcggcgccacatcctcctcctcgccgctgccttcgtgtcccttctcgcgctcgaggctgtggagggcctcgaagaggggccccgcgggcgccggctgctggtcctgctggacgacctggccgtgcggtcgtcgcactcggccttcttcggctcgctccaggcgcgcgggttcgatctcgaattccgcctcgccgacgaccccaagctctcgctgcaccgctacggccagtacctctacgatggcctcgtgctgttcgccccctccaccccacgttttggtggatcagtggaccagaacgcagtccttgaaatttatgatgctgggcatgatatgatcctggcggcagattcctctgcctctgatnctattcgtggcatgcgacagagtgtgggggtgattttgatgaggatccagagcaatgggttatggacccatttactatgccgctatgaatggttgaagcgatcacaccttggatgtgggggatgatcttattcaaccgatgtcctacgggggccaaaaaagatgagggccccggtttatttcggggaattggaacccgggtaatccctccaaaaagttgggttcggaaaagccatattggccccccctaggttttccgggtaacaaaaaaatagagtttttgtggcccccccacctt

SEQ ID NO: 83034 - protein, 165 aa, Zea mays
  misc_feature: Ceres CLONE 1568900
  misc_feature: SWISSPROT Homolog: EC 2.4.1.119 Dolichyl-diphosphooligosaccharide--protein glycotransferase
  misc_feature (125)..(125): Xaa is any aa, unknown, or other
MATRRHILLLAAAFVSLLALEAVEGLEEGPRGRRLLVLLDDLAVRSSHSAFFGSLQARGFDLEFRLADDPKLSLHRYGQYLYDGLVLFAPSTPRFGGSVDQNAVLEIYDAGHDMILAADSSASDXIRGMRQSVGVILMRIQSNGLWTHLLCRYEWLKRSHLGCGG

SEQ ID NO: 83035 - DNA, 1041 bp, Zea mays
  misc_feature: Ceres CLONE 1568901
  misc_feature: Encodes the peptide sequence at SEQ ID NO. 83036
  misc_feature (392)..(392): n is a, c, t, g, unknown, or other
  misc_feature (422)..(422): n is a, c, t, g, unknown, or other
ctccccgcggtggcggccgctctagaactagtggatcccccgggctgcaggaattcgtctcacccctagaaaaagccgaggaaagaataaacggcgagccgcccgtcaaacaatcgttaaacccagaagcctcctcgtcctctctctgactctctctcaccctctcccctccctcggggtcgcggttgcttcctcgcggccgattcgtatcttccgtggcagcagggagggtacggtactcctccggccggcgggaggagaagaggagcttcgagatgggggcgtccctcgcttccgcgggcttggtgaactacccgcttgtcgcggcgctcctcgcgttcgctctcgcgcagtcctccaagtttcttcaccacctggtacaaagaaggtcngcgggatgccagacaacttatagccttctngcggggatgccatcttcccactcagcttcggtgacagcacttttcatgggcagggggaaaccaagaaaggttttccttagtgcaaccttttgcaacctgccctaggccctttgcattgggtgggttatgccaggaagccttttgggagtttcggtttacctgccccggaataccagggcaaaaggggcctaaaccaaaattgggcctttaacccggcccaaaaggaaccccccttttttcaaaaaacaaaaaccccctggggggggaaaatccccggggaaaaatgcggtgttcctccgggggtgggggccgggggggcgcccccgtggaaaacccccccgggggggggcgcttttaggcttttgggcccctccgggggagggttttttacaacaaggtgtgttccccccctatttcctcgccggggtggggcgcccaaaagcaaaaaaaatttgtccccccccggggggtggggggtcgccaaggtttcctaaaaacaacattctcccccccaatttttatcccgcgccggggtgttttcgggggttgcccccgtgggtggtttgattatataagagaggctcttttttcccccgccgggggggaggatgtttgtttc

SEQ ID NO: 83036 - protein, 83 aa, Zea mays
  misc_feature: Ceres CLONE 1568901
MGASLASAGLVNYPLVAALLAFALAQSSKFLHHLVQRRSAGCQTTYSLLAGMPSSHSASVTALFMGRGKPRKVFLSATFCNLP
